United States Patent 11,692,002 (RNA SEQUENCE ADAPTATION) - sequence listing, part 5

SEQ ID NO: 13829 - RNA, 1701 nt, Artificial Sequence
  derived and/or modified CDS sequence (AUadapt) from InfluenzaA__ALE32100__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccucggggcgcaucaccgugagcacgaagcggucccagcaggccgugaucccgaacaucggcucgcgcccccggauccgcgacauccccucccggaucagcaucuacuggaccaucgucaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgaccugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 13830 - RNA, 1701 nt, Artificial Sequence
  derived and/or modified CDS sequence (AUadapt) from InfluenzaA__ALE32101__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagccagugcuaccccuacgacgugccggacuacgcgucccugcgcucgcuggucgccuccagcggcacccucgaguucaacaacgaguccuucaacuggacgggggugacccagaacggcaccucguccgccugcauccgcaagagcuccgggucguucuucucccggcugaacuggcugacccaccucaaguacacguaccccgcccugaacgugaccaugcccaacaacgagcaguucgacaagcuguacaucuggggcguccaccaccccgggaccgacaaggaccagaucuuccucuacgcgcggagcuccggccgcaucaccgugucgacgaagcggagccagcaggccgugaucccgaacaucggcucccgcccccggauccgcgacauccccucgcggaucuccaucuacuggaccaucgucaagcccggggacauccugcugaucaacagcaccggcaaccucaucgccccgcgcggguacuucaagauccgguccggcaagucguccaucaugcgcagcgacgcccccaucggcaagugcaaguccgagugcaucacccccaacgggucgauccccaacgacaagccguuccagaacgugaaccggaucacguacggcgccugcccccgcuacgugaagcacuccacccugaagcuggcgaccgggaugcggaacguccccgagaagcagacccgcggcaucuucggggccaucgccggcuucaucgagaacggcugggaggggaugguggacggcugguacggguuccggcaccagaacagcgagggccgcgggcaggccgccgaccucaaguccacgcaggcggccaucgaccagaucaacggcaagcugaaccggcugaucggcaagaccaacgagaaguuccaccagaucgagaaggaguucucggagguggaggggcgcauccaggaccucgagaaguacgucgaggacaccaagaucgaccugugguccuacaacgccgagcugcucguggcccuggagaaccagcacaccaucgaccugacggacagcgagaugaacaagcuguucgagaagaccaagaagcagcuccgcgagaacgccgaggacaugggcaacgggugcuucaagaucuaccacaagugcgacaacgcgugcaucggcuccauccggaacgggaccuacgaccacaacguguaccgcgacgaggcccugaacaaccgguuccagaucaagggcgucgagcucaagucgggcuacaaggacuggauccuguggaucuccuucgccaucagcugcuuccugcucugcguggcccugcugggguucaucaugugggccugccagaagggcaacauccgcugcaacaucugcaucuga

SEQ ID NO: 13831 - RNA, 1701 nt, Artificial Sequence
  derived and/or modified CDS sequence (AUadapt) from InfluenzaA__ALE32102__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccgcaagagcuccagcuccuucuucucgcggcugaacuggcugacccaccucaaguacacguaccccgcccugaacgugaccaugcccaacaacgagcaguucgacaagcuguacaucuggggcguccaccaccccgggaccgacaaggaccagaucuuccucuacgcgcgguccagcgggcgcaucaccgugucgacgaagcggucccagcaggccgugaucccgaacaucggcagccgcccccggauccgcgacauccccucccggaucucgaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccuguccaaccgguuccagaucaagggggucgagcucaagagcggcuacaaggacuggauccuguggaucagcuucgccaucuccugcuuccugcucugcguggcccugcugggcuucaucaugugggccugccagaaggggaacauccgcugcaacaucugcaucuga

SEQ ID NO: 13832 - RNA, 1701 nt, Artificial Sequence; identical to SEQ ID NO: 13399
  derived and/or modified CDS sequence (AUadapt) from InfluenzaA__ALE32103__HA

SEQ ID NO: 13833 - RNA, 1701 nt, Artificial Sequence
  derived and/or modified CDS sequence (AUadapt) from InfluenzaA__ALE32104__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccagaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgcuccaaggccuacagcaacugcuaccccuacgacgugccggacuacgcgucccugcggucgcuggucgccuccagcggcacccucgaguucaacaacgaguccuucaacuggacgggggugacccagaacggcaccucguccgccugcauccgccggagcuccucguccuucuucagccgccugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccucggggcggaucaccgugagcacgaagcgcucccagcaggccgugaucccgaacaucggcucgcggccccgcauccgggacauccccucccgcaucagcaucuacuggaccaucgucaagcccggcgacauccugcugaucaacuccaccgggaaccucaucgccccgcggggcuacuucaagauccgcucggggaaguccagcaucaugcgguccgacgcccccaucggcaagugcaagucggagugcaucacccccaacggcuccauccccaacgacaagccguuccagaacgugaaccgcaucacguacggggccugcccccgguacgugaagcacagcacccugaagcuggcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagucgacgcaggcggccaucgaccagaucaacgggaagcugaaccgccugaucggcaagaccaacgagaaguuccaccagaucgagaaggaguucuccgagguggagggccggauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccgcaacggcaccuacgaccacaacguguaccgggacgaggcccugaacaaccgcuuccagaucaagggggucgagcucaaguccggcuacaaggacuggauccuguggaucagcuucgccaucagcugcuuccugcucugcguggcccugcugggcuucaucaugugggccugccagaaggggaacauccggugcaacaucugcaucuga

SEQ ID NO: 13834 - RNA, 1701 nt, Artificial Sequence; identical to SEQ ID NO: 13344
  derived and/or modified CDS sequence (AUadapt) from InfluenzaA__ALE32105__HA

SEQ ID NO: 13835 - RNA, 1701 nt, Artificial Sequence; identical to SEQ ID NO: 13344
  derived and/or modified CDS sequence (AUadapt) from InfluenzaA__ALE32106__HA

SEQ ID NO: 13836 - RNA, 1701 nt, Artificial Sequence; identical to SEQ ID NO: 13399
  derived and/or modified CDS sequence (AUadapt) from InfluenzaA__ALE32107__HA

SEQ ID NO: 13837 - RNA, 1701 nt, Artificial Sequence; identical to SEQ ID NO: 13629
  derived and/or modified CDS sequence (AUadapt) from InfluenzaA__ALE32108__HA

SEQ ID NO: 13838 - RNA, 1701 nt, Artificial Sequence; identical to SEQ ID NO: 13243
  derived and/or modified CDS sequence (AUadapt) from InfluenzaA__ALE32109__HA

SEQ ID NO: 13839 - RNA, 1701 nt, Artificial Sequence; identical to SEQ ID NO: 13230
  derived and/or modified CDS sequence (AUadapt) from InfluenzaA__ALE32110__HA

SEQ ID NO: 13840 - RNA, 1701 nt, Artificial Sequence; identical to SEQ ID NO: 68
  derived and/or modified CDS sequence (AUadapt) from InfluenzaA__ALE32111__HA

SEQ ID NO: 13841 - RNA, 1701 nt, Artificial Sequence
  derived and/or modified CDS sequence (AUadapt) from InfluenzaA__ALE32112__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacgccuaccccgcgcugaacgugacgaugcccaacaacgagcaguucgacaagcuguacaucuggggcguccaccaccccgggaccgacaaggaccagaucuuccucuacgcccaguccucggggcgcaucaccgugagcaccaagcggucccagcaggccgugaucccgaacaucggcucgcgcccccggauccgcgacauccccucccggaucagcaucuacuggacgaucgucaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucaccuacggggcgugcccccgcuacgugaagcacagcacgcugaagcuggccaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgcggaccucaagucgacccaggccgccaucgaccagaucaacgggaagcugaaccggcugaucggcaagacgaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugaccgacuccgagaugaacaagcuguucgagaagacgaagaagcagcuccgcgagaacgcggaggacauggggaacggcugcuucaagaucuaccacaagugcgacaacgccugcaucgggucgauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggcgugccagaaggggaacauccgcugcaacaucugcaucuga

SEQ ID NO: 13842 - RNA, 1701 nt, Artificial Sequence
  derived and/or modified CDS sequence (AUadapt) from InfluenzaA__ALE32113__HA
augaagaccaucaucgcccugucguacauccucugccugguguucgcccagaagauccccggcaacgacaacuccaccgcgacgcugugccucgggcaccacgccgucccgaacggcaccguggugaagaccaucaccaacgaccgcaucgaggucacgaacgccaccgagcuggugcagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgucccggacuacgcgucccugcgcucgcugguggccuccagcggcacccucgaguucaacaacgaguccuucaacuggacgggggugacccagaacggcaccucguccgccugcauccgggggagcuccucguccuucuucagccgccugaacuggcugacccaccucaacuacacguaccccgcccugaacgucaccaugcccaacaacgagcaguucgacaagcuguacaucuggggcgugcaccaccccgggaccgacaaggaccagaucuuccucuacgcgcaguccucgggccggaucaccgugagcacgaagcgcucccagcaggccgucaucccgaacaucggcucgcggccccgcauccgggacauccccucccgcaucagcaucuacuggaccaucgugaagcccggggacauccugcugaucaacuccaccggcaaccucaucgccccgcggggguacuucaagaugcgcucgggcaaguccagcaucaugcgguccgacgcccccaucggcaagugcaagucggagugcaucacccccaacggguccauccccaacgacaagccguuccagaacgugaaccgcaucacguacggcgccugcccccgguacgucaagcacagcacccugaagcuggcgaccgggaugcgcaacgugcccgagaagcagacccggggcaucuucggggccaucgccggcuucaucgagaacggcugggaggggaugguggacggcugguacggguuccgccaccagaacuccgagggccgggggcaggccgccgaccucaagucgacgcaggcggccaucgaccagaucaacggcaagcugaaccgccugaucggcaagaccaacgagaaguuccaccagaucgagaaggaguucuccgaggucgaggggcggauccaggaccucgagaaguacguggaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacaugggcaacgggugcuucaagaucuaccacaagugcgacaacgcgugcaucggcucgauccgcaacgggaccuacgaccacaacgucuaccgggacgaggcccugaacaaccgcuuccagaucaagggcguggagcucaaguccggcuacaaggacuggauccuguggaucagcuucgccaucagcugcuuccugcucugcguggcccugcugggguucaucaugugggccugccagaagggcaacauccggugcaacaucugcaucuga

SEQ ID NO: 13843 - RNA, 1701 nt, Artificial Sequence; identical to SEQ ID NO: 13230
  derived and/or modified CDS sequence (AUadapt) from InfluenzaA__ALE32114__HA

SEQ ID NO: 13844 - RNA, 1701 nt, Artificial Sequence; identical to SEQ ID NO: 13230
  derived and/or modified CDS sequence (AUadapt) from InfluenzaA__ALE32115__HA

SEQ ID NO: 13845 - RNA, 1701 nt, Artificial Sequence
  derived and/or modified CDS sequence (AUadapt) from InfluenzaA__ALE32116__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccucggggcgcaucaccgugagcacgaagcggucccagcaggccgugaucccgaacaucggcucgcgcccccggauccgcgacauccccucccggaucagcaucuacuggaccaucgucaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacgugcgcugcaacaucugcaucuga

SEQ ID NO: 13846 - RNA, 1701 nt, Artificial Sequence
  derived and/or modified CDS sequence (AUadapt) from InfluenzaA__ALE32117__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccagcuccuucuucucgcggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugucgacgaagcggucccagcaggccgugaucccgaacaucggcagccgcccccggauccgcgacauccccucccggaucucgaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgacuucaagucgacgcaggcggccaucgaccagaucaacgggaagcucaaccggcugaucggcaagaccaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaagggggucgagcugaaguccgaguacaaggacuggauccucuggaucagcuucgccaucagcugcuuccugcugugcguggcccuccugggcuucaucaugugggccugccagaagggcaacauccgcugcaacaucugcaucuga

SEQ ID NO: 13847 - RNA, 1701 nt, Artificial Sequence; identical to SEQ ID NO: 13292
  derived and/or modified CDS sequence (AUadapt) from InfluenzaA__ALE32118__HA

SEQ ID NO: 13848 - RNA, 1701 nt, Artificial Sequence; identical to SEQ ID NO: 116
  derived and/or modified CDS sequence (AUadapt) from InfluenzaA__ALM06086__HA

SEQ ID NO: 13849 - RNA, 1701 nt, Artificial Sequence; identical to SEQ ID NO: 10285
  derived and/or modified CDS sequence (AUadapt) from InfluenzaA__ALM06087__HA

SEQ ID NO: 13850 - RNA, 1701 nt, Artificial Sequence
  derived and/or modified CDS sequence (AUadapt) from InfluenzaA__ALM06088__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcugucccagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccggggccaggaggggcgcaugaacuacuacuggacccugguggagcccggcgacaagaucaccuucgaggcgacggggaaccucguggucccccgguacgccuucaccauggagcgcaacgccggcucgggcaucaucaucuccgacacccccgugcacgacugcaacaccacgugccagaccccggagggggccaucaacaccagccugcccuuccagaacauccaccccaucaccaucggcaagugccccaaguacgugaaguccacgaagcugcggcucgccaccgggcugcgcaacgucccgucgauccagucccggggccuguucggggcgaucgccggcuucaucgagggcggguggaccggcaugguggacgggugguacggcuaccaccaccagaacgagcaggggagcggcuacgccgccgaccucaaguccacccagaacgccaucgacaagaucacgaacaaggugaacucggucaucgagaagaugaacacccaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggagaagaucgacggggugaagcucgagagcacccgcaucuaccagauccuggccaucuacuccaccgucgcgucgucccuggugcucguggucagccugggcgccaucucguucuggaugugcuccaacggcagccugcagugccggaucugcaucuga

SEQ ID NO: 13851 - RNA, 1701 nt, Artificial Sequence; identical to SEQ ID NO: 10285
  derived and/or modified CDS sequence (AUadapt) from InfluenzaA__ALM06089__HA

SEQ ID NO: 13852 - RNA, 1701 nt, Artificial Sequence
  derived and/or modified CDS sequence (AUadapt) from InfluenzaA__ALN39661__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccucggggcgcaucaccgugagcacgaagcggucccagcaggccgugaucccgaacaucggcucgcgcccccggauccgcgacauccccucccggaucagcaucuacuggaccaucgucaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcaucgcccugcugggcuucaucaugugggccugccagaaggggaacauccgcugcaacaucugcaucuga

SEQ ID NO: 13853 - RNA, 1701 nt, Artificial Sequence; identical to SEQ ID NO: 13219
  derived and/or modified CDS sequence (AUadapt) from InfluenzaA__ALN39662__HA

SEQ ID NO: 13854 - RNA, 1701 nt, Artificial Sequence; identical to SEQ ID NO: 68
  derived and/or modified CDS sequence (AUadapt) from InfluenzaA__ALN39663__HA

SEQ ID NO: 13855 - RNA, 1701 nt, Artificial Sequence
  derived and/or modified CDS sequence (AUadapt) from InfluenzaA__ALN39664__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacucguccaucggggagaucugcgacagcccccaccagauccucgacggcgagaacugcacccugaucgacgcccugcucggggacccccagugcgacggcuuccagaacaagaagugggaccuguucguggagcgguccaaggccuacucgaacugcuaccccuacgacgugccggacuacgcgucccugcgcagccucgucgccuccucgggcacccuggaguucaacaacgaguccuucaacugggccggggugacgcagaacggcaccagcuccucgugcauccggggguccaacagcuccuucuucucgcgccugaacuggcucacccaccugaacuccaaguaccccgcccugaacgugaccaugcccaacaacgagcaguucgacaagcucuacaucuggggcguccaccaccccgggacggacaaggaccagaucuuccuguacgcgcagccgagcggccgggugaccgugucgaccaagcgcucccagcaggccgucauccccaacaucggcagccggccccgcauccgggacauccccucccgcaucucgaucuacuggaccaucgugaagccgggggacauccugcucaucaacuccacgggcaaccugaucgcgccccggggguacuucaagauccgcagcggcaaguccucgaucaugcgguccgacgcccccaucggcaagugcaagagcgagugcaucacccccaacggguccaucccgaacgacaagcccuuccagaacgugaaccgcaucaccuacggcgccugcccccgguacgucaagcagucgacccugaagcucgccacggggaugcgcaacgugcccgagcggcagacccgcggcaucuucggggccaucgccggcuucaucgagaacggcugggaggggaugguggacggcugguacggguuccggcaccagaacuccgagggccgcgggcaggccgccgaccucaagagcacccaggcggccaucgaccagaucaacggcaagcugaaccggcugaucggcaagaccaacgagaaguuccaccagaucgagaaggaguucuccgaggucgaggggcgcauccaggaccuggagaaguacguggaggacacgaagaucgaccuguggucguacaacgccgagcuccugguggcccuggagaaccagcacaccaucgaccucaccgacuccgagaugaacaagcuguucgagaagaccaagaagcagcugcgcgagaacgccgaggacaugggcaacgggugcuucaagaucuaccacaagugcgacaacgcgugcaucggcagcauccggaacgggacguacgaccacgacgucuaccgcgacgaggcccucaacaaccgguuccagaucaagggcguggagcugaaguccggcuacaaggacuggauccuguggaucucguucgccaucagcugcuuccuccugugcguggcccugcucggguucaucaugugggccugccagaagggcaacauccgcugcaacaucugcaucuga

SEQ ID NO: 13856 - RNA, 1701 nt, Artificial Sequence; identical to SEQ ID NO: 68
  derived and/or modified CDS sequence (AUadapt) from InfluenzaA__ALN39665__HA

SEQ ID NO: 13857 - RNA, 1701 nt, Artificial Sequence; identical to SEQ ID NO: 13292
  derived and/or modified CDS sequence (AUadapt) from InfluenzaA__ALN39666__HA

SEQ ID NO: 13858 - RNA, 1701 nt, Artificial Sequence
  derived and/or modified CDS sequence (AUadapt) from InfluenzaA__ALN39667__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacucguccaucggggagaucugcaacagcccccaccagauccucgacggcgagaacugcacccugaucgacgcccugcucggggacccccagugcgacggcuuccagaacaagaagugggaccuguucguggagcgguccaaggccuacucgaacugcuaccccuacgacgugccggacuacgcgucccugcgcagccucgucgccuccucgggcacccuggaguucaacaacgaguccuucaacugggccggggugacgcagaacggcaccagcuccgccugcauccgggggucgaacuccucguucuucucccgccugaacuggcucacccacagcaacuucaaguaccccgcgcugaacgugaccaugcccaacaacgagcaguucgacaagcuguacaucuggggcguccaccaccccgggacggacaaggaccagaucuuccucuacgcccaguccucgggccggaucaccgugagcaccaagcgcucccagcaggccgugaccccgaacaucggcucgcggccccgcauccggaacauccccucccgcaucagcaucuacuggacgaucgucaagcccggggacauccugcugaucaacuccaccggcaaccucaucgccccgcggggguacuucaagauccgcucgggcaaguccucgaucaugcgguccgacgcccccaucggcaagugcaagagcgagugcaucacccccaacggguccauccccaacgacaagccguuccagaacgugaaccgcaucaccuacggcgcgugcccccgguacgugaagcagucgacgcugaagcuggccaccgggaugcgcaacguccccgagaagcagacccggggcaucuucggggccaucgccggcuucaucgagaacggcugggaggggaugaaggacggcugguacggguuccgccaccagaacuccgagggccgggggcaggccgcggaccucaagagcacccaggccgccaucgaccagaucaacggcaagcugaaccgccugaucggcaagacgaacgagaaguuccaccagaucgagaaggaguucuccgagguggaggggcggauccaggaccucgagaaguacguggaggacaccaagaucgaccuguggucguacaacgccgagcugcucgucgcccuggagaaccagcacaccaucgaccugaccgacuccgagaugaacaagcuguucgagaagacgaagaagcagcuccgcgagaacgcggaggacaugggcaacgggugcuucaagaucuaccacaagugcgacaacgccugcaucggcagcauccgcaacgggaccuacgaccacgacguguaccggaacgaggcccugaacaaccgcuuccagaucaagggcguggagcucaaguccggcuacaaggacuggauccuguggaucucguucgccaucagcugcuuccugcucugcgucgcccugcugggguucaucaugugggcgugccagaagggcaacauccggugcaacaucugcaucuga

SEQ ID NO: 13859 - RNA, 1701 nt, Artificial Sequence; identical to SEQ ID NO: 13761
  derived and/or modified CDS sequence (AUadapt) from InfluenzaA__ALN39668__HA

SEQ ID NO: 13860 - RNA, 1701 nt, Artificial Sequence
  derived and/or modified CDS sequence (AUadapt) from InfluenzaA__ALN39669__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcagcuguccgggcgcaucaccgugagcacgaagcggucgcagcaggccgugaucccgaacaucggcucccgcccccggauccgcgacauccccagccggaucuccaucuacuggaccaucgucaagcccggcgacauccugcucaucaacucgaccgggaaccugaucgccccgcgcggcuacuucaagauccgguccggcaagagcuccaucaugcgcucggacgcccccaucgggaagugcaaguccgagugcaucacccccaacggcagcauccccaacgacaagccguuccagaacgugaaccggaucacguacggggccugcccccgcuacgugaagcacuccacccugaagcucgcgaccggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccugaaguccacgcaggcggccaucgaccagaucaacgggaagcugaaccggcucaucggcaagaccaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucacggacucggagaugaacaagcuguucgagaagaccaagaagcagcugcgcgagaacgccgaggacauggggaacggcugcuucaagaucuaccacaagugcgacaacgcgugcaucggguccauccggaacggcaccuacgaccacaacguguaccgcgacgaggcccucaacaaccgguuccagaucaagggggucgagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 13861 - RNA, 1701 nt, Artificial Sequence; identical to SEQ ID NO: 68
  derived and/or modified CDS sequence (AUadapt) from InfluenzaA__ALN39670__HA

SEQ ID NO: 13862 - RNA, 1701 nt, Artificial Sequence
  derived and/or modified CDS sequence (AUadapt) from InfluenzaA__ALN39671__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccucggggcgcaucaccgugagcacgaagcggucccagcaggccgugaucccgaacaucggcucgcgcccccggauccgcgacauccccucccggaucagcaucuacuggaccaucgucaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagacccgcaagcagcuccgggagaacgccgaggacauggggaacggcugcuucaagaucuaccacaagugcgacaacgcgugcaucgggucgauccgcaacggcaccuacgaccacaacguguaccgggacgaggcccugaacaaccgcuuccagaucaagggggucgagcucaaguccggcuacaaggacuggauccuguggaucagcuucgccaucagcugcuuccugcucugcguggcccugcugggcuucaucaugugggccugccagaaggggaacauccggugcaacaucugcaucuga

SEQ ID NO: 13863 - RNA, 1701 nt, Artificial Sequence; identical to SEQ ID NO: 68
  derived and/or modified CDS sequence (AUadapt) from InfluenzaA__ALN39672__HA

SEQ ID NO: 13864 - RNA, 1701 nt, Artificial Sequence
  derived and/or modified CDS sequence (AUadapt) from InfluenzaA__ALN39673__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccucggggcgcaucaccgugagcacgaagcggucccagcaggccgugaucccggacaucggcucgcgcccccggauccgcgacauccccucccggaucagcaucuacuggaccaucgucaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 13865 - RNA, 1701 nt, Artificial Sequence; identical to SEQ ID NO: 13226
  derived and/or modified CDS sequence (AUadapt) from InfluenzaA__ALN39674__HA

SEQ ID NO: 13866 - RNA, 1701 nt, Artificial Sequence; identical to SEQ ID NO: 68
  derived and/or modified CDS sequence (AUadapt) from InfluenzaA__ALN39675__HA

SEQ ID NO: 13867 - RNA, 1701 nt, Artificial Sequence
  derived and/or modified CDS sequence (AUadapt) from InfluenzaA__ALN39676__HA
augaagaccaucaucgcccugucgugcauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacucguccaucggggagaucugcgacagcccccaccagauccucgacggcgagaacugcacccugaucgacgcccugcucggggacccccagugcgacggcuuccagaacaagaagugggaccuguucguggagcgguccaaggccuacucgaacugcuaccccuacgacgugccggacuacgcgucccugcgcagccucgucgccuccucgggcacccuggaguucaacaacgagaacuucaacugggccggggugacgcagaacggcaccuccagcuccugcauccgggggucgaacuccagcuucuucucccgccugaacuggcucacccaccugaacucgaaguaccccgcccugaacgugaccaugcccaacaacgagcaguucgacaagcucuacaucuggggcguccaccaccccgggacggacaaggaccagaucuuccuguacgcgcaguccagcggccggaucaccgugucgaccaagcgcucccagcaggccgugaucccgaacaucggcagccggccccgcauccgggacauccccucccgcaucucgaucuacuggaccaucgucaagcccggggacauccugcucaucaacuccacgggcaaccugaucgccccgcggggguacuuccgcauccggagcggcaaguccucgaucaugcgcuccgacgcccccaucggcaagugcaagagcgagugcaucacccccaacggguccauccccaacgacaagccguuccagaacgugaaccggaucaccuacggcgccugcccccgcuacgugaagcagaacacccugaagcucgcgacggggaugcggaacguccccgagcgccagacccggggcaucuucggggccaucgccggcuucaucgagaacggcugggaggggaugguggacggcugguacggguuccgccaccagaacucggagggccgggggcaggccgccgaccugaaguccacccagagcgcgaucgaccagaucaacggcaagcugaaccgccucaucggcaagaccaacgagaaguuccaccagaucgagaaggaguucuccgagguggaggggcgcauccaggaccuggagaaguacgucgaggacacgaagaucgaccuguggucguacaacgccgagcuccugguggcccuggagaaccagcacaccaucgaccucaccgacuccgagaugaacaagcuguucgagaagaccaagaagcagcugcgggagaacgccgaggacaugggcaacgggugcuucaagaucuaccacaagugcgacaacgccugcaucggcagcauccgcaacgggacguacgaccacgacguguaccgggacgaggcgcucaacaaccgcuuccagaucaagggcgucgagcugaaguccggcuacaaggacuggauccuguggaucucguucgccaucagcugcuuccuccugugcguggcccugcucggguucaucaugugggccugccagaagggcaacauccggugcaacaucugcaucuga

SEQ ID NO: 13868 - RNA, 1701 nt, Artificial Sequence
  derived and/or modified CDS sequence (AUadapt) from InfluenzaA__ALN39677__HA
augaagaccaucaucgcccugggcuacauccucugccugguguucgcccagaagauccccgggaacgacaacucgaccgcgacgcugugccucggccaccacgccgucccgaacgggaccaucgugaagaccaucaccaacgaccgcaucgaggugacgaacgccaccgagcugguccagaacuccagcaucggcgagaucugcgacucgccccacaagauccuggacggggagaacugcacccucaucgacgcccugcugggcgacccccagugcgacggcuuccagaacaagaagugggaccucuucguggagcgguccaaggccuacuccaacugcuaccccuacgacgugccggacuacgcgagccugcgcucccuggucgccucguccgggacccucgaguucaacaacgagagcuucaacuggacgggcgugacccagaacgggaccuccucggccugcauccggcgcuccagcuccucguucuucucccggcugaacuggcugacccaccucaacuacgccuaccccgcgcugaacgugacgaugcccaacaacgagcaguucgacaagcuguacaucuggggcguccaccaccccgggaccgacaaggaccagaucuuccucuacgcccagagcuccggccgcaucaccgugucgaccaagcggagccagcaggccgugaucccgaacaucggcucccgcccccggauccgcgacauccccucgcggaucuccaucuacuggacgaucgucaagcccggggacauccugcugaucaacagcaccggcaaccucaucgccccgcgcggguacuucaagauccgguccggcaagucguccaucaugcgcagcgacgcccccaucggcaagugcaaguccgagugcaucacccccaacgggucgauccccaacgacaagccguuccagaacgugaaccggaucaccuacggcgcgugcccccgcuacgugaagcacuccacgcugaagcuggccaccgggaugcggaacguccccgagaagcagacccgcggcaucuucggggccaucgccggcuucaucgagaacggcugggaggggaugguggacggcugguacggguuccggcaccagaacagcgagggccgcgggcaggccgcggaccucaaguccacccaggccgccaucgaccagaucaacggcaagcugaaccggcugaucggcaagacgaacgagaaguuccaccagaucgagaaggaguucucggagguggaggggcgcauccaggaccucgagaaguacgucgaggacaccaagaucgaccugugguccuacaacgccgagcugcucguggcccuggagaaccagcacaccaucgaccugaccgacagcgagaugaacaagcuguucgagaagacgaagaagcagcuccgcgagaacgcggaggacaugggcaacgggugcuucaagaucuaccacaagugcgacaacgccugcaucggcuccauccggaacgggaccuacgaccacaacguguaccgcgacgaggcccugaacaaccgguuccagaucaagggcgucgagcucaagucgggcuacaaggacuggauccuguggaucuccuucgccaucagcugcuuccugcucugcguggcccugcugggguucaucaugugggcgugccagaagggcaacauccgcugcaacaucugcaucuga

SEQ ID NO: 13869 - RNA, 1701 nt, Artificial Sequence; identical to SEQ ID NO: 13573
  derived and/or modified CDS sequence (AUadapt) from InfluenzaA__ALN39678__HA

SEQ ID NO: 13870 - RNA, 1701 nt, Artificial Sequence
  derived and/or modified CDS sequence (AUadapt) from InfluenzaA__ALN39679__HA
augaagaccaucaucgcccugggcuacauccucugccugguguucgcccagaagauccccgggaacgacaacucgaccgcgacgcugugccucggccaccacgccgucccgaacgggaccguggugaagaccaucaccaacgaccgcaucgaggucacgaacgccaccgagcuggugcagaacuccagcaucggcgagaucugcgacucgccccacaagauccuggacggggagaacugcacccucaucgacgcccugcugggcgacccccagugcgacggcuuccagaacaagaagugggaccucuucguggagcgguccaaggccuacuccaacugcuaccccuacgacgucccggacuacgcgagccugcgcucccugguggccucguccgggacccucgaguucaacaacgagagcuucaacuggacgggcgugacccagaacgggaccuccucggccugcauccggcgcuccagcuccucguucuucucccggcugaacuggcugacccaccucaacuacacguaccccgcccugaacgucaccaugcccaacaacgagcaguucgacaagcuguacaucuggggcgugcaccaccccgggaccgacaaggaccagaucuuccucuacgcgcagagcuccggccgcaucaccgugucgacgaagcggagccagcaggccgucaucccgaacaucggcucccgcccccggauccgcgacauccccucgcggaucuccaucuacuggaccaucgugaagcccggggacauccugcugaucaacagcaccggcaaccucaucgccccgcgcggguacuucaagauccgguccggcaagucguccaucaugcgcagcgacgcccccaucggcaagugcaaguccgagugcaucacccccaacgggucgauccccaacgacaagccguuccagaacgugaaccggaucacguacggcgccugcccccgcuacgucaagcacuccacccugaagcuggcgaccgggaugcggaacgugcccgagaagcagacccgcggcaucuucggggccaucgccggcuucaucgagaacggcugggaggggaugguggacggcugguacggguuccggcaccagaacagcgagggccgcgggcaggccgccgaccucaaguccacgcaggcggccaucgaccagaucaacggcaagcugaaccggcugaucggcaagaccaacgagaaguuccaccagaucgagaaggaguucucggaggucgaggggcgcauccaggaccucgagaaguacguggaggacaccaagaucgaccugugguccuacaacgccgagcugcucguggcccuggagaaccagcacaccaucgaccugacggacagcgagaugaacaagcuguucgagaagaccaagaagcagcuccgcgagaacgccgaggacaugggcaacgggugcuucaagaucuaccacaagugcgacaacgcgugcaucggcuccauccggaacgggaccuacgaccacaacgucuaccgcgacgaggcccugaacaaccgguuccagaucaagggcguggagcucaagucgggcuacaaggacuggauccuguggaucuccuucgccaucagcugcuuccugcucugcguggcccugcugggguucaucaugugggccugccagaagggcaacauccgcugcaacaucugcaucuga

SEQ ID NO: 13871 - RNA, 1701 nt, Artificial Sequence; identical to SEQ ID NO: 13573
  derived and/or modified CDS sequence (AUadapt) from InfluenzaA__ALN39680__HA

SEQ ID NO: 13872 - RNA, 1701 nt, Artificial Sequence; identical to SEQ ID NO: 13573
  derived and/or modified CDS sequence (AUadapt) from InfluenzaA__ALN39681__HA

SEQ ID NO: 13873 - RNA, 1701 nt, Artificial Sequence; identical to SEQ ID NO: 13573
  derived and/or modified CDS sequence (AUadapt) from InfluenzaA__ALN39682__HA

SEQ ID NO: 13874 - RNA, 1701 nt, Artificial Sequence; identical to SEQ ID NO: 13573
  derived and/or modified CDS sequence (AUadapt) from InfluenzaA__ALN39683__HA

SEQ ID NO: 13875 - RNA, 1701 nt, Artificial Sequence; identical to SEQ ID NO: 13573
  derived and/or modified CDS sequence (AUadapt) from InfluenzaA__ALN39684__HA

SEQ ID NO: 13876 - RNA, 1701 nt, Artificial Sequence; identical to SEQ ID NO: 13573
  derived and/or modified CDS sequence (AUadapt) from InfluenzaA__ALN39685__HA

SEQ ID NO: 13877 - RNA, 1701 nt, Artificial Sequence
  derived and/or modified CDS sequence (AUadapt) from InfluenzaA__ALN39686__HA
augaagaccaucaucgcccugggcuacauccucugccuggccuucgcgcagaagauccccgggaacgacaacucgaccgccacgcugugccucggccaccacgccgugccgaacgggaccaucgucaagaccaucaccaacgaccgcaucgaggugacgaacgccaccgagcuggugcagaacuccucgaucggcgagaucugcgacagcccccacaagauccuggacggggagaacugcacccucaucgacgcccugcugggcgacccccagugcgacggcuuccagaacaagaagugggaccucuucgucgagcgguccaaggcguacuccaacugcuaccccuacgacgugccggacuacaccucgcugcgcucccugguggccagcuccgggacgcucgaguucaacaacgagucguucaacuggaccggcgucacccagaacgggaccuccagcgccugcauccggcgcuccucguccagcuucuucucccggcugaacuggcugacgcaccucaacuacaccuaccccgcccugaacgugaccaugcccaacaacgagcaguucgacaagcuguacaucuggggcgugcaccaccccgggaccgacaaggaccagaucuuccucuacgcgcagucguccggccgcaucacggucagcaccaagcggucgcagcaggccgugaucccgaacaucggcucccgcccccggauccgcgacauccccucgcggaucuccaucuacuggaccaucgugaagcccggggacauccugcugaucaacagcaccggcaaccucaucgccccgcgcggguacuucaagauccgguccggcaagucguccaucaugcgcagcgacgcccccaucggcaagugcaaguccgagugcaucacgcccaacgggucgauccccaacgacaagccguuccagaacgucaaccggaucaccuacggcgccugcccccgcuacgugaagcacuccacccugaagcuggcgaccgggaugcggaacgugcccgagaagcagacgcgcggcaucuucggggccaucgccggcuucaucgagaacggcugggaggggauggucgacggcugguacggguuccggcaccagaacagcgagggccgcgggcaggccgccgaccucaaguccacccaggcggccaucgaccagaucaacggcaagcugaaccggcugaucggcaagaccaacgagaaguuccaccagaucgagaaggaguucucggagguggaggggcgcauccaggaccucgagaaguacguggaggacaccaagaucgaccugugguccuacaacgccgagcugcucgucgcccuggagaaccagcacacgaucgaccugaccgacagcgagaugaacaagcuguucgagaagaccaagaagcagcuccgcgagaacgccgaggacaugggcaacgggugcuucaagaucuaccacaagugcgacaacgcgugcaucggcuccauccggaacgggaccuacgaccacaacguguaccgcgacgaggcccugaacaaccgguuccagaucaagggcguggagcucaagucgggcuacaaggacuggauccuguggaucuccuucgccaucagcugcuuccugcucugcgucgcccugcugggguucaucaugugggccugccagaagggcaacauccgcugcaacaucugcaucuga

SEQ ID NO: 13878 - RNA, 1701 nt, Artificial Sequence; identical to SEQ ID NO: 13573
  derived and/or modified CDS sequence (AUadapt) from InfluenzaA__ALN39687__HA

SEQ ID NO: 13879 - RNA, 1701 nt, Artificial Sequence
  derived and/or modified CDS sequence (AUadapt) from InfluenzaA__ALN39688__HA
augaagaccaucaucgcccugggcuacauccucugccugguguucgcccagaagauccccgggaacgacaacucgaccgcgacgcugugccucggccaccacgccgucccgaacgggaccaucgugaagaccaucaccaacgaccgcaucgaggugacgaacgccaccgagcugguccagaacuccagcaucggcgagaucugcgacucgccccacaagauccuggacggggagaacugcacccucaucgacgcccugcugggcgacccccagugcgacggcuuccagaacaagaagugggaccucuucguggagcgguccaaggccuacuccaacugcuaccccuacgacgugccggacuacgcgagccugcgcucccuggucgccucguccgggacccucgaguucaacaacgagagcuucaacuggacgggcgugacccagaacgggaccuccucggccugcauccggcgcuccagcuccucguucuucucccggcugaacuggcugacccaccucaacuacaucuaccccgcccugaacgugacgaugcccaacaacgagcaguucgacaagcuguacaucuggggcguccaccaccccgggaccgacaaggaccagaucuuccucuacgcgcagagcuccggccgcaucaccgugagcaccaagcggucgcagcaggccgugaucccgaacaucggcucccgcccccggauccgcgacauccccagccggaucuccaucuacuggacgaucgucaagcccggggacauccugcugaucaacucgaccggcaaccucaucgccccgcgcggguacuucaagauccgguccggcaagagcuccaucaugcgcucggacgcccccaucggcaagugcaaguccgagugcaucacccccaacgggagcauccccaacgacaagccguuccagaacgugaaccggaucaccuacggcgccugcccccgcuacgugaagcacuccacgcugaagcuggcgaccgggaugcggaacguccccgagaagcagacccgcggcaucuucggggccaucgccggcuucaucgagaacggcugggaggggaugguggacggcugguacggguuccggcaccagaacucggagggccgcgggcaggccgccgaccucaaguccacccaggcggccaucgaccagaucaacggcaagcugaaccggcugaucggcaagacgaacgagaaguuccaccagaucgagaaggaguucagcgagguggaggggcgcauccaggaccucgagaaguacgucgaggacaccaagaucgaccugugguccuacaacgccgagcugcucguggcccuggagaaccagcacaccaucgaccugaccgacucggagaugaacaagcuguucgagaagacgaagaagcagcuccgcgagaacgccgaggacaugggcaacgggugcuucaagaucuaccacaagugcgacaacgcgugcaucggcuccauccggaacgggaccuacgaccacaacguguaccgcgacgaggcccugaacaaccgguuccagaucaagggcgucgagcucaagagcggcuacaaggacuggauccuguggaucuccuucgccaucagcugcuuccugcucugcguggcccugcugggguucaucaugugggccugccagaagggcaacauccgcugcaacaucugcaucuga

SEQ ID NO: 13880 - RNA, 1701 nt, Artificial Sequence
  derived and/or modified CDS sequence (AUadapt) from InfluenzaA__ALN39689__HA
augaagaccaucaucgcccugggcuacauccucugccugguguucgcccagaagauccccgggaacgacaacucgaccgcgacgcugugccucggccaccacgccgucccgaacgggaccaucgugaagaccaucaccaacgaccgcaucgaggugacgaacgccaccgagcugguccagaacuccagcaucggcgagaucugcgacucgccccacaagauccuggacggggagaacugcacccucaucgacgcccugcugggcgacccccagugcgacggcuuccagaacaagaagugggaccucuucguggagcgguccaaggccuacuccaacugcuaccccuacgacgugccggacuacgcgagccugcgcucccuggucgccucguccgggacccucgaguucaacaacgagagcuucaacuggacgggcgugacccagaacgggaccuccucggccugcauccggcgcuccagcuccucguucuucucccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcagagcuccggccgcaucaccgugucgacgaagcggagccagcaggccgugaucccgaacaucggcucccgcccccggauccgcgacauccccucgcggaucuccaucuacuggaccaucgucaagcccggggacauccugcugauccacagcaccggcaaccucaucgccccgcgcggguacuucaagauccgguccggcaagucguccaucaugcgcagcgacgcccccaucggcaagugcaaguccgagugcaucacccccaacgggucgauccccaacgacaagccguuccagaacgugaaccggaucacguacggcgccugcccccgcuacgugaagcacuccacccugaagcuggcgaccgggaugcggaacguccccgagaagcagacccgcggcaucuucggggccaucgccggcuucaucgagaacggcugggaggggaugguggacggcugguacggguuccggcaccagaacagcgagggccgcgggcaggccgccgaccucaaguccacgcaggcggccaucgaccagaucaacggcaagcugaaccggcugaucggcaagaccaacgagaaguuccaccagaucgagaaggaguucucggagguggaggggcgcauccaggaccucgagaaguacgucgaggacaccaagaucgaccugugguccuacaacgccgagcugcucguggcccuggagaaccagcacaccaucgaccugacggacagcgagaugaacaagcuguucgagaagaccaagaagcagcuccgcgagaacgccgaggacaugggcaacgggugcuucaagaucuaccacaagugcgacaacgcgugcaucggcuccauccggaacgggaccuacgaccacaacguguaccgcgacgaggcccugaacaaccgguuccagaucaagggcgucgagcucaagucgggcuacaaggacuggauccuguggaucuccuucgccaucagcugcuuccugcucugcguggcccugcugggguucaucaugugggccugccagaagggcaacauccgcugcaacaucugcaucuga

SEQ ID NO: 13881 - RNA, 1701 nt, Artificial Sequence
  derived and/or modified CDS sequence (AUadapt) from InfluenzaA__ALN39690__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcaagaacugcacccugaucgacgcccugcucggggacccccagugcgacggcuuccagaacaagaagugggaccuguucguggagcgguccaaggcccacagcaacugcuaccccuacgacgugccggacuacgcgucccugcgcucgcucgucgccuccagcggcacccuggaguucaacaacgaguccuucaacugggccggggugacgcagaacggcaccucguccagcugcauccggggguccaacucguccuucuucagccgccugaacuggcucacccaccugaacuccaucuaccccgcccugaacgugaccaugcccaacaacgagcaguucgacaagcucuacaucuggggcguccaccaccccgggacggacaaggaccagaucuuccuguacgcgcagucgagcggccggaucaccguguccaccaagcgcucgcagcaggccgugaucccgaacaucggcucccggccccgcauccgggacauccccagccgcaucuccaucuacuggaccaucgucaagcccggggacauccugcucaucaacucgacgggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgccugcccccgguacgugaagcaguccacccugaagcucgcgacggggaugcgcaacguccccgagcggcagacccgcggcaucuucggggccaucgccggcuucaucgagaacggcugggaggggaugguggacggcugguacggguuccggcaccagaacucggagggccgcgggcaggccgccgaccugaaguccacccaggcggccaucgaccagaucaacggcaagcugaaccggcucaucggcaagaccaacgagaaguuccaccagaucgagaaggaguucagcgagguggaggggcgcauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgcgagaacgccgaggacaugggcaacgggugcuucaagaucuaccacaagugcgacaacgcgugcaucggcuccauccggaacgggacguacgaccacaacguguaccgcgacgaggcccucaacaaccgguuccagaucaagggcgucgagcucaagagcggcuacaaggacuggauccuguggaucagcuucgccaucuccugcuuccugcugugcguggcccugcucggguucaucaugugggccugccagaagggcaacauccgcugcaacaucugcaucuga

SEQ ID NO: 13882 - RNA, 1701 nt, Artificial Sequence
  derived and/or modified CDS sequence (AUadapt) from InfluenzaA__ALN39691__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacucguccaucggggagaucugcgacagcccccaccagauccucgacggcaagaacugcacccugaucgacgcccugcucggggacccccagugcgacggcuuccagaacaagaagugggaccuguucguggagcgguccaaggcccacucgaacugcuaccccuacgacgugccggacuacgcgucccugcgcucgcucgucgccuccagcggcacccuggaguucaacaacgaguccuucaacugggccggggugacgcagaacggcaccucguccagcugcauccggggguccaacucguccuucuucucgcgccugaacuggcucacccaccugaacuccaaguaccccgcccugaacgugaccaugcccaacaacgagcaguucgacaagcucuacaucuggggcguccaccaccccgggacggacaaggaccagaucuuccuguacgcgcagccgagcggccggaucaccgugucgaccaagcgcucccagcaggccgugauccccaacaucggcagccggccccgcauccgggacauccccucccgcaucucgaucuacuggaccaucgucaagccgggggacauccugcucaucaacuccacgggcaaccugaucgcgccccggggguacuucaagauccgcucgggcaaguccagcaucaugcgguccgacgcccccaucggcaagugcaagucggagugcaucacccccaacggguccaucccgaacgacaagcccuuccagaacgugaaccgcaucaccuacggcgccugcccccgguacgugaagcagagcacccugaagcucgccacggggaugcgcaacguccccgagaagcagacccggggcaucuucggggccaucgccggcuucaucgagaacggcugggaggggaugaaggacggcugguacggguuccgccaccagaacuccgagggccgggggcaggccgccgaccucaagucgacccaggcggccaucgaccagaucaacggcaagcugaaccgccugaucggcaagaccaacgagaaguuccaccagaucgagaaggaguucuccgagguggaggggcggauccaggaccuggagaaguacguggaggacacgaagaucgaccuguggucguacaacgccgagcuccuggucgcccuggagaaccagcacaccaucgaccucaccgacuccgagaugaacaagcuguucgagaagaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcguggagcugaaguccggcuacaaggacuggauccuguggaucucguucgccaucagcugcuuccuccugugcgucgcccugcucggguucaucaugugggccugccagaagggcaacauccggugcaacaucugcaucuga

SEQ ID NO: 13883 - RNA, 1701 nt, Artificial Sequence; identical to SEQ ID NO: 13573
  derived and/or modified CDS sequence (AUadapt) from InfluenzaA__ALN39692__HA

SEQ ID NO: 13884 - RNA, 1701 nt, Artificial Sequence; identical to SEQ ID NO: 13573
  derived and/or modified CDS sequence (AUadapt) from InfluenzaA__ALN39693__HA

SEQ ID NO: 13885 - RNA, 1701 nt, Artificial Sequence; identical to SEQ ID NO: 13573
  derived and/or modified CDS sequence (AUadapt) from InfluenzaA__ALN39694__HA

SEQ ID NO: 13886 - RNA, 1701 nt, Artificial Sequence; identical to SEQ ID NO: 13573
  derived and/or modified CDS sequence (AUadapt) from InfluenzaA__ALN39695__HA

SEQ ID NO: 13887 - RNA, 1701 nt, Artificial Sequence; identical to SEQ ID NO: 13573
  derived and/or modified CDS sequence (AUadapt) from InfluenzaA__ALN39696__HA

SEQ ID NO: 13888 - RNA, 1701 nt, Artificial Sequence; identical to SEQ ID NO: 13243
  derived and/or modified CDS sequence (AUadapt) from InfluenzaA__ALN39697__HA

SEQ ID NO: 13889 - RNA, 1701 nt, Artificial Sequence
  derived and/or modified CDS sequence (AUadapt) from InfluenzaA__ALN39698__HA
augaagaccaucaucgcccugucgcacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacucguccaucggggagaucugcgacagcccccaccagauccuggacggcgagaacugcacccucaucgacgcccugcugggggacccccagugcgacggcuuccagaacaagaagugggaccucuucguggagcgguccaaggccuacucgaacugcuaccccuacgacgugccggacuacgcgucccugcgcagccuggucgccuccucgggcacccucgaguucaacaacgaguccuucaacuggacgggggugacccagaacggcaccagcuccgccugcauccggcgcucguccagcuccuucuucucgcggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugucgacgaagcggucccagcaggccgugaucccgaacaucggcagccgcccccggauccgcgacauccccucccggaucucgaucuacuggaccaucgucaagcccggcgacauccugcugaucaacuccaccgggaaccucaucgccccgcgcggcuacuucaagauccggagcgggaaguccucgaucaugcgcuccgacgcccccaucggcaagugcaagagcgagugcaucacccccaacggcuccauccccaacgacaagccguuccagaacgugaaccggaucacguacggggccugcccccgcuacgugaagcacucgacccugaagcuggcgaccggcaugcggaacguccccgagaagcagacccgcgggaucuucggcgccaucgccggguucaucgagaacggcugggagggcaugauggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacguggaggacaccaagaucgaccuguggucguacaacgccgagcugcucgucgcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcauggggagcauccggaacggcaccuacgaccacaacguguaccgcaacgaggcccugaacaaccgguuccagaucaaggggguggagcucaaguccggcuacaaggacuggauccuguggaucucguucgccaucagcugcuuccugcucugcgucgcccugcugggcuucaucaugugggccugccagaaggggaacauccgcugcaacaucugcaucuga

SEQ ID NO: 13890 - RNA, 1701 nt, Artificial Sequence
  derived and/or modified CDS sequence (AUadapt) from InfluenzaA__ALN39700__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccucggggcgcaucaccgugagcacgaagcggucccagcaggccgugaucccgaacaucggcucgcgcccccggauccgcgacauccccucccggaucagcaucuacuggaccaucgucaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacaucaagugcaacaucugcaucuga

SEQ ID NO: 13891 - RNA, 1701 nt, Artificial Sequence; identical to SEQ ID NO: 13292
  derived and/or modified CDS sequence (AUadapt) from InfluenzaA__ALN39701__HA

SEQ ID NO: 13892 - RNA, 1701 nt, Artificial Sequence
  derived and/or modified CDS sequence (AUadapt) from InfluenzaA__ALN39702__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccgcaagagcuccagcuccuucuucucgcggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcgguccagcgggcgcaucaccgugucgacgaagcggucccagcaggccgugaucccgaacaucggcagccgcccccggauccgcgacauccccucccggaucucgaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcuccaucugcaucuga

SEQ ID NO: 13893 - RNA, 1701 nt, Artificial Sequence
  derived and/or modified CDS sequence (AUadapt) from InfluenzaA__ALN39703__HA
augaagaccaucaucgcccugucguacauccucugccugguguucgcccagaagauccccggcaacgacgacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccucggggcgcaucaccgugagcacgaagcggucccagcaggccgugaucccgaacaucggcucgcgcccccggauccgcgacauccccucccggaucagcaucuacuggaccaucgucaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 13894 - RNA, 1701 nt, Artificial Sequence; identical to SEQ ID NO: 13292
  derived and/or modified CDS sequence (AUadapt) from InfluenzaA__ALN39704__HA

SEQ ID NO: 13895 - RNA, 1701 nt, Artificial Sequence; identical to SEQ ID NO: 68
  derived and/or modified CDS sequence (AUadapt) from InfluenzaA__ALN39705__HA

SEQ ID NO: 13896 - RNA, 1701 nt, Artificial Sequence
  derived and/or modified CDS sequence (AUadapt) from InfluenzaA__ALN39706__HA
augaagaccaucaucgcccugucguacauccucugccugguguucgcccagaagcugcccggcaacgacaacuccaccgcgacgcucugccuggggcaccacgccgucccgaacggcaugaucgugaagaccaucaccaacgaccgcaucgaggugaccaacgccacggagcugguccagaacagcuccaucggggagaucugcgacucgccccaccagauccucgacggcaagaacugcacccugaucgacgcccugcucggggacccccagugcgacgacuuccagaacaagcggugggaccuguucguggagcgcuccaaggccuacagcaacugcuaccccuacgacgugccggacuacgcgucccugcggucgcucgucgccuccagcggcacccuggaguucaacgacgaguccuucaacugggccggcgugacccagaacgggacgucguccgccugcauccgcggcagcaacuccucguucuucucccggcugaacuggcucacccacagcaacuucaaguaccccgcgcugaacgugaccaugcccaacaacgagcaguucgacaagcuguacaucuggggcguccaccaccccgggaccgacaaggaccagaucuuccucuacgcccaguccucggggcgcaucacggugagcaccaagcggucccagcaggccgugaucccgaacaucggcucgcgcccccggauccgcaacauccccucccggaucagcaucuacuggaccaucgucaagcccggcgacauccugcugaucaacuccaccgggaaccucaucgccccgcgcggcuacuucaagauccagucggggaaguccagcaucaugcgguccgacgcccccaucggcaagugcaagucggagugcaucacgcccaacggcuccauccccaacgacaagccguuccagaacgugaaccgcaucaccuacggggcgugcccccgguacgugaagcagagcacccugaagcuggccaccggcaugcgcaacguccccgagaagcagacgcgggggaucuucggcgccaucgccggguucaucgagaacggcugggagggcaugaaggacgggugguacggcuuccgccaccagaacuccgaggggcggggccaggccgcggaccucaagucgacccaggccgccaucgaccagaucaacgggaagcugaaccgccugaucggcaagaccaacgagaaguuccaccagaucgagaaggaguucuccgagguggagggccggauccaggaccucgagaaguacguggaggacaccaagaucgaccuguggagcuacaacgccgagcugcucgucgcccuggagaaccagcacacgaucgaccugaccgacuccgagaugaacaagcuguucgagaagaccaagaagcagcuccgcgagaacgcggaggacauggggaacggcugcuucaagaucuaccacaagugcgacaacgccugcaucgggucgauccgcaacggcaccuacgaccacgacguguaccgggacgaggcccugaacaaccgcuuccagaucaaggggguggagcucaaguccggcuacaaggacuggauccuguggaucagcuucgccaucagcugcuuccugcucugcgucgcccugcugggcuucaucaugugggcgugccagaaggggaacauccggugcaacaucugcaucuga

SEQ ID NO: 13897 - RNA, 1701 nt, Artificial Sequence; identical to SEQ ID NO: 68
  derived and/or modified CDS sequence (AUadapt) from InfluenzaA__ALN39707__HA

SEQ ID NO: 13898 - RNA, 1701 nt, Artificial Sequence; identical to SEQ ID NO: 13292
  derived and/or modified CDS sequence (AUadapt) from InfluenzaA__ALN39708__HA

SEQ ID NO: 13899 - RNA, 1701 nt, Artificial Sequence
  derived and/or modified CDS sequence (AUadapt) from InfluenzaA__ALN39709__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacucguccaucggggagaucugcgacagcccccaccagauccucgacggcgagaacugcacccugaucgacgcccugcucggggacccccagugcgacggcuuccagaacaagaagugggaccuguucguggagcgguccaaggccuacucgaacugcuaccccuacgacgugccggacuacgcgucccugcgcagccucgucgccuccucgggcacccuggaguucaacaacgaguccuucaacugggccggggugacgcagaacggcaccagcuccucgugcaugcggggguccaacagcuccuucuucucgcgccugaacuggcucacccaccugaacuccaaguaccccgcccugaacgugaccaugcccaacaacgagcaguucgacaagcucuacaucuggggcguccaccaccccgggacggacaaggaccagaucuuccuguacgcgcagagcucgggccggaucaccguguccaccaagcgcagccagcaggccgugaccccgaacaucggcucccggccccgcauccgggacauccccucgcgcaucuccaucuacuggacgaucgucaagcccggggacauccugcucaucaacagcaccggcaaccugaucgccccgcggggguacuucaagauccgcuccggcaagucguccaucaugcggagcgacgcccccaucggcaagugcaaguccgagugcaucacccccaacgggucgauccccaacgacaagccguuccagaacgugaaccgcaucaccuacggcgccugcccccgguacgugaagcaguccacgcugaagcucgcgaccgggaugcgcaacguccccgagcggcagacccgcggcaucuucggggccaucgccggcuucaucgagaacggcugggaggggaugguggacggcugguacggguuccggcaccagaacagcgagggccgcgggcaggccgccgaccugaaguccacccaggcggccaucgaccagaucaacggcaagcugaaccggcucaucggcaagacgaacgagaaguuccaccagaucgagaaggaguucucggagguggaggggcgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacaugggcaacgggugcuucaagaucuaccacaagugcgacaacgcgugcaucggcuccauccggaacgggaccuacgaccacgacguguaccgcgacgaggcccucaacaaccgguuccagaucaagggcgucgagcucaagucgggcuacaaggacuggauccuguggaucagcuucgccaucuccugcuuccugcugugcguggcccugcucggguucaucaugugggccugccagaagggcaacauccgcugcaacaucugcaucuga

SEQ ID NO: 13900 - RNA, 1701 nt, Artificial Sequence; identical to SEQ ID NO: 13616
  derived and/or modified CDS sequence (AUadapt) from InfluenzaA__ALN39710__HA

SEQ ID NO: 13901 - RNA, 1701 nt, Artificial Sequence; identical to SEQ ID NO: 13292
  derived and/or modified CDS sequence (AUadapt) from InfluenzaA__ALN39711__HA

SEQ ID NO: 13902 - RNA, 1701 nt, Artificial Sequence; identical to SEQ ID NO: 68
  derived and/or modified CDS sequence (AUadapt) from InfluenzaA__ALN39712__HA

SEQ ID NO: 13903 - RNA, 1701 nt, Artificial Sequence
  derived and/or modified CDS sequence (AUadapt) from InfluenzaA__ALN39713__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccgggggagcuccucguccuucuucagccgccugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccucgggccggaucaccgugagcacgaagcgcucccagcaggccgugaucccgaacaucggcucgcggccccgcauccgggacauccccucccgcaucagcaucuacuggaccaucgucaagcccggggacauccugcugaucaacuccaccggcaaccucaucgccccgcggggguacuucaagauccgcucgggcaaguccagcaucaugcgguccgacgcccccaucggcaagugcaagucggagugcaucacccccaacggguccauccccaacgacaagccguuccagaacgugaaccgcaucacguacggcgccugcccccgguacgugaagcacagcacccugaagcuggcgaccgggaugcgcaacguccccgagaagcagacccggggcaucuucggggccaucgccggcuucaucgagaacggcugggaggggaugguggacggcugguacggguuccgccaccagaacuccgagggccgggggcaggccgccgaccucaagucgacgcaggcggccaucgaccagaucaacggcaagcugaaccgccugaucggcaagaccaacgagaaguuccaccagaucgagaaggaguucuccgagguggaggggcggauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacaugggcaacgggugcuucaagaucuaccacaagugcgacaacgcgugcaucggcucgauccgcaacgggaccuacgaccacaacguguaccgggacgaggcccugaacaaccgcuuccagaucaagggcgucgagcucaaguccggcuacaaggacuggauccuguggaucagcuucgccaucagcugcuuccugcucugcguggcccugcugggguucaucaugugggccugccagaagggcaacauccggugcaacaucugcaucuga

SEQ ID NO: 13904 - RNA, 1701 nt, Artificial Sequence
  derived and/or modified CDS sequence (AUadapt) from InfluenzaA__ALN39714__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacucguccaucggggagaucugcgacagcccccaccagauccuggacggcgagaacugcacccucaucgacgcccugcugggggacccccagugcgacggcuuccagaacaagaagugggaccucuucguggagcgguccaaggccuacucgaacugcuaccccuacgacgugccggacuacgcgucccugcgcagccuggucgccuccucgggcacccucgaguucaacaacgaguccuucaacugggccggggugacgcagaacggcaccagcuccucgugcauccggggguccaacucguccuucuucagccgccugaacuggcugacccaccucaacuccaaguaccccgcccugaacgugaccaugcccaacaacgagcaguucgacaagcuguacaucuggggcguccaccaccccgggacggacaaggaccagaccuuccucuacgcgcagccgucgggccggaucaccgugagcaccaagcgcucccagcaggccgugauccccaacaucggcucgcggccccgcauccgggacauccccucccgcaucagcaucuacuggacgaucgucaagccgggggacauccugcugaucaacuccaccggcaaccucaucgcgccccggggguacuucaagauccgcucgggcaaguccucgaucaugcgguccgacgcccccaucggcaagugcaagagcgagugcaucacccccaacggguccaucccgaacgacaagcccuuccagaacgugaaccgcaucaccuacggcgccugcccccgguacgugaagcagucgacgcugaagcuggccaccgggaugcgcaacguccccgagcggcagacccgcggcaucuucggggccaucgccggcuucaucgagaacggcugggaggggaugguggacggcugguacggguuccggcaccagaacuccgagggccgcgggcaggccgccgaccucaagagcacccaggcggccaucgaccagaucaacggcaagcugaaccggcugaucggcaagacgaacgagaaguuccaccagaucgagaaggaguucuccgagguggaggggcgcauccaggaccucgagaaguacgucgaggacaccaagaucgaccuguggucguacaacgccgagcugcucguggcccuggagaaccagcacaccaucgaccugaccgacuccgagaugaacaagcuguucgagaagacgaagaagcagcuccgcgagaacgccgaggacaugggcaacgggugcuucaagaucuaccacaagugcgacaacgcgugcaucggcagcauccggaacgggaccuacgaccacgacguguaccgcgacgaggcccugaacaaccgguuccagaucaagggcgucgagcucaaguccggcuacaaggacuggauccuguggaucucguucgccaucagcugcuuccugcucugcguggcccugcugggguucaucaugugggccugccagaagggcaacauccgcugcaacaucugcaucuga

SEQ ID NO: 13905 - RNA, 1701 nt, Artificial Sequence; identical to SEQ ID NO: 13344
  derived and/or modified CDS sequence (AUadapt) from InfluenzaA__ALN39715__HA

SEQ ID NO: 13906 - RNA, 1701 nt, Artificial Sequence; identical to SEQ ID NO: 68
  derived and/or modified CDS sequence (AUadapt) from InfluenzaA__ALN39716__HA

SEQ ID NO: 13907 - RNA, 1701 nt, Artificial Sequence; identical to SEQ ID NO: 68
  derived and/or modified CDS sequence (AUadapt) from InfluenzaA__ALN39717__HA

SEQ ID NO: 13908 - RNA, 1701 nt, Artificial Sequence; identical to SEQ ID NO: 13724
  derived and/or modified CDS sequence (AUadapt) from InfluenzaA__ALN39718__HA

SEQ ID NO: 13909 - RNA, 1701 nt, Artificial Sequence; identical to SEQ ID NO: 68
  derived and/or modified CDS sequence (AUadapt) from InfluenzaA__ALN39734__HA

SEQ ID NO: 13910 - RNA, 1701 nt, Artificial Sequence
  derived and/or modified CDS sequence (AUadapt) from InfluenzaA__ALN39735__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccgacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccucggggcgcaucaccgugagcacgaagcggucccagcaggccgugaucccgaacaucggcucgcgcccccggauccgcgacauccccucccggaucagcaucuacuggaccaucgucaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 13911 - RNA, 1701 nt, Artificial Sequence
  derived and/or modified CDS sequence (AUadapt) from InfluenzaA__ALN39736__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacucguccaucggggagaucugcgacagcccccaccagauccuggacggcgagaacugcacccucaucgacgcccugcugggggacccccagugcgacggcuuccagaacaagaagugggaccucuucguggagcgguccaaggccuacucgaacugcuaccccuacgacgugccggacuacgcgucccugcgcagccuggucgccuccucgggcacccucgaguucaacaacgaguccuucaacuggacgggggugacccagaacggcaccagcuccgccugcauccggcgcucguccagcuccuucuucucgcggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcagccguccgggcgcaucaccgugagcacgaagcggucgcagcaggccgugauccccaacaucggcucccgcccccggauccgcgacauccccagccggaucuccaucuacuggaccaucgucaagccgggcgacauccugcugaucaacucgaccgggaaccucaucgcgccccgcggcuacuucaagauccgcgggggcaaguccagcaucaugcgguccgacgcccccaucggcaagugcaagucggagugcaucacccccaacggguccaucccgaacgacaagcccuuccagaacgugaaccggaucacguacggcgccugcccccgcuacgugaagcacagcacccugaagcuggccaccgggaugcggaacguccccgagaagcagacccgcggcaucuucggggccaucgccggcuucaucgagaacggcugggaggggaugguggacggcugguacggguuccggcaccagaacuccgagggccgcgggcaggccgccgaccucaagucgacgcaggcggccaucgaccagaucaacggcaagcugaaccggcugaucggcaagaccaacgagaaguuccaccagaucgagaaggaguucuccgagguggaggggcgcauccagaaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacaugggcaacgggugcuucaagaucuaccacaagugcgacaacgcgugcaucggcucgauccggaacgggaccuacgaccacaacguguaccgcgacgaggcccugaacaaccgguuccagaucaagggcgucgagcucaaguccggcuacaaggacuggauccuguggaucagcuucgccaucuccugcuuccugcucugcguggcccugcugggguucaucaugugggccugccagaagggcaacauccgcugcaacaucugcaucuga

SEQ ID NO: 13912 - RNA, 1701 nt, Artificial Sequence; identical to SEQ ID NO: 13292
  derived and/or modified CDS sequence (AUadapt) from InfluenzaA__ALN39737__HA

SEQ ID NO: 13913 - RNA, 1701 nt, Artificial Sequence
  derived and/or modified CDS sequence (AUadapt) from InfluenzaA__ALN39738__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccucugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcuccagcuccuucuucucgcggcugaacuggcucacccaccugaacuacacguaccccgcccugaacgugaccaugcccaacaacgagcaguucgacaagcucuacaucuggggcguccaccaccccgggaccgacaaggaccagaucuuccuguacgcgcaguccagcgggcgcaucaccgugucgacgaagcggucccagcaggccgugaucccgaacaucggcagccgcccccggauccgcgacauccccucccggaucucgaucuacuggaccaucgucaagcccggcgacauccugcucaucaacuccaccgggaaccugaucgccccgcgcggcuacuucaagauccggagcgggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacagcacccugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgcgugcaucgggucgauccggaacggcaccuacgaccacaacguguaccgcgacgaggcccucaacaaccgguuccagaucaagggggucgagcugaaguccggcuacaaggacuggauccuguggaucagcuucgccaucagcugcuuccuccugugcguggcccugcucggcuucaucaugugggccugccagaaggggaacauccgcugcaacaucugcaucuga

SEQ ID NO: 13914 - RNA, 1701 nt, Artificial Sequence
  derived and/or modified CDS sequence (AUadapt) from InfluenzaA__ALN39739__HA
augaagaccaucaucgcccugggcuacauccucugccugguguucgcccagaagauccccgggaacgacaacucgaccgcgacgcugugccucggccaccacgccgucccgaacgggaccaucgugaagaccaucaccaacgaccgcaucgaggugacgaacgccaccgagcugguccagaacuccagcaucggcgagaucugcgacucgccccacaagauccuggacggggagaacugcacccucaucgacgcccugcugggcgacccccagugcgacggcuuccagaacaagaagugggaccucuucguggagcgguccaaggccuacuccaacugcuaccccuacgacgugccggacuacgcgagccugcgcucccuggucgccucguccgggacccucgaguucaacaacgagagcuucaacuggacgggcgugacccagaacgggaccuccucggccugcauccggcgcuccagcuccucguucuucucccggcugaacuggcugacccaccucgacuacacguaccccgcccugaacgugaccaugcccaacaacgagcaguucgacaagcuguacaucuggggcguccaccaccccgggaccgacaaggaccagaucuuccucuacgcgcagagcuccggccgcaucaccgugucgacgaagcggagccagcaggccgugaucccgaacaucggcucccgcccccggauccgcgacauccccucgcggaucuccaucuacuggaccaucgucaagcccggggacauccugcugaucaacagcaccggcaaccucaucgccccgcgcggguacuucaagauccgguccggcaagucguccaucaugcgcagcgacgcccccaucggcaagugcaaguccgagugcaucacccccaacgggucgauccccaacgacaagccguuccagaacgugaaccggaucacguacggcgccugcccccgcuacgugaagcacuccacccugaagcuggcgaccgggaugcggaacguccccgagaagcagacccgcggcaucuucggggccaucgccggcuucaucgagaacggcugggaggggaugguggacggcugguacggguuccggcaccagaacagcgagggccgcgggcaggccgccgaccucaaguccacgcaggcggccaucgaccagaucaacggcaagcugaaccggcugaucggcaagaccaacgagaaguuccaccagaucgagaaggaguucucggagguggaggggcgcauccaggaccucgagaaguacgucgaggacaccaagaucgaccugugguccuacaacgccgagcugcucguggcccuggagaaccagcacaccaucgaccugacggacagcgagaugaacaagcuguucgagaagaccaagaagcagcuccgcgagaacgccgaggacaugggcaacgggugcuucaagaucuaccacaagugcgacaacgcgugcaucggcuccauccggaacgggaccuacgaccacaacguguaccgcgacgaggcccugaacaaccgguuccagaucaagggcgucgagcucaagucgggcuacaaggacuggauccuguggaucuccuucgccaucagcugcuuccugcucugcguggcccugcugggguucaucaugugggccugccagaagggcaacauccgcugcaacaucugcaucuga

SEQ ID NO: 13915 - RNA, 1701 nt, Artificial Sequence
  derived and/or modified CDS sequence (AUadapt) from InfluenzaA__ALN39740__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccgcaagagcuccucguccuucuucagccggcugaacuggcugacccaccucaacuacacguaccccgcccugaacgugaccguccccaacaacgagcaguucgacaagcuguacaucuggggcgugcaccaccccgggaccgacaaggaccagaucuuccucuacgcgcgguccagcgggcgcaucaccgugucgacgaagcggucccagcaggccgucaucccgaacaucggcuaccgcccccggauccgcgacauccccagccggaucuccaucuacuggaccaucgugaagcccggcgacauccugcugaucaacucgaccgggaaccucaucgccccgcgcggcuacuucaagauccgguccggcaagagcuccaucaugcgcucggacgcccccaucgggaagugcaaguccgagugcaucacccccaacggcagcauccccaacgacaagccguuccagaacgugaaccggaucacguacggggccugcccccgcuacgucaagcacuccacccugaagcuggcgaccggcaugcggaacgugcccgagaagcagacccgcgggaucuucggcgccaucgccggguucaucgagaacggcugggagggcaugguggacgggugguacggcuuccggcaccagaacucggaggggcgcggccaggccgccgaccucaaguccacgcaggcggccaucgaccagaucaacgggaagcugaaccggcugaucggcaagaccaacgagaaguuccaccagaucgagaaggaguucagcgaggucgagggccgcauccaggaccucgagaaguacguggaggacaccaagaucgaccugugguccuacaacgccgagcugcucguggcccuggagaaccagcacaccaucgaccugacggacucggagaugaacaagcuguucgagaagaccaagaagcagcuccgcgagaacgccgaggacauggggaacggcugcuucaagaucuaccacaagugcgacaacgcgugcaucggguccauccggaacggcaccuacgaccacaacgucuaccgcgacgaggcccugaacaaccgguuccagaucaaggggguggagcucaagagcggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 13916 - RNA, 1701 nt, Artificial Sequence; identical to SEQ ID NO: 68
  derived and/or modified CDS sequence (AUadapt) from InfluenzaA__ALN39741__HA

SEQ ID NO: 13917 - RNA, 1701 nt, Artificial Sequence
  derived and/or modified CDS sequence (AUadapt) from InfluenzaA__ALN39742__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccucggggcgcaucaccgugagcacgaagcggucccagcaggccgugaucccgaacaucggcucgcgcccccggauccgcgacauccccucccggaucagcaucuacuggaccaucgucaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucacguacggggacugcccccgcuacgugaagcacagcacccugaagcuggccaccggcaugcggaacguccccgagaagcagacccgcgggaucuucggcgcgaucgccggguucaucgagaacggcugggagggcaugguggacgggugguacggcuuccggcaccagaacuccgaggggcgcggccaggccgccgaccucaagucgacgcaggccgcgaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgccugcaucgggucgauccggaacggcaccuacgaccacaacguguaccgcgacgaggcgcugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 13918 - RNA, 1701 nt, Artificial Sequence
  derived and/or modified CDS sequence (AUadapt) from InfluenzaA__ALN39743__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccgcaagagcuccagcuccuucuucucgcggcugaacuggcugacccaccucaacuacaucuaccccgcccugaacgugacgaugcccaacaacgagcaguucgacaagcuguacaucuggggcguccaccaccccgggaccgacaaggaccagaucuuccucuacgcgcaguccagcgggcggaucaccgugucgaccaagcgcucccagcaggccgugaucccgaacaucggcagccggccccgcauccgggacauccccucccgcaucucgaucuacuggacgaucgucaagcccggcgacauccugcugaucaacuccaccgggaaccucaucgccccgcggggcuacuucaagauccgcagcgggaaguccagcaucaugcgguccgacgcccccaucggcaagugcaagucggagugcaucacccccaacggcuccauccccaacgacaagccguuccagaacgugaaccgcaucaccuacggggccugcccccgguacgugaagcacagcacgcugaagcuggcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagucgacccaggcggccaucgaccagaucaacgggaagcugaaccgccugaucggcaagacgaacgagaaguuccaccagaucgagaaggaguucuccgagguggagggccggauccaggaccucgagaaguacgucgaggacaccaagaucgaccuguggagcuacaacgccgagcugcucguggcccuggagaaccagcacaccaucgaccugaccgacuccgagaugaacaagcuguucgagaagacgaagaagcagcuccgcgagaacgccgaggacauggggaacggcugcuucaagaucuaccacaagugcgacaacgcgugcaucgggucgauccgcaacggcaccuacgaccacaacguguaccgggacgaggcccugaacaaccgcuuccagaucaagggggucgagcucaaguccggcuacaaggacuggauccuguggaucagcuucgccaucagcugcuuccugcucugcguggcccugcugggcuucaucaugugggccugccagaaggggaacauccggugcaacaucugcaucuga

SEQ ID NO: 13919 - RNA, 1701 nt, Artificial Sequence
  derived and/or modified CDS sequence (AUadapt) from InfluenzaA__ALN39744__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccgcaagagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccucggggcggaucaccgugagcacgaagcgcucccagcaggccgugaucccgaacaucggcucgcggccccgcauccgggacauccccucccgcaucagcaucuacuggaccaucgucaagcccggcgacauccugcugaucaacuccaccgggaaccucaucgccccgcggggcuacuucaagauccgcucggggaaguccagcaucaugcgguccgacgcccccaucggcaagugcaagucggagugcaucacccccaacggcuccauccccaacgacaagccguuccagaacgugaaccgcaucacguacggggccugcccccgguacgugaagcacagcacccugaagcuggcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagucgacgcaggcggccaucgaccagaucaacgggaagcugaaccgccugaucggcaagaccaacgagaaguuccaccagaucgagaaggaguucuccgagguggagggccggauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccgcaacggcaccuacgaccacaacguguaccgggacgaggcccugaacaaccgcuuccagaucaagggggucgagcucaaguccggcuacaaggacuggauccuguggaucagcuucgccaucagcugcuuccugcucugcguggcccugcugggcuucaucaugugggccugccagaaggggaacauccggugcaacaucugcaucuga

SEQ ID NO: 13920 - RNA, 1701 nt, Artificial Sequence
  derived and/or modified CDS sequence (AUadapt) from InfluenzaA__ALN39745__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccgcaagagcuccucguccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuuccucuacgcgcaguccucggggcggaucaccgugagcaccaagcgcucccagcaggccgugaucccgaacaucggcucgcggccccgcauccgggacauccccucccgcaucagcaucuacuggacgaucgucaagcccggcgacauccugcugaucaacuccaccgggaaccucaucgccccgcggggcuacuucaagauccgcucggggaaguccagcaucaugcgguccgacgcccccaucggcaagugcaagucggagugcaucacccccaacggcuccauccccaacgacaagccguuccagaacgugaaccgcaucaccuacggggccugcccccgguacgugaagcacagcacgcugaagcuggcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagucgacccaggcggccaucgaccagaucaacgggaagcugaaccgccugaucggcaagacgaacgagaaguuccaccagaucgagaaggaguucuccgagguggagggccggauccaggaccucgagaaguacgucgaggacaccaagaucgaccuguggagcuacaacgccgagcugcucguggcccuggagaaccagcacaccaucgaccugaccgacuccgagaugaacaagcuguucgagaagacgaagaagcagcuccgcgagaacgccgaggacauggggaacggcugcuucaagaucuaccacaagugcgacaacgcgugcaucgggucgauccgcaacggcaccuacgaccacaacguguaccgggacgaggcccugaacaaccgcuuccagaucaagggggucgagcucaaguccggcuacaaggacuggauccuguggaucagcuucgccaucagcugcuuccugcucugcguggcccugcugggcuucaucaugugggccugccagaaggggaacauccggugcaacaucugcaucuga

SEQ ID NO: 13921 - RNA, 1701 nt, Artificial Sequence; identical to SEQ ID NO: 13919
  derived and/or modified CDS sequence (AUadapt) from InfluenzaA__ALN39746__HA

SEQ ID NO: 13922 - RNA, 1701 nt, Artificial Sequence; identical to SEQ ID NO: 13614
  derived and/or modified CDS sequence (AUadapt) from InfluenzaA__ALN39747__HA

SEQ ID NO: 13923 - RNA, 1701 nt, Artificial Sequence
  derived and/or modified CDS sequence (AUadapt) from InfluenzaA__ALN39748__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccagcuccuucuucucgcggcugaacuggcugacccaccucaacuacgccuaccccgcgcugaacgugacgaugcccaacaacgagcaguucgacaagcuguacaucuggggcguccaccaccccgggaccgacaaggaccagaucuuccucuacgcccaguccagcgggcgcaucaccgugucgaccaagcggucccagcaggccgugaucccgaacaucggcagccgcccccggauccgcgacauccccucccggaucucgaucuacuggacgaucgucaagcccggcgacauccugcugaucaacuccaccgggaaccucaucgccccgcgcggcuacuucaagauccugagcgggaaguccagcaucaugcgguccgacgcccccaucggcaagugcaagucggagugcaucacccccaacggcuccauccccaacgacaagccguuccagaacgugaaccgcaucaccuacggggcgugcccccgguacgugaagcacagcacgcugaagcucgccaccggcaugcgcaacguccccgagaagcagacccgggggaucuucggcgccaucgccggguucaucgagaacggcugggagggcaugguggacgggugguacggcuuccgccaccagaacuccgaggggcggggccaggccgcggaccucaagucgacccaggccgccaucgaccagaucaacgggaagcugaaccgccugaucggcaagacgaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacaccaucgaccucaccgacuccgagaugaacaagcuguucgagaagacgaagaagcagcugcgcgagaacgcggaggacauggggaacggcugcuucaagaucuaccacaagugcgacaacgccugcaucgggucgauccgcaacggcaccuacgaccacaacguguaccgggacgaggcccucaacaaccgcuuccagaucaagggggucgagcugaaguccggcuacaaggacuggauccuguggaucagcuucgccaucagcugcuuccuccugugcguggcccugcucggcuucaucaugugggcgugccagaaggggaacauccggugcaacaucugcaucuga

SEQ ID NO: 13924 - RNA, 1701 nt, Artificial Sequence
  derived and/or modified CDS sequence (AUadapt) from InfluenzaA__ALN39749__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacucguccaucggggagaucugcaacagcccccaccagauccucgacggcgagaacugcacccugaucgacgcccugcucggggacccccagugcgacggcuuccagaacaagaagugggaccuguucguggagcgguccaaggccuacucgaacugcuaccccuacgacgugccggacuacgcgucccugcgcagccucgucgccuccucgggcacccuggaguucaacaacgaguccuucaacugggccggggugacgcagaacggcaccagcuccucgugcauccggggguccaacagcuccuucuucucgcgccugaacuggcucacccaccugaacuccaaguaccccgcccugaacgugaccaugcccaacaacgagcaguucgacaagcucuacaucuggggcguccaccaccccgggacggacaaggaccagaucuuccuguacgcgcagccgagcggccggaucaccgugucgaccaagcgcucccagcaggccgugauccccaacaucggcagccggccccgcauccgggacauccccucccgcaucucgaucuacuggaccaucgucaagccgggggacauccugcucaucaacuccacgggcaaccugaucgcgccccggggguacuucaagauccgcagcggcaaguccucgaucaugcgguccgacgcccccaucggcaagugcaagagcgagugcaucacccccaacggguccaucccgaacgacaagcccuuccagaacgugaaccgcaucaccuacggcgccugcccccgguacgugaagcagucgacccugaagcucgccacggggaugcgcaacguccccgagcggcagacccgcggcaucuucggggccaucgccggcuucaucgagaacggcugggaggggaugguggacggcugguacggguuccggcaccagaacuccgagggccgcgggcaggccgccgaccucaagagcacccaggcggccaucgaccagaucaacggcaagcugaaccggcugaucggcaagaccaacgagaaguuccaccagaucgagaaggaguucuccgagguggaggggcgcauccaggaccuggagaaguacgucgaggacacgaagaucgaccuguggucguacaacgccgagcuccugguggcccuggagaaccagcacaccaucgaccucaccgacuccgagaugaacaagcuguucgagaagaccaagaagcagcugcgcgagaacgccgaggacaugggcaacgggugcuucaagaucuaccacaagugcgacaacgcgugcaucggcagcauccggaacgggacguacgaccacgacguguaccgcgacgaggcccucaacaaccgguuccagaucaagggcgucgagcugaaguccggcuacaaggacuggauccuguggaucucguucgccaucagcugcuuccuccugugcguggcccugcucggguucaucaugugggccugccagaagggcaacauccgcugcaacaucugcaucuga

SEQ ID NO: 13925 - RNA, 1701 nt, Artificial Sequence; identical to SEQ ID NO: 68
  derived and/or modified CDS sequence (AUadapt) from InfluenzaA__ALN39750__HA

SEQ ID NO: 13926 - RNA, 1701 nt, Artificial Sequence; identical to SEQ ID NO: 68
  derived and/or modified CDS sequence (AUadapt) from InfluenzaA__ALN39789__HA

SEQ ID NO: 13927 - RNA, 1701 nt, Artificial Sequence; identical to SEQ ID NO: 224
  derived and/or modified CDS sequence (AUadapt) from InfluenzaA__ALO75895__HA

SEQ ID NO: 13928 - RNA, 1701 nt, Artificial Sequence
  derived and/or modified CDS sequence (AUadapt) from InfluenzaA__ALO75907__HA
auggagaagaucgugcugcuccuggccaucgucucgcuggugaagggcgaccagaucugcaucggguaccacgccaacaacuccaccgagcaggucgacaccaucauggagaagaacgugacggugacccacgcgcaggacauccucgagaagacccacaacggcaagcugugcgaccugaacggggugaagccccucauccugaaggacugcucggucgccggcugguuccuggggaaccgcaugugcgacgaguucauccgggugccggagugguccuacaucguggagcgcgccaaccccgccaacgaccucugcuaccccggcaaccugaacgacuacgaggagcugaagcaccuccugagccggaucaaccacuucgagaagacccugaucauccccaaguccucguggccgaaccacacguccagcggcgucuccgccgcgugccccuaccaggggaugcccucguucuuccgcaacgugguguggcucaccaagaagaacgacgccuaccccaccaucaagauguccuacaacaacaccuaccgggaggaccugcugauccucuggggcauccaccacucgaacaacgccgccgagcagacgaaccuguacaagaacccgaccaccuacgucuccguggggaccagcacgcugaaccagcgccucgagcccaagaucgcgacccggucccaggugaacggccagcgcgggcggauggacuucuucuggaccauccugaagcccaacgacgccauccacuucgagucgaacggcaacuucaucgcccccgaguacgccuacaagaucgucaagaagggcgacuccaccaucaugaaguccgagauggaguacgggcacugcaacacgaagugccagaccccgaucggcgccaucaacagcucgaugcccuuccacaacauccacccccugaccaucggggagugccccaaguacgucaagucgaacaagcucgugcuggcgaccggccugcgcaacuccccgcuccgggagcgccggcgcaagcggggccuguucggggccaucgccggcuucaucgagggcggguggcaggggaugguggacggcugguacggcuaccaccacagcaacgagcagggguccggcuacgccgccgaccgcgagucgacgcagaaggcgaucgacggggugaccaacaaggugaacuccaucaucgacaagaugaacacccaguucgaggccgucggccgggaguucaacaaccuggagcgccggaucgagaaccucaacaagaagauggaggacggguuccuggacguguggaccuacaacgccgagcugcucgugcugauggagaacgagcgcacgcuggacuuccacgacagcaacgucaagaaccucuacgacaaggugcggcugcagcugcgcgacaacgccaaggagcucggcaacggcugcuucgaguucuaccacaagugcgacaacgagugcauggaguccguccgcaacgggaccuacgacuacccccuguacucggaggaggcccggcugaagcgcgaggagaucuccggcgugaagcucgagucgaucgggaccuaccagauccuguccaacuacagcaccguggcguccucgcuggcccucgccaucaucgucgccggccugucccuguggaugugcagcaacgggucccuccagugccggaucugcaucuga

SEQ ID NO: 13929 - RNA, 1701 nt, Artificial Sequence
  derived and/or modified CDS sequence (AUadapt) from InfluenzaA__ALO75919__HA
auggagaagaucgugcugcuccuggccaucgucucgcuggugaagggcgaccagaucugcaucggguaccacgccaacaacuccaccgagcaggucgacaccaucauggagaagaacgugacggugacccacgcgcaggacauccucgagaagacccacaacggcaagcugugcgaccugaacggggugaagccccucauccugaaggacugcucggucgccggcuggcugcacgggaaccgcaugugcgacgaguucauccgggugccggagugguccuacaucguggagcgcgccaaccccgccaacgaccucugcuaccccggcaaccugaacgacuacgaggagcugaagcaccuccugagccggaucaaccacuucgagaagacccugaucauccccaaguccucguggccgaaccacacguccucgggcgucuccgccgcgugccccuaccaggggaugcccagcuucuuccgcaacgugguguggcucaccaagaagaacgacgccuaccccaccaucaagauguccuacaacaacaccuaccgggaggaccugcugauccucuggggcauccaccacucgaacaacgccgccgagcagacgaaccuguacaagaacccgaccaccuacgucuccguggggaccagcacgcugaaccagcgccucgagcccaagaucgcgacccggucccaggugaacggccagcgcgggcggauggacuucuucuggaccauccugaagcccaacgacgccauccacuucgagucgaacggcaacuucaucgcccccgaguacgccuacaagaucgucaagaagggcgacuccaccaucaugaaguccgagauggaguacgggcacugcaacacgaagugccagaccccgaucggcgccaucaacucgagcaugcccuuccacaacauccacccccugaccaucggggagugccccaaguacgucaagucgaacaagcucgugcuggcgaccggccugcgcaacuccccgcuccgggagcgccggcgcaagcggggccuguucggggccaucgccggcuucaucgagggcggguggcaggggaugguggacggcugguacggcuaccaccacucgaacgagcagggguccggcuacgccgccgaccgcgagagcacgcagaaggcgaucgacggggugaccaacaaggugaacuccaucaucgacaagaugaacacccaguucgaggccgucggccgggaguucaacaaccuggagcgccggaucgagaaccucaacaagaagauggaggacggguuccuggacguguggaccuacaacgccgagcugcucgugcugauggagaacgagcgcacgcuggacuuccacgacucgaacgucaagaaccucuacgacaaggugcggcugcagcugcgcgacaacgccaaggagcucggcaacggcugcuucgaguucuaccacaagugcgacaacgagugcauggaguccguccgcaacgggaccuacgacuacccccuguacagcgaggaggccucccugaagcgggaggagaucucgggcgugaagcucgaguccaucgggaccuaccagauccugucgaucuacuccaccguggcgagcucccuggcccucgccaucaucgucgccggccugucgcuguggaugugcuccaacgggagccuccagugccgcaucugcaucuga

SEQ ID NO: 13930 - RNA, 1683 nt, Artificial Sequence; identical to SEQ ID NO: 245
  derived and/or modified CDS sequence (AUadapt) from InfluenzaA__ALT20080__HA

SEQ ID NO: 13931 - RNA, 1701 nt, Artificial Sequence; identical to SEQ ID NO: 59
  derived and/or modified CDS sequence (AUadapt) from InfluenzaA__ALT66860__HA

SEQ ID NO: 13932 - RNA, 1701 nt, Artificial Sequence
  derived and/or modified CDS sequence (AUadapt) from InfluenzaA__AMA65391__HA
augaaggccauccuggugguccuccuguacaccuucaccacggccaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccaacucggacaacgggaccugcuaccccggcgacuucaucaacuacgaggagcuccgggagcagcuguccagcguguccucguucgagcgcuucgagaucuuccccaagaccuccucguggcccaaccacgacuccaacaagggcgucaccgccgccugcccgcacgccggcgccaagagcuucuacaagaaccugaucuggcucgugaagaaggggaacuccuaccccaagcugaaccagucguacaucaacgacaagggcaaggaggugcugguccucugggggauccaccaccccuccacgaccgcggaccagcagagccuguaccagaacgccgacgccuacguguucgugggcaccucgcgguacuccaagaaguucaagcccgagaucgccacccgcccgaagguccggggccaggaggggcgcaugaacuacuacuggacgcugguggagcccggcgacaagaucaccuucgaggccaccgggaaccucguggucccccgguacgcguucaccauggagcgcaacgccggcucgggcaucaucaucuccgacacgcccgugcacgacugcaacacgaccugccagaccccggagggggccaucaacaccagccugcccuuccagaacauccaccccaucaccaucggcaagugccccaaguacgugaaguccaccaagcugcggcucgccaccgggcugcgcaacgucccgucgauccagucccggggccuguucggggccaucgcgggcuucaucgagggcggguggacgggcaugguggacgggugguacggcuaccaccaccagaacgagcaggggucgggcuacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggguuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggagaagaucgacggggugaagcucgagucgacccgcaucuaccagauccuggccaucuacuccaccgucgccagcucccuggugcucguggucuuccugggcgcgaucucguucuggaugugcuccaacggcagccugcagugccggaucugcaucuga

SEQ ID NO: 13933 - RNA, 1701 nt, Artificial Sequence
  derived and/or modified CDS sequence (AUadapt) from InfluenzaA__AMA65393__HA
augaaggccauccuggugguccuccuguacaccuucaccacggccaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccaacucggacaacgggaccugcuaccccggcgacuucaucaacuacgaggagcuccgggagcagcuguccagcguguccucguucgagcgcuucgagaucuuccccaagaccuccucguggcccaaccacgacuccaacaagggcgucaccgccgccugcccgcacgccggcgccaagagcuucuacaagaaccugaucuggcucgugaagaaggggaacuccuaccccaagcugaaccagucguacaucaacgacaagggcaaggaggugcugguccucugggggauccaccaccccuccacgaccgcggaccagcagagccuguaccagaacgccgacgccuacguguucgugggcaccucgcgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggucgggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgucgauccagucccgggggcuguucggcgccaucgcgggguucaucgagggcggcuggacggggaugguggacggcugguacggguaccaccaccagaacgagcagggcucgggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggagaagaucgacggcgugaagcucgagucgacccgcaucuaccagauccuggccaucuacucccccgucgccagcucccuggugcucguggucuuccugggggcgaucucguucuggaugugcuccaacggcagccugcagugccggaucugcaucuga

SEQ ID NO: 13934 - RNA, 1701 nt, Artificial Sequence
  derived and/or modified CDS sequence (AUadapt) from InfluenzaA__BAA02768__HA
augaaggccaagcugcucgugcugcugugcgccuucaccgcgaccgacgccgacacgaucugcaucggcuaccacgccaacaacucgaccgacaccgucgacaccgugcucgagaagaacgugacggucacccacuccgugaaccugcuggaggacagccacaacgggaagcucugccgccugaagggcaucgcgccccugcagcucgggaacugcuccaucgccggcuggauccuggggaacccggagugcgagagccuguucuccaaggagagcugguccuacaucgccgagacccccaacagcgagaacgggaccugcuaccccggcuacuucgccgacuacgaggagcuccgggagcagcuguccucgguguccagcuucgagcgcuucgagaucuuccccaaggaguccagcuggccgaaccacacggucaccaagggggugaccgccuccugcagccacaacggcaaguccagcuucuaccggaaccugcucuggcugaccgggaagaacggccuguaccccaaccucuccaagucguacgugaacaacaaggagaaggagguccuggugcuguggggcgugcaccaccccagcaacaucggcgaccagcgcgccaucuaccacacggagaacgcguacgucuccguggugagcucccacuacagccggcgcuucacccccgagaucgccaagcggccgaagguccgcggccaggaggggcggaucaacuacuacuggacccuccuggagcccggcgacaccaucaucuucgaggccaacgggaaccugaucgcccccugguacgccuucgcgcucucccgcggcuucggcagcgggaucaucacguccaacgccagcauggacgagugcgacgccaagugccagacgccccagggcgccaucaacuccucgcugccguuccagaacgugcaccccgugaccaucggggagugccccaaguacguccgguccaccaagcugcgcauggugaccggccuccggaacauccccagcauccagucccgcgggcuguucggcgccaucgcgggcuucaucgagggcggguggaccgggaugaucgacggcugguacggguaccaccaccagaacgagcagggcagcggcuacgccgccgaccagaaguccacccagaacgccaucaacgggaucaccaacaaggugaacagcgucaucgagaagaugaacacgcaguucaccgccgugggcaaggaguucaacaagcuggagcggcgcauggaguaccucaacaagaagguggacgacggguuccuggacaucuggaccuacaacgcggagcugcucguccugcuggagaacgagcggacccucgacuuccacgacuccaacgugaagaaccuguacgagaaggucaagagccagcugaagaacaacgccaaggagaucggcuacgggugcuucgaguucuaccacaagugcaacaacgagugcauggaguccgugaagaacggcacguacgacuacccgaaguacucggaggagagcaagcucaaccgcgagaagaucgacggcgugaagcuggaguccaugggggucuaccagauccuggccaucuacagcaccguggccuccagccucgugcugcuggucucccucggcgccaucagcuucuggaugugcuccaacgggagccugcagugccggaucugcaucuga

SEQ ID NO: 13935 - RNA, 1701 nt, Artificial Sequence
  derived and/or modified CDS sequence (AUadapt) from InfluenzaA__BAA02769__HA
augaaggccaagcugcucgugcugcugugcgccuucaccgcgaccgacgccgacacgaucugcaucggcuaccacgccaacaacucgaccgacaccgucgacaccgugcucgagaagaacgugacggucacccacuccgugaaccugcuggaggacagccacaacgggaagcucugccgccugaagggcaucgcgccccugcagcucgggaacugcuccaucgccggcuggauccuggggaacccggagugcgagagccuguucuccaaggagagcugguccuacaucgccgagacccccaacagcgagaacgggaccugcuaccccggcuacuucgccgacuacgaggagcuccgggagcagcuguccucgguguccagcuucgagcgcuucgagaucuuccccaaggaguccagcuggccgaaccacacggucaccaagggggugaccgccuccugcagccacaacggcaaguccagcuucuaccggaaccugcucuggcugaccgggaagaacggccuguaccccaaccucuccaagucguacgugaacaacaaggagaaggagguccuggugcuguggggcgugcaccaccccagcaacauccgcgaccagcgggccaucuaccacacggagaacgcguacgucuccguggugagcucccacuacagccgccgguucacccccgagaucgccaagcgcccgaagguccgggaccaggagggccgcaucaacuacuacuggacccuccuggagcccggcgacaccaucaucuucgaggccaacgggaaccugaucgcccccugguacgccuucgcgcucucccggggcuucgggagcggcaucaucacguccaacgccagcauggacgagugcgacgccaagugccagacgccccagggcgccaucaacuccucgcugccguuccagaacgugcaccccgugaccaucggggagugccccaaguacguccgcuccaccaagcugcggauggugaagggccuccgcaacauccccagcauccagucccgggggcuguucggcgccaucgcgggguucaucgagggcggcuggaccgggaugaucgacggcugguacggguaccaccaccagaacgagcagggcagcggguacgccgccgaccagaaguccacccagaacgccaucaacggcaucaccaacaaggugaacagcgucaucgagaagaugaacacccaguucacggccgugggcaaggaguucaacaagcuggagcgccggauggaguaccucaacaagaagguggacgacggguuccuggacaucuggaccuacaacgcggagcugcucguccugcuggagaacgagcgcacccucgacuuccacgacuccaacgugaagaaccuguacgagaaggucaagagccagcugaagaacaacgccaaggagaucggcuacgggugcuucgaguucuaccacaagugcaacaacgagugcauggaguccgugaagaacggcaccuacgacuacccgaaguacucggaggagagcaagcucaaccgggagaagaucgacggggugaagcuggaguccaugggcgucuaccagauccuggccaucuacagcacgguggccuccagccucgugcugcuggucucccucggcgccaucagcuucuggaugugcuccaacgggagccugcagugccgcaucugcaucuga

SEQ ID NO: 13936 - RNA, 1689 nt, Artificial Sequence
  derived and/or modified CDS sequence (AUadapt) from InfluenzaA__BAC43764__HA
auggccaucaucuaccugauccuccuguucaccgccgugcgcggcgaccagaucugcaucggguaccacgcgaacaacucgaccgagaaggucgacacgauccuggagcggaacgugaccgugacccacgccaagaacauccucgagaagacccacaacggcaagcugugcaagcugaacgggaucccgccccucgagcugggcgacugcuccaucgccggguggcugcucggcaaccccgagugcgaccgccugcugaucguccccgaguggucguacaucauggagaaggagaacccccgggacggccucugcuacccgggguccuucaacgacuacgaggagcugaagcaccuccugagcuccgugaagcacuucgagaaggugaagauccugcccaaggaccgcuggacgcagcacaccaccaccggcgggucgcgggccugcgccgucuccggcaaccccagcuucuuccgcaacaugguguggcugacgaagaagggguccaacuaccccguggcgaagggcucguacaacaacaccuccggcgagcagaugcucaucaucuggggcguccaccacccgaucgacgagaccgagcagaucacccuguaccagaacguggggacguacgugagcgucgggaccuccacccugaacaagcggucgacccccgagaucgccacgcgccccaaggugaacggccucggcucccggauggaguucagcuggacccugcuggacaugugggacaccaucaacuucgaguccaccgggaaccucaucgcccccgaguacggcuucaagaucucgaagcgcggguccucgggcaucaugaagacggaggggacccuggagaacugcgagaccaagugccagaccccgcugggcgccaucaacacgacccuccccuuccacaacgugcacccccugaccaucggcgagugccccaaguacgucaagagcgagaagcuggugcucgcgaccgggcugcggaacgugccgcagaucgagucccgcggccuguucggggccaucgccggcuucaucgagggcggguggcagggcauggucgacgggugguacggcuaccaccacucgaacgaccagggguccggcuacgccgccgacaaggagagcacgcagaaggcguucgacgggaucaccaacaaggugaacuccgugaucgagaagaugaacacccaguucgaggccgucggcaaggaguucucgaaccucgagcggcgccuggagaaccugaacaagaagauggaggacggcuuccucgacguguggaccuacaacgccgagcugcuggugcucauggagaacgagcggacgcuggacuuccacgacuccaacgucaagaaccuguacgacaaggugcgcaugcagcuccgggacaacgucaaggagcuggggaacggcugcuucgaguucuaccacaagugcgacgacgagugcaugaacagcgugaagaacgggaccuacgacuaccccaaguacgaggaggaguccaagcugaaccgcaacgagaucaagggcgugaagcucucguccaugggcgucuaccagauccuggccaucuacgccaccguggcggggagccugucccucgccaucaugauggccggcaucucguucuggaugugcuccaacgggagccugcaguuccggaucugcaucuga

SEQ ID NO: 13937 - RNA, 1707 nt, Artificial Sequence
  derived and/or modified CDS sequence (AUadapt) from InfluenzaA__BAE07201__HA
auggagaagaucgugcugcuguucgccaucgucucgcuggugaaguccgaccagaucugcaucggcuaccacgccaacaacucgaccgagcaggucgacaccaucauggagaagaacgugacggugacccacgcgcaggacauccuggagaagacccacaacgggaagcucugcgaccuggacggcgugaagccccugauccuccgcgacugcuccgucgccggguggcugcugggcaacccgaugugcgacgaguucaucaacgugcccgaguggagcuacaucguggagaaggccaaccccgccaacgaccucugcuaccccggggacuucaacgacuacgaggagcugaagcaccuccucucccggaucaaccacuucgagaagauccagaucaucccgaagaacucgugguccagccacgaggccucccugggcgucucguccgcgugccccuaccagggcaagagcuccuucuuccgcaacgugguguggcugaucaagaagaacaacgccuaccccaccaucaagcggucguacaacaacacgaaccaggaggaccuccugguccugugggggauccaccaccccaacgacgccgccgagcagacccgccucuaccagaacccgaccaccuacaucuccgugggcacgagcacccugaaccagcggcuggugcccaagaucgcgacccgcuccaaggucaacgggcagaacggccggauggaguucuucuggaccauccucaagcccaacgacgccaucaacuucgagucgaacgggaacuucaucgcccccgaguacgccuacaagaucgugaagaagggcgacuccgccaucaugaaguccgagcuggaguacggcaacugcaacacgaagugccagaccccgaugggggcgaucaacagcucgaugcccuuccacaacauccacccccugaccaucggcgagugccccaaguacgucaagagcaaccgccucgugcuggccaccgggcugcggaacuccccgcagcgcgagcggcgccggaagaagcgcggccucuucggcgccaucgccggguucaucgagggcggguggcagggcaugguggacgggugguacggcuaccaccacucgaacgagcagggcuccggguacgccgcggacaaggagagcacgcagaaggccaucgacggcgugaccaacaaggucaacuccaucaucgacaagaugaacacccaguucgaggccguggggcgggaguucaacaaccuggagcgccggaucgagaaccugaacaagaagauggaggacggcuuccucgacguguggaccuacaacgccgagcugcugguccucauggagaacgagcgcacgcuggacuuccacgacucgaacgugaagaaccuguacgacaagguccggcuccagcugcgcgacaacgccaaggagcuggggaacggcugcuucgaguucuaccacaagugcgacaacgagugcauggaguccgugcggaacggcaccuacgacuacccccaguacagcgaggaggcgcgccucaagcgcgaggagaucuccggggugaagcuggagucgaucggcaccuaccagauccuguccaucuacagcaccgucgccuccucgcucgcccuggccaucaugguggccgggcugucccucuggaugugcagcaacggcucccugcagugccggaucugcaucuga

SEQ ID NO: 13938 - RNA, 1701 nt, Artificial Sequence
  derived and/or modified CDS sequence (AUadapt) from InfluenzaA__BAH95823__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcuccucgcgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccucgcugcccuuccagaacauccaccccaucacgaucgggaagugccccaagcacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcucgggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccagcucccuggugcucguggucucgcugggggccaucuccuucuggaugugcagcaacggcucccugcagugccggaucugcaucuga

SEQ ID NO: 13939 - RNA, 1701 nt, Artificial Sequence; identical to SEQ ID NO: 62
  derived and/or modified CDS sequence (AUadapt) from InfluenzaA__BAH95824__HA

SEQ ID NO: 13940 - RNA, 1707 nt, Artificial Sequence
  derived and/or modified CDS sequence (AUadapt) from InfluenzaA__BAJ07997__HA
auggagaagaucgugcugcuguucgccaucgucucgcuggugaaguccgaccagaucugcaucggcuaccacgccaacaacagcaccgagcaggucgacaccaucauggagaagaacgugacggugacccacgcgcaggacauccuggagaagacccacaacgggaagcucugcgaccuggacggcgugaagccccugauccuccgcgacugcuccgucgccggguggcugcugggcaacccgaugugcgacgaguucaucaacgugcccgaguggucguacaucguggagaaggccaaccccgccaacgaccucugcuaccccggggacuucaacgacuacgaggagcugaagcaccuccucucccggaucaaccacuucgagaagauccagaucaucccgaagaacagcugguccucgcacgaggccucccugggcgucagcuccgcgugccccuaccagggcaagucguccuucuuccgcaacgugguguggcugaucaagaagaacaacgccuaccccaccaucaagcggagcuacaacaacacgaaccaggaggaccuccugguccugugggggauccaccaccccaacgacgccgccgagcagacccgccucuaccagaacccgaccaccuacaucuccgugggcacgucgacccugaaccagcggcuggugcccaagaucgcgacccgcuccaaggucaacgggcagagcggccggauggaguucuucuggaccauccucaagcccaacgacgccaucaacuucgaguccaacgggaacuucaucgcccccgaguacgccuacaagaucgugaagaagggcgacucggccaucaugaaguccgagcuggaguacggcaacugcaacacgaagugccagaccccgaugggggcgaucaacagcucgaugcccuuccacaacauccacccccugaccaucggcgagugccccaaguacgugaaguccaaccgccucguccuggccaccgggcugcggaacagcccgcagcgcgagcggcgccggaagaagcgcggccucuucggcgccaucgccggguucaucgagggcggguggcagggcaugguggacgggugguacggcuaccaccacuccaacgagcagggcucgggguacgccgcggacaaggaguccacgcagaaggccaucgacggcgugaccaacaaggucaacagcaucaucgacaagaugaacacccaguucgaggccguggggcgggaguucaacaaccuggagcgccggaucgagaaccugaacaagaagauggaggacggcuuccucgacguguggaccuacaacgccgagcugcugguccucauggagaacgagcgcacgcuggacuuccacgacuccaacgugaagaaccuguacgacaagguccggcuccagcugcgcgacaacgccaaggagcuggggaacggcugcuucgaguucuaccacaagugcgacaacgagugcauggagucggugcggaacggcaccuacgacuacccccaguacuccgaggaggcgcgccucaagcgcgaggagaucagcggggugaagcuggaguccaucggcaccuaccagauccugucgaucuacuccaccgucgccagcucccucgcccuggccaucaugguggccgggcugucgcucuggaugugcuccaacggcagccugcagugccggaucugcaucuga

SEQ ID NO: 13941 - RNA, 1701 nt, Artificial Sequence
  derived and/or modified CDS sequence (AUadapt) from InfluenzaA__BAJ39949__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacacguacguguucgugggcaccucccgguacucgaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccaagcugcuggugcuccugaagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgcgucgagccuggugcucguggucucccugggggccaucucguucuggaugugcuccaacggcagccugcagugccggaucugcaucuga

SEQ ID NO: 13942 - RNA, 1701 nt, Artificial Sequence
  derived and/or modified CDS sequence (AUadapt) from InfluenzaA__BAJ39950__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucgccgagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggugaccgccgccugcccgcacgcgggcgccaaguccuucuacaagaaccugaucuggcucgucaagaaggggaacagcuaccccaagcuguccaagucguacaucaacgacaagggcaaggaggugcuggugcucugggggauccaccaccccagcaccuccgccgaccagcagucgcuguaccagaacgccgacgccuacgucuucgugggcacgucccgguacagcaagaaguucaagcccgagaucgcgauccgcccgaaggugcgggaccaggagggccgcaugaacuacuacuggacccuggucgagcccggggacaagaucaccuucgaggccaccggcaaccucguggugccccgguacgccuucgccauggagcgcaacgccggguccggcaucaucaucucggacacgcccguccacgacugcaacacgaccugccagaccccgaagggcgcgaucaacaccucccugcccuuccagaacauccaccccaucaccaucgggaagugccccaaguacgucaagagcaccaagcugcggcucgccaccggccugcgcaacgugccguccauccagucgcgggggcuguucggcgccaucgccggguucaucgagggcggcuggacggggaugguggacggcugguacggguaccaccaccagaacgagcagggcuccggguacgccgcggaccucaagucgacccagaacgccaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggcgaagcugaaccgggaggagaucgacggcgugaagcucgagagcacccgcaucuaccagauccuggccaucuacuccaccguggccucgagccugguccucguggugucccugggggccaucucguucuggaugugcuccaacggcagccugcagugccggaucugcaucuga

SEQ ID NO: 13943 - RNA, 1701 nt, Artificial Sequence
  derived and/or modified CDS sequence (AUadapt) from InfluenzaA__BAJ39951__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacacguacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucucggacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccuuccagucgcgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggccaucuacuccaccgucgcgagcucgcuggugcucguggucucccugggggccaucagcuucuggaugugcuccaacggcagccugcagugccggaucugcaucuga

SEQ ID NO: 13944 - RNA, 1701 nt, Artificial Sequence; identical to SEQ ID NO: 9517
  derived and/or modified CDS sequence (AUadapt) from InfluenzaA__BAJ39952__HA

SEQ ID NO: 13945 - RNA, 1701 nt, Artificial Sequence
  derived and/or modified CDS sequence (AUadapt) from InfluenzaA__BAJ39953__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacacguacguguucgugggcaccucccgguacucgaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccaagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgcgucgagccuggugcucguggucucccugggggccaucucguucuggaugugcuccaacggcagccugcagugccggaucugcaucuga

SEQ ID NO: 13946 - RNA, 1701 nt, Artificial Sequence; identical to SEQ ID NO: 9517
  derived and/or modified CDS sequence (AUadapt) from InfluenzaA__BAJ39954__HA

SEQ ID NO: 13947 - RNA, 1701 nt, Artificial Sequence
  derived and/or modified CDS sequence (AUadapt) from InfluenzaA__BAJ39955__HA
augaaggccauccuggugguccuccuguacaccuucgccaccgcgaacgccgacacgcugucgaucggcuaccacgccaacaacuccaccgacaccguggacaccgugcucgagaagaacgucacggugacccacagcgugaaccugcuggaggacaagcacaacgggaagcucugcaagcugcgcggcgucgcgccccugcaccucgggaagugcaacaucgccggcuggauccuggggaacccggagugcgagucccugucgaccgcguccagcugguccuacaucguggagaccucguccagcgacaacggcacgugcuaccccggcgacuucaucgacuacgaggagcuccgggagcagcuguccucgguguccagcuucgagcgcuucgagaucuuccccaagaccuccucguggcccaaccacgacuccaacaagggggucaccgccgccugcccgcacgccggcgccaagagcuucuacaagaaccugaucuggcucgugaagaaggggaacuccuaccccaagcugucgaagagcuacaucaacgacaagggcaaggaggugcugguccucugggggauccaccaccccuccaucucggccgaccagcagucccuguaccagaacgccgacaccuacguguucgugggcacgagccgguacuccaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgccgggucgggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgccaccggccugcgcaacgucccgucgauccagucccgggggcuguucggcgcgaucgccggguucaucgagggcggcuggacggggaugguggacggcugguacggguaccaccaccagaacgagcagggcagcggguacgccgccgaccucaaguccacccagaacgccaucgacgagaucaccaacaaggugaacucggucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggccaucuacagcaccgucgcgucgucccuggugcucguggucagccugggggccaucuccuucuggaugugcagcaacggcucccugcagugcaagaucugcaucuga

SEQ ID NO: 13948 - RNA, 1701 nt, Artificial Sequence; identical to SEQ ID NO: 13942
  derived and/or modified CDS sequence (AUadapt) from InfluenzaA__BAJ39956__HA

SEQ ID NO: 13949 - RNA, 1701 nt, Artificial Sequence; identical to SEQ ID NO: 9517
  derived and/or modified CDS sequence (AUadapt) from InfluenzaA__BAJ39957__HA

SEQ ID NO: 13950 - RNA, 1701 nt, Artificial Sequence
  derived and/or modified CDS sequence (AUadapt) from InfluenzaA__BAJ39958__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaaggucaagucccagcugaagaacaacgccaaggagaucgggaacggcugcuucgaguucuaccacaagugcgacaacacgugcauggagucggugaagaacgggaccuacgacuaccccaaguacuccaaggaggccaagcugaaccgcgagaagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 13951 - RNA, 1701 nt, Artificial Sequence
  derived and/or modified CDS sequence (AUadapt) from InfluenzaA__BAJ39959__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguucauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacucggucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaaggucaagagccagcugaagaacaacgccaaggagaucgggaacggcugcuucgaguucuaccacaagugcgacaacacgugcauggaguccgugaagaacgggaccuacgacuaccccaaguacucgaaggaggccaagcugaaccgcgaggagaucgacggcgugaagcucgaguccacccggaucuaccagauccuggcgaucuacagcaccgucgccuccucgcuggugcucguggucagccugggggccaucuccuucuggaugugcagcaacggcucccugcagugccgcaucugcaucuga

SEQ ID NO: 13952 - RNA, 1701 nt, Artificial Sequence; identical to SEQ ID NO: 116
  derived and/or modified CDS sequence (AUadapt) from InfluenzaA__BAJ39960__HA

SEQ ID NO: 13953 - RNA, 1701 nt, Artificial Sequence; identical to SEQ ID NO: 3543
  derived and/or modified CDS sequence (AUadapt) from InfluenzaA__BAJ39961__HA

SEQ ID NO: 13954 - RNA, 1701 nt, Artificial Sequence
  derived and/or modified CDS sequence (AUadapt) from InfluenzaA__BAJ39962__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucgccgagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggugaccgccgccugcccgcacgcgggcgccaaguccuucuacaagaaccugaccuggcucgucaagaaggggaacucguaccccaagcuguccaagagcuacaucaacgacaagggcaaggaggugcuggugcucugggggauccaccaccccucgacguccgccgaccagcagucgcuguaccagaacgccgacgccuacgucuucgugggcaccucccgguacagcaagaaguucaagcccgagaucgcgauccgcccgaaggugcgggaccaggagggccgcaugaacuacuacuggacccuggucgagcccggggacaagaucaccuucgaggccacgggcaaccucguggugccccgguacgccuucgccauggagcgcaacgccggguccggcaucaucaucucggacacccccguccacgacugcaacacgaccugccagaccccgaagggcgcgaucaacaccucccugcccuuccagaacauccaccccaucaccaucgggaagugccccaaguacgucaagagcaccaagcugcggcucgccacgggccugcgcaacgugccguucauccagucccgggggcuguucggcgccaucgccggguucaucgagggcggcuggaccgggaugguggacggcugguacggguaccaccaccagaacgagcagggcucgggguacgccgcggaccucaaguccacccagaacgccaucgacgagaucaccaacaaggugaacagcgugaucgagaagaugaacacgcaguucaccgccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggucaagucgcagcugaagaacaacgccaaggagaucgggaacggcugcuucgaguucuaccacaagugcgacaacacgugcauggaguccgugaagaacgggaccuacgacuaccccaaguacagcaaggaggcgaagcugaaccgcgaggagaucgacggcgugaagcucgaguccacccggaucuaccagauccuggccaucuacucgaccguggccuccagccugguccucguggugucgcugggggccaucuccuucuggaugugcagcaacggcucccugcagugccgcaucugcaucuga

SEQ ID NO: 13955 - RNA, 1701 nt, Artificial Sequence; identical to SEQ ID NO: 116
  derived and/or modified CDS sequence (AUadapt) from InfluenzaA__BAJ39963__HA

SEQ ID NO: 13956 - RNA, 1701 nt, Artificial Sequence; identical to SEQ ID NO: 9517
  derived and/or modified CDS sequence (AUadapt) from InfluenzaA__BAJ39964__HA

SEQ ID NO: 13957 - RNA, 1701 nt, Artificial Sequence; identical to SEQ ID NO: 116
  derived and/or modified CDS sequence (AUadapt) from InfluenzaA__BAJ39965__HA

SEQ ID NO: 13958 - RNA, 1701 nt, Artificial Sequence; identical to SEQ ID NO: 116
  derived and/or modified CDS sequence (AUadapt) from InfluenzaA__BAJ39966__HA

SEQ ID NO: 13959 - RNA, 1701 nt, Artificial Sequence
  derived and/or modified CDS sequence (AUadapt) from InfluenzaA__BAJ39967__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagcugcucagcaccgcguccucgugguccuacaucguggagaccagcuccucggacaacggcacgugcuaccccggcgacuucaucgacuacgaggagcugcgggagcagcuguccagcguguccucguucgagcgcuucgagaucuuccccaagaccuccagcuggcccaaccacgacuccgacaagggggucaccgccgccugcccgcacgccggcgccaagucguucuacaagaaccucaucuggcuggugaagaaggggaacuccuaccccaagcugagcaaguccuacaucaacgacaagggcaaggaggugcucguccugugggggauccaccaccccucgaccagcgccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccucguggagcccggggacaagaucaccuucgaggcgaccggcaaccugguggucccccgguacgccuucgccauggagcgcaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaccaagcuccggcuggcgaccggccugcgcaacgucccgagcauccagucccggggccucuucggggccaucgccggguucaucgagggcggcuggacggggaugguggacggcugguacggguaccaccaccagaacgagcagggcucgggguacgccgccgaccugaaguccacccagaacgcgaucgacgagaucaccaacaaggugaacagcgucaucgagaagaugaacacccaguucacggcccugggcaaggaguucaaccaccucgagaagaagaucgagaaccugaacaagaagguggacgacggcuuccuggacaucuggaccuacaacgccgagcuccugguccugcucgagaacgagcgcacccuggacuaccacgacuccaacgugaagaaccuguacgagaaggugcggucgcagcucaagaacaacgccaaggagaucgggaacggcugcuucgaguucuaccacaagugcgacaacacgugcauggaguccgucaagaacgggaccuacgacuaccccaaguacagcgaggaggccaagcugaaccgcgaggagaucgacggcgugaagcuggaguccacccggaucuaccagauccucgcgaucuacucgaccguggccuccagccugguccugguggugucgcucggggccaucuccuucuggaugugcagcaacggcucccugcagugccgcaucugcaucuga

SEQ ID NO: 13960 - RNA, 1701 nt, Artificial Sequence; identical to SEQ ID NO: 8442
  derived and/or modified CDS sequence (AUadapt) from InfluenzaA__BAJ39968__HA

SEQ ID NO: 13961 - RNA, 1701 nt, Artificial Sequence; identical to SEQ ID NO: 9517
  derived and/or modified CDS sequence (AUadapt) from InfluenzaA__BAJ39969__HA

SEQ ID NO: 13962 - RNA, 1701 nt, Artificial Sequence; identical to SEQ ID NO: 116
  derived and/or modified CDS sequence (AUadapt) from InfluenzaA__BAJ39970__HA

SEQ ID NO: 13963 - RNA, 1701 nt, Artificial Sequence; identical to SEQ ID NO: 116
  derived and/or modified CDS sequence (AUadapt) from InfluenzaA__BAJ39971__HA

SEQ ID NO: 13964 - RNA, 1701 nt, Artificial Sequence; identical to SEQ ID NO: 3543
  derived and/or modified CDS sequence (AUadapt) from InfluenzaA__BAJ39972__HA

SEQ ID NO: 13965 - RNA, 1701 nt, Artificial Sequence
  derived and/or modified CDS sequence (AUadapt) from InfluenzaA__BAJ39973__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacacguacguguucgugggcaccucccgguacucgaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaaggucaagucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggccaucuacuccaccgucgcgucgagccuggugcucguggucucccugggggccaucucguucuggaugugcuccaacggcagccugcagugccgcaucugcaucuga

SEQ ID NO: 13966 - RNA, 1701 nt, Artificial Sequence; identical to SEQ ID NO: 116
  derived and/or modified CDS sequence (AUadapt) from InfluenzaA__BAJ39974__HA

SEQ ID NO: 13967 - RNA, 1701 nt, Artificial Sequence; identical to SEQ ID NO: 3483
  derived and/or modified CDS sequence (AUadapt) from InfluenzaA__BAJ39975__HA

SEQ ID NO: 13968 - RNA, 1701 nt, Artificial Sequence
  derived and/or modified CDS sequence (AUadapt) from InfluenzaA__BAJ39976__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgagaagcucugcaagcugcgcggggucgcgccccugcaccucggcaagugcaacaucgccggguggauccugggcaacccggagugcgagucgcuguccaccgccagcuccuggucguacaucguggagaccuccagcuccgacaacgggacgugcuaccccggcgacuucaucgacuacgaggagcuccgggagcagcugucguccgugagcuccuucgagcgcuucgagaucuuccccaagaccucguccuggcccaaccacgacagcaacaagggcgucaccgccgccugcccgcacgccggggcgaaguccuucuacaagaaccugaucuggcucgugaagaagggcaacucguaccccaagcuguccaagagcuacaucaacgacaaggggaaggaggugcugguccucuggggcauccaccaccccucgaccuccgccgaccagcagucgcuguaccagaacgccgacgccuacguguucguggggacgucccgguacagcaagaaguucaagcccgagaucgccauccgcccgaagguccgggaccaggagggccgcaugaacuacuacuggacccugguggagcccggcgacaagaucaccuucgaggcgaccgggaaccucguggucccccgguacgccuucgccauggagcgcaacgccggcuccgggaucaucaucucggacacgcccgugcacgacugcaacacgaccugccagaccccgaagggcgccaucaacaccucccugcccuuccagaacauccaccccaucaccaucggcaagugccccaaguacgucaagagcaccaagcugcggcucgcgaccgggcugcgcaacgugccguccauccagucgcggggccuguucggggccaucgccggcuucaucgagggcggguggacgggcaugguggacgggugguacggcuaccaccaccagaacgagcagggguccggcuacgccgccgaccucaagagcacccagaacgcgaucgacaagaucaccaacaaggugaacuccgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagucgacccgcaucuaccagauccuggcgaucuacuccaccgucgccagcucgcuggugcucguggucucccugggcgccaucaacuucuggaugugcagcaacgggucccugcagugccggaucugcaucuga

SEQ ID NO: 13969 - RNA, 1701 nt, Artificial Sequence; identical to SEQ ID NO: 116
  derived and/or modified CDS sequence (AUadapt) from InfluenzaA__BAJ39977__HA

SEQ ID NO: 13970 - RNA, 1701 nt, Artificial Sequence
  derived and/or modified CDS sequence (AUadapt) from InfluenzaA__BAJ39978__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccacagcaucaccaucgggaagugccccaaguacgugaaguccaccaagcugcggcucgcgaccggccugcgcaacguccccucgauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacucggucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaaggucaagagccagcugaagaacaacgccaaggagaucgggaacggcugcuucgaguucuaccacaagugcgacaacacgugcauggaguccgugaagaacgggaccuacgacuacccgaaguacucggaggaggccaagcugaaccgcgagaagaucgacggcgugaagcucgaguccacccggaucuaccagauccuggcgaucuacagcaccgucgccucgucccuggugcucguggucagccugggggccaucuccuucuggaugugcagcaacggcucccugcagugccgcaucugcaucuga

SEQ ID NO: 13971 - RNA, 1701 nt, Artificial Sequence
  derived and/or modified CDS sequence (AUadapt) from InfluenzaA__BAJ39979__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagcugcucagcaccgcguccucgugguccuacaucguggagaccagcuccucggacaacggcacgugcuaccccggcgacuucaucgacuacgaggagcugcgggagcagcuguccagcguguccucguucgagcgcuucgagaucuuccccaagaccuccagcuggcccaaccacgacuccgacaagggggucaccgccgccugcccgcacgccggcgccaagucguucuacaagaaccucaucuggcuggugaagaaggggaacuccuaccccaagcugagcaaguccuacaucaacgacaagggcaaggaggugcucguccugugggggauccaccaccccucgaccagcgccgaccagcagucccuguaccagaacgccgacgccuacguguucgugggcacgucgcgguacuccaagaaguucaagcccgagaucgccauccgcccgaagguccgggaccaggagggccgcauggacuacuacuggacccucguggagcccggggacaagaucaccuucgaggcgaccggcaaccugguggucccccgguacgccuucgccauggagcgcaacgccgggagcggcaucaucaucuccgacacgcccgugcacaacugcaacacgaccugccagaccccgaagggcgccaucaacaccucgcugcccuuccagaacauccaccccaucaccaucgggaagugccccaaguacgugaaguccaccaagcuccggcuggcgaccggccugcgcaacgucccgagcauccagucccggggccucuucggggccaucgccggguucaucgagggcggcuggacggggaugguggacggcugguacggguaccaccaccagaacgagcagggcucgggguacgccgccgaccugaaguccacccagaacgcgaucgacaagaucaccaacaaggugaacagcgucaucgagaagaugaacacccaguucacggccgugggcaaggaguucaaccaccuggagaaccgcaucgagaaccucaacaagaaggucgacgacggcuuccuggacaucuggaccuacaacgccgagcugcucgugcugcuggagaacgagcggacccucgacuaccacgacuccaacgugaagaaccuguacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcucaaccgggaggagaucgacggcgugaagcuggaguccacccgcaucuaccagauccuggcgaucuacucgaccgucgccuccagccucgugcugguggucucgcugggggccaucuccuucuggaugugcagcaacggcucccuccagugccggaucugcaucuga

SEQ ID NO: 13972 - RNA, 1701 nt, Artificial Sequence; identical to SEQ ID NO: 9517
  derived and/or modified CDS sequence (AUadapt) from InfluenzaA__BAJ39980__HA

SEQ ID NO: 13973 - RNA, 1701 nt, Artificial Sequence
  derived and/or modified CDS sequence (AUadapt) from InfluenzaA__BAJ39981__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugcagcaaguacgugaaguccaccaagcugcggcucgcgaccggccugcgcaacguccccucgauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacucggucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaaggucaagagccagcugaagaacaacgccaaggagaucgggaacggcugcuucgaguucuaccacaagugcgacaacacgugcauggaguccgugaagaacgggaccuacgacuacccgaaguacucgaaggaggccaagcugaaccgcgagaagaucgacggcgugaagcucgaguccacccggaucuaccagauccuggcgaucuacagcaccgucgccucgucccuggugcucguggucagccugggggccaucuccuucuggaugugcagcaacggcucccugcagugccgcaucugcaucuga

SEQ ID NO: 13974 - RNA, 1701 nt, Artificial Sequence
  derived and/or modified CDS sequence (AUadapt) from InfluenzaA__BAJ39982__HA
augaaggccauccuggugguccuccuguacaccuucgccaccgcgaacgccgccacgcugugcaucggcuaccacgccaacaacucgaccgacaccguggacacccuccuggagaagaacgugacggucacccacuccgugaaccugcucgaggacaagcacaacgggaagcugugcaagcugcgcggcguggcgccccuccaccuggggaagugcaacaucgccggcuggauccuggggaacccggagugcgagucgcucuccaccgccagcuccuggucguacaucgucgagaccuccagcuccgacaacggcacgugcuaccccggcgacuucaucgacuacgaggagcugcgggagcagcugucguccgugagcuccuucgagcgcuucgagaucuuccccaagaccucguccuggcccaaccacgacagcaacaagggggugaccgccgccugcccgcacgcgggcgccaaguccuucuacaagaaccucaucuggcuggucaagaaggggaacucguaccccaagcuguccaagagcuacaucaacgacaagggcaaggaggugcucgugcugugggggauccaccaccccucgaccuccgccgaccagcagagccuguaccagaacgccgacgccuacgucuucgugggcacgucccgguacucgaagaaguucaagcccgagaucgcgauccgcccgaaggugcgggaccaggagggccgcaugaacuacuacuggacccucgucgagcccggggacaagaucaccuucgaggccaccggcaaccugguggugccccgguacgccuucgccauggagcgcaacgccggguccggcaucaucaucagcgacacgcccguccacgacugcaacacgaccugccagaccccgaagggcgcgaucaacaccucccugcccuuccagaacauccaccccaucaccaucgggaagugccccaaguacgucaagucgaccaagcuccggcuggccaccggccugcgcaacgugccguccauccagagccgggggcuguucggcgccaucgccggguucaucgagggcggcuggacggggaugguggacggcugguacggguaccaccaccagaacgagcagggcuccggguacgccgcggaccucaagucgacccagaacgccaucgacgagaucaccaacaaggugaacuccgugaucgagaagaugaacacccaguucacggccgucggcaaggaguucaaccaccuggagaagcgcaucgagaaccucaacaagaagguggacgacggcuuccuggacaucuggaccuacaacgccgagcugcucguccugcuggagaacgagcggacccucgacuaccacgacagcaacgugaagaaccuguacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggcgaagcucaaccgggaggagaucgacggcgugaagcuggagagcacccgcaucuaccagauccuggccaucuacuccaccguggccucgagccucguccugguggugucccugggggccaucucguucuggaugugcuccaacggcagccuccagugccggaucugcaucuga

SEQ ID NO: 13975 - RNA, 1701 nt, Artificial Sequence; identical to SEQ ID NO: 13942
  derived and/or modified CDS sequence (AUadapt) from InfluenzaA__BAJ39983__HA

SEQ ID NO: 13976 - RNA, 1701 nt, Artificial Sequence
  derived and/or modified CDS sequence (AUadapt) from InfluenzaA__BAJ39984__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagcugcucagcaccgcguccucgugguccuacaucguggagaccagcuccucggacaacggcacgugcuaccccggcgacuucaucgacuacgaggagcugcgggagcagcuguccagcguguccucguucgagcgcuucgagaucuuccccaagaccuccagcuggcccaaccacgacuccaacaagggggucaccgccgccugcccgcacgccggcgccaagucguucuacaagaaccucaucuggcuggugaagaaggggaacuccuaccccaagcugagcaaguccuacaucaacgacaagggcaaggaggugcucguccugugggggauccaccaccccucgaccagcgccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccucguggagcccggggacaagaucaccuucgaggcgaccggcaaccugguggucccccgguacgccuucgccauggagcgcaacgccgggagcggcaucaucaucuccgacacgcccgugcacaacugcaacacgaccugccagaccccgaagggcgccaucaacaccucgcugcccuuccagaacauccaccccaucaccaucgggaagugccccaaguacgugaaguccaccaagcuccggcuggcgaccggccugcgcaacgucccgagcauccagucccggggccucuucggggccaucgccggguucaucgagggcggcuggacggggaugguggacggcugguacggguaccaccaccagaacgagcagggcucgggguacgccgccgaccugaaguccacccagaacgcgaucgacaagaucaccaacaaggugaacagcgucaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacuccaacgugaagaaccuguacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcucaaccgggaggagaucgacggcgugaagcuggaguccacccgcaucuaccagauccuggcgaucuacucgaccgucgccuccagccucgugcugguggucucgcugggggccaucuccuucuggaugugcagcaacggcucccuccagugccggaucugcaucuga

SEQ ID NO: 13977 - RNA, 1701 nt, Artificial Sequence; identical to SEQ ID NO: 116
  derived and/or modified CDS sequence (AUadapt) from InfluenzaA__BAJ39985__HA

SEQ ID NO: 13978 - RNA, 1701 nt, Artificial Sequence
  derived and/or modified CDS sequence (AUadapt) from InfluenzaA__BAJ39987__HA
augaagaccauccuggugguccuccuguacaccuucgccacggccaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccagcuccgacaacgggaccugcuaccccggcgacuucaucgacuacgaggagcuccgggagcagcugucguccgugagcuccuucgagcgcuucgagaucuuccccaagaccucguccuggcccaaccacgacagcaacaagggcgucaccgccgccugcccgcacgccggcgccaaguccuucuacaagaaccugaucuggcucgugaagaaggggaacucguaccccaagcuguccaagagcuacaucaacgacaagggcaaggaggugcugguccucugggggauccaccaccccucgacguccgcggaccagcagagccuguaccagaacgccgacaccuacguguucgugggcaccucccgguacucgaagaaguucaagcccgagaucgccauccgcccgaagguccgggaccaggagggccgcaugaacuacuacuggacccugguggagcccggggacaagaucacguucgaggccaccggcaaccucguggucccccgguacgccuucgcgauggagcgcaacgccggguccggcaucaucaucagcgacacccccgugcacgacugcaacaccacgugccagaccccgaagggcgccaucaacaccucccugcccuuccagaacauccaccccaucaccaucgggaagugccccaaguacgucaagucgacgaagcugcggcucgccaccggccugcgcaacgugccguccauccagagccgggggcuguucggcgccaucgcgggguucaucgagggcggcuggaccgggaugguggacggcugguacggguaccaccaccagaacgagcagggcuccggguacgccgccgaccucaagucgacccagaacgccaucgacgagaucacgaacaaggugaacuccgucaucgagaagaugaacacccaguucaccgccgugggcaaggaguucaaccaccuggagaagcgcaucgagaaccugaacaagaaggucgacgacggcuuccucgacaucuggaccuacaacgcggagcugcuggugcuccuggagaacgagcggacgcuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccaaggaggccaagcugaaccgggaggagaucgacggcgugaagcucgagagcacccgcaucuaccagauccuggccaucuacuccaccgucgccucgagccuggugcucguggucucccugggggcgaucucguucuggaugugcuccaacggcagccugcagugccggaucugcaucuga

SEQ ID NO: 13979 - RNA, 1701 nt, Artificial Sequence
  derived and/or modified CDS sequence (AUadapt) from InfluenzaA__BAJ39988__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgaucuaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccggguccggcaucaucaucucggacacgcccgugcacgacugcaacacgaccugccagaccccgaagggcgccaucaacaccucccuccccuuccagaacauccaccccaucaccaucgggaagugcagcaaguacgugaaguccaccaagcugcggcuggcgaccggccuccgcaacguccccucgauccagucccgggggcuguucggcgccaucgccggguucaucgagggcggcuggacggggaugguggacggcugguacggguaccaccaccagaacgagcagggcagcggguacgccgccgaccugaaguccacccagaacgcgaucgacgagaucaccaacaaggugaacucggucaucgagaagaugaacacccaguucacggccgugggcaaggaguucaaccaccucgagaagcgcaucgagaaccugaacaagaaggucgacgacggcuuccuggacaucuggaccuacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuacccgaaguacucggaggaggccaagcugaaccgggaggagaucgacggcgugaagcuggaguccacccgcaucuaccagauccucgcgaucuacagcaccgucgccucgucccuggugcugguggucagccucggggccaucuccuucuggaugugcagcaacggcucccugcagugccggaucugcaucuga

SEQ ID NO: 13980 - RNA, 1701 nt, Artificial Sequence; identical to SEQ ID NO: 4228
  derived and/or modified CDS sequence (AUadapt) from InfluenzaA__BAJ39989__HA

SEQ ID NO: 13981 - RNA, 1701 nt, Artificial Sequence; identical to SEQ ID NO: 116
  derived and/or modified CDS sequence (AUadapt) from InfluenzaA__BAJ39990__HA

SEQ ID NO: 13982 - RNA, 1701 nt, Artificial Sequence; identical to SEQ ID NO: 116
  derived and/or modified CDS sequence (AUadapt) from InfluenzaA__BAJ39993__HA

SEQ ID NO: 13983 - RNA, 1701 nt, Artificial Sequence
  derived and/or modified CDS sequence (AUadapt) from InfluenzaA__BAJ39994__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacacguacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucucggacacccccgugcacgacugcaacacgaccugccagaccccgaagggcgccaucaacaccucccugcccuuccagaacauccaccccaccaccaucgggaagugccccaaguacgucaagagcacgaagcugcggcucgccaccggccugcgcaacgugccguccauccagucgcgggggcuguucggcgcgaucgccggguucaucgagggcggcuggaccgggaugguggacggcugguacggguaccaccaccagaacgagcagggcuccggguacgccgccgaccucaagucgacccagaacgccaucgacgagaucacgaacaaggugaacuccgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacagcaacgugaagaaccucuacgagaaggucaagucccagcugaagaacaacgccaaggagaucgggaacggcugcuucgaguucuaccacaagugcgacaacacgugccuggagucggugaagaacgggaccuacgacuaccccaaguacuccgaggaggccaagcucaaccgcgagaagaucgacggcgugaagcuggagagcacccggaucuaccagauccuggccaucuacuccaccgucgcgucgagccucgugcugguggucucccugggggccaucucguucuggaugugcuccaacggcagccuccagugccgcaucugcaucuga

SEQ ID NO: 13984 - RNA, 1701 nt, Artificial Sequence; identical to SEQ ID NO: 116
  derived and/or modified CDS sequence (AUadapt) from InfluenzaA__BAJ39996__HA

SEQ ID NO: 13985 - RNA, 1701 nt, Artificial Sequence
  derived and/or modified CDS sequence (AUadapt) from InfluenzaA__BAJ39997__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacacguacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucucggacacccccgugcacgacugcaacacgaccugccagaccccgaagggcgccaucaacaccucccugcccuuccagaacauccaccccaccaccaucgggaagugccccaaguacgucaagagcacgaagcugcggcucgccaccggccugcgcaacgugccguccauccagucgcgggggcuguucggcgcgaucgccggguucaucgagggcggcuggaccgggaugguggacggcugguacggguaccaccaccagaacgagcagggcuccggguacgccgccgaccucaagucgacccagaacgccaucgacgagaucacgaacaaggugaacuccgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgcgucgagccuggugcucguggucucccugggggccaucucguucuggaugugcuccaacggcagccugcagugccggaucugcaucuga

SEQ ID NO: 13986 - RNA, 1701 nt, Artificial Sequence; identical to SEQ ID NO: 116
  derived and/or modified CDS sequence (AUadapt) from InfluenzaA__BAJ39998__HA

SEQ ID NO: 13987 - RNA, 1701 nt, Artificial Sequence
  derived and/or modified CDS sequence (AUadapt) from InfluenzaA__BAJ39999__HA
augaaggccauccuggugguccuccuguacaccuucgccaccgcgaacgccgacacgcugugcaucggcuaccacgccaacaacucgaccgacaccguggacaccgugcucgagcgcaacgucacggugacccacuccgugaaccugcuggaggacaagcacaacgggaagcucugcaagcugcggggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgcgagcagcugucguccgugagcuccuucgagcgguucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacacguacguguucgugggcaccucccgcuacucgaagaaguucaagcccgagaucgccauccggccgaagguccgcgaccaggagggccggaugaacuacuacuggacccugguggagcccggggacaagaucaccuucgaggccacgggcaaccucguggucccccgcuacgcguucgccauggagcggaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcgccucgccacgggccugcggaacgugccguccauccagagccgcgggcuguucggcgcgaucgccggguucaucgagggcggcuggaccgggaugguggacggcugguacggguaccaccaccagaacgagcagggcuccggguacgccgccgaccucaagucgacccagaacgccaucgacgagaucaccaacaaggugaacuccgucaucgagaagaugaacacgcaguucaccgcggugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggccaucuacuccaccgucgcgucgagccuggugcucguggucucccugggggccaucucguucuggaugugcuccaacggcagccugcagugccgcaucugcaucuga

SEQ ID NO: 13988 - RNA, 1701 nt, Artificial Sequence
  derived and/or modified CDS sequence (AUadapt) from InfluenzaA__BAJ40000__HA
augaagaccauccuggugguccuccuguacaccuucgccacggccaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccagcuccgacaacgggaccugcuaccccggcgacuucaucgacuacgaggagcuccgggagcagcugucguccgugagcuccuucgagcgcuucgagaucuuccccaagaccucguccuggcccaaccacgacagcaacaagggcgucaccgccgccugcccgcacgccggcgccaaguccuucuacaagaaccugaucuggcucgugaagaaggggaacucguaccccaagcuguccaagagcuacaucaacgacaagggcaaggaggugcugguccucugggggauccaccaccccucgacguccgcggaccagcagagccuguaccagaacgccgacaccuacguguucgugggcaccucccgguacucgaagaaguucaagcccgagaucgccauccgcccgaagguccgggaccaggagggccgcaugaacuacuacuggacccugguggagcccggggacaagaucacguucgaggccaccggcaaccucguggucccccgguacgccuucgcgauggagcgcaacgccggguccggcaucaucaucagcgacacccccgugcacgacugcaacaccacgugccagaccccgaagggcgccaucaacaccucccugcccuuccagaacauccaccccaucaccaucgggaagugccccaaguacgucaagucgacgaagcugcggcucgccaccggccugcgcaacgugccguccauccagagccgggggcuguucggcgccaucgcgggguucaucgagggcggcuggaccgggaugguggacggcugguacggguaccaccaccagaacgagcagggcuccggguacgccgccgaccucaagucgacccagaacgccaucgacgagaucacgaacaaggugaacuccgucaucgagaagaugaacacccaguucaccgccgugggcaaggaguucaaccaccuggagaagcgcaucgagaaccugaacaagaaggucgacgacggcuuccucgacaucuggaccuacaacgcggagcugcuggugcuccuggagaacgagcggacgcuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgccucgagccuggugcucguggucucccugggggcgaucucguucuggaugugcuccaacggcagccugcagugccggaucugcaucuga

SEQ ID NO: 13989 - RNA, 1701 nt, Artificial Sequence; identical to SEQ ID NO: 7924
  derived and/or modified CDS sequence (AUadapt) from InfluenzaA__BAJ40001__HA

SEQ ID NO: 13990 - RNA, 1701 nt, Artificial Sequence; identical to SEQ ID NO: 116
  derived and/or modified CDS sequence (AUadapt) from InfluenzaA__BAJ40002__HA

SEQ ID NO: 13991 - RNA, 1701 nt, Artificial Sequence; identical to SEQ ID NO: 7924
  derived and/or modified CDS sequence (AUadapt) from InfluenzaA__BAJ40003__HA

SEQ ID NO: 13992 - RNA, 1701 nt, Artificial Sequence
  derived and/or modified CDS sequence (AUadapt) from InfluenzaA__BAJ40004__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggagaccgccgccugcccgcacgccggcgcgaaguccuucuacaagaaccugaucuggcucgucaagaaggggaacagcuaccccaagcuguccaagucguacaucaacgacaagggcaaggaggugcuggugcucugggggauccaccaccccagcaccuccgccgaccagcagucgcuguaccagaacgccgacgccuacgucuucgugggcacgucccgguacagcaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucucggacacgcccguccacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugaagucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgcgagaagaucgacggcgugaagcucgagagcacccggaucuaccagauccuggcgaucuacuccaccguggccucgagccugguccucguggugucccugggggccaucucguucuggaugugcuccaacggcagccugcagugccgcaucugcaucuga

SEQ ID NO: 13993 - RNA, 1701 nt, Artificial Sequence
  derived and/or modified CDS sequence (AUadapt) from InfluenzaA__BAJ40006__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggccgggaggugcugguccucugggggauccaccaccccucgaccuccgccgaccagcagagccuguaccagaacgccgacacguacguguucgugggcaccucccgcuacucgaagaaguucaagcccgagaucgccauccggccgaagguccgcgaccaggagggccggaugaacuacuacuggacccugguggagcccggggacaagaucaccuucgaggccacgggcaaccucguggucccccgcuacgcguucgccauggagcggaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcgccucgccacgggccugcggaacgugccguccauccagagccgcgggcuguucggcgcgaucgccggguucaucgagggcggcuggaccgggaugguggacggcugguacggguaccaccaccagaacgagcagggcuccggguacgccgccgaccucaagucgacccagaacgccaucgacgagaucaccaacaaggugaacuccgucaucgagaagaugaacacgcaguucaccgcggugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggccaucuacuccaccgucgcgucgagccuggugcucguggucucccugggggccaucucguucuggaugugcuccaacggcagccugcagugccgcaucugcaucuga

SEQ ID NO: 13994 - RNA, 1701 nt, Artificial Sequence; identical to SEQ ID NO: 116
  derived and/or modified CDS sequence (AUadapt) from InfluenzaA__BAJ40007__HA

SEQ ID NO: 13995 - RNA, 1701 nt, Artificial Sequence
  derived and/or modified CDS sequence (AUadapt) from InfluenzaA__BAJ40008__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaucgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggcgaucuacuccaccgucgccagcucgcuggugcucguggucucccugggggccaucagcuucuggaugugcuccaacggcagccugcagugccggaucugcaucuga

SEQ ID NO: 13996 - RNA, 1701 nt, Artificial Sequence
  derived and/or modified CDS sequence (AUadapt) from InfluenzaA__BAJ40009__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcgacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcauggacuacuacuggacccugguggagcccggggacaagaucaccuucgaggcgaccggcaaccucguggucccccgguacgccuucgccauggagcgcaacgccggguccggcaucaucaucagcgacacgcccgugcacaacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaaccgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 13997 - RNA, 1701 nt, Artificial Sequence
  derived and/or modified CDS sequence (AUadapt) from InfluenzaA__BAJ40010__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagcugcucagcaccgcguccucgugguccuacaucguggagaccagcuccucggacaacggcacgugcuaccccggcgacuucaucgacuacgaggagcugcgggagcagcuguccagcguguccucguucgagcgcuucgagaucuuccccaagaccuccagcuggcccaaccacgacuccgacaagggggucaccgccgccugcccgcacgccggcgccaagucguucuacaagaaccucaucuggcuggugaagaaggggaacuccuaccccaagcugagcaaguccuacaucaacgacaagggcaaggaggugcucguccugugggggauccaccaccccucgaccagcgccgaccagcagucccuguaccagaacgccgacgccuacguguucgugggcacgucgcgguacuccaagaaguucaagcccgagaucgccauccgcccgaagguccgggaccaggagggccgcauggacuacuacuggacccucguggagcccggggacaagaucaccuucgaggcgaccggcaaccugguggucccccgguacgccuucgccauggagcgcaacgccgggagcggcaucaucaucuccgacacgcccgugcacaacugcaacacgaccugccagaccccgaagggcgccaucaacaccucgcugcccuuccagaacauccaccccaucaccaucgggaagugccccaaguacgugaaguccaccaagcuccggcuggcgaccggccugcgcaacgucccgagcauccagucccggggccucuucggggccaucgccggguucaucgagggcggcuggacggggaugguggacggcugguacggguaccaccaccagaacgagcagggcucgggguacgccgccgaccugaaguccacccagaacgcgaucgacaagaucaccaacaaggugaacagcgucaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacuccaacgugaagaaccuguacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcucaaccgggaggagaucgacggcgugaagcuggaguccacccgcaucuaccagauccuggcgaucuacucgaccgucgccuccagccucgugcugguggucucgcugggggccaucuccuucuggaugugcagcaacggcucccuccagugccggaucugcaucuga

SEQ ID NO: 13998 - RNA, 1701 nt, Artificial Sequence; identical to SEQ ID NO: 13987
  derived and/or modified CDS sequence (AUadapt) from InfluenzaA__BAJ40011__HA

SEQ ID NO: 13999 - RNA, 1701 nt, Artificial Sequence
  derived and/or modified CDS sequence (AUadapt) from InfluenzaA__BAJ40012__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcaucaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 14000 - RNA, 1701 nt, Artificial Sequence; identical to SEQ ID NO: 13987
  derived and/or modified CDS sequence (AUadapt) from InfluenzaA__BAJ40013__HA

SEQ ID NO: 14001 - RNA, 1701 nt, Artificial Sequence; identical to SEQ ID NO: 13987
  derived and/or modified CDS sequence (AUadapt) from InfluenzaA__BAJ40014__HA

SEQ ID NO: 14002 - RNA, 1701 nt, Artificial Sequence
  derived and/or modified CDS sequence (AUadapt) from InfluenzaA__BAJ40015__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaacaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacacguacguguucgugggcaccucccgguacucgaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgcgucgagccuggugcucguggucucccugggggccaucucguucuggaugugcuccaacggcagccugcagugccggaucugcaucuga

SEQ ID NO: 14003 - RNA, 1701 nt, Artificial Sequence; identical to SEQ ID NO: 13987
  derived and/or modified CDS sequence (AUadapt) from InfluenzaA__BAJ40016__HA

SEQ ID NO: 14004 - RNA, 1701 nt, Artificial Sequence
  derived and/or modified CDS sequence (AUadapt) from InfluenzaA__BAJ40017__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccaacagcgacaacggcacgugcuaccccggcgacuucaucgacuacgaggagcuccgggagcagcuguccucgguguccagcuucgagcgcuucgagaucuuccccaagaccuccucguggcccaaccacgacuccaacaagggggucaccgccgccugcccgcacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcucgggguacgccgccgaccucaaguccacccagaaggcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 14005 - RNA, 1701 nt, Artificial Sequence; identical to SEQ ID NO: 4078
  derived and/or modified CDS sequence (AUadapt) from InfluenzaA__BAJ40018__HA

SEQ ID NO: 14006 - RNA, 1701 nt, Artificial Sequence; identical to SEQ ID NO: 13993
  derived and/or modified CDS sequence (AUadapt) from InfluenzaA__BAJ40019__HA

SEQ ID NO: 14007 - RNA, 1701 nt, Artificial Sequence; identical to SEQ ID NO: 13993
  derived and/or modified CDS sequence (AUadapt) from InfluenzaA__BAJ40020__HA

SEQ ID NO: 14008 - RNA, 1701 nt, Artificial Sequence
  derived and/or modified CDS sequence (AUadapt) from InfluenzaA__BAJ40021__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggagaccgccgccugcccgcacgccggcgcgaaguccuucuacaagaaccugaucuggcucgucaagaaggggaacagcuaccccaagcuguccaagucguacaucaacgacaagggcaaggaggugcuggugcucugggggauccaccaccccagcaccuccgccgaccagcagucgcuguaccagaacgccgacgccuacgucuucgugggcacgucccgguacagcaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucucggacacgcccguccacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 14009 - RNA, 1701 nt, Artificial Sequence; identical to SEQ ID NO: 4078
  derived and/or modified CDS sequence (AUadapt) from InfluenzaA__BAJ40023__HA

SEQ ID NO: 14010 - RNA, 1701 nt, Artificial Sequence
  derived and/or modified CDS sequence (AUadapt) from InfluenzaA__BAJ40024__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacacguacguguucgugggcaccucccgguacucgaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggagaagaucgacggcgugaagcucgagagcacccgcaucuaccagauccuggccaucuacuccaccgucgcgucgagccuggugcucguggucucccugggggccaucucguucuggaugugcuccaacggcagccugcagugccggaucugcaucuga

SEQ ID NO: 14011 - RNA, 1701 nt, Artificial Sequence; identical to SEQ ID NO: 13987
  derived and/or modified CDS sequence (AUadapt) from InfluenzaA__BAJ40025__HA

SEQ ID NO: 14012 - RNA, 1701 nt, Artificial Sequence; identical to SEQ ID NO: 4078
  derived and/or modified CDS sequence (AUadapt) from InfluenzaA__BAJ40026__HA

SEQ ID NO: 14013 - RNA, 1701 nt, Artificial Sequence
  derived and/or modified CDS sequence (AUadapt) from InfluenzaA__BAJ40027__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggagaccgccgccugcccgcacgccggcgcgaaguccuucuacaagaaccugaucuggcucgucaagaaggggaacagcuaccccaagcuguccaagucguacaucaacgacaagggcaaggaggugcuggugcucugggggauccaccaccccagcaccuccgccgaccagcagucgcuguaccagaacgccgacgccuacgucuucgugggcacgucccgguacagcaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucucggacacgcccguccacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagucgcgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugaagucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgcgaggagaucgacggcgugaagcucgagagcacccggaucuaccagauccuggcgaucuacuccaccguggccucgagccugguccucguggugucccugggggccaucucguucuggaugugcuccaacggcagccugcagugccgcaucugcaucuga

SEQ ID NO: 14014 - RNA, 1701 nt, Artificial Sequence
  derived and/or modified CDS sequence (AUadapt) from InfluenzaA__BAJ40028__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccgccuucaucgagggcggguggacgggcaugguggacgggugguacggcuaccaccaccagaacgagcagggguccggcuacgccgcggaccucaagucgacccagaacgccaucgacaagaucaccaacaaggugaacuccgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggcgaagcugaaccgggaggagaucgacggggugaagcucgagagcacccgcaucuaccagauccuggccaucuacuccaccgucgccucgagccuggugcucguggucucccugggcgccaucucguucuggaugugcuccaacgggagccugcagugccggaucugcaucuga

SEQ ID NO: 14015 - RNA, 1701 nt, Artificial Sequence; identical to SEQ ID NO: 13987
  derived and/or modified CDS sequence (AUadapt) from InfluenzaA__BAJ40029__HA

SEQ ID NO: 14016 - RNA, 1701 nt, Artificial Sequence
  derived and/or modified CDS sequence (AUadapt) from InfluenzaA__BAJ40030__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcucaaggagcagcugucguccgugagcuccuucgagcgguucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggccgcgaggugcugguccucugggggauccaccaccccucgaccuccgccgaccagcagagccuguaccagaacgccgacacguacguguucgugggcaccucccgguacucgaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgcgucgagccuggugcucguggucucccugggggccaucucguucuggaugugcuccaacggcagccugcagugccggaucugcaucuga

SEQ ID NO: 14017 - RNA, 1701 nt, Artificial Sequence; identical to SEQ ID NO: 116
  derived and/or modified CDS sequence (AUadapt) from InfluenzaA__BAJ40031__HA

SEQ ID NO: 14018 - RNA, 1701 nt, Artificial Sequence; identical to SEQ ID NO: 13987
  derived and/or modified CDS sequence (AUadapt) from InfluenzaA__BAJ40032__HA

SEQ ID NO: 14019 - RNA, 1701 nt, Artificial Sequence; identical to SEQ ID NO: 14016
  derived and/or modified CDS sequence (AUadapt) from InfluenzaA__BAJ40033__HA

SEQ ID NO: 14020 - RNA, 1701 nt, Artificial Sequence
  derived and/or modified CDS sequence (AUadapt) from InfluenzaA__BAJ40034__HA
augaaggccauccuggugguccuccuguacaccuucgccaccgcgaacgccgacacgcugugcaucggcuaccacgccaacaacucgaccgacaccguggacaccgugcucgagcgcaacgucacggugacccacuccgugaaccugcuggaggacaagcacaacgggaagcucugcaagcugcggggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgcgagcagcugucguccgugagcuccuucgagcgguucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacacguacguguucgugggcaccucccgcuacucgaagaaguucaagcccgagaucgccauccggccgaagguccgcgaccaggagggccggaugaacuacuacuggacccugguggagcccggggacaagaucaccuucgaggccacgggcaaccucguggucccccgcuacgcguucgccauggagcggaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcgccucgccacgggccugcggaacgugccguccauccagagccgcgggcuguucggcgcgaucgccggguucaucgagggcggcuggaccgggaugguggacggcugguacggguaccaccaccagaacgagcagggcuccggguacgccgccgaccucaagucgacccagaacgccaucgacgagaucaccaacaaggugaacuccgucaucgagaagaugaacacgcaguucaccgcggugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgagaagaucgacggcgugaagcucgagagcacccggaucuaccagauccuggccaucuacuccaccgucgcgucgagccuggugcucguggucucccugggggccaucucguucuggaugugcuccaacggcagccugcagugccgcaucugcaucuga

SEQ ID NO: 14021 - RNA, 1701 nt, Artificial Sequence
  derived and/or modified CDS sequence (AUadapt) from InfluenzaA__BAJ40035__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagucgcuguaccagaacgccgacacguacguguucgugggcaccucccgguacagcaagaaguucaagcccgagaucgccauccgcccgaagguccgggaccaggagggccgcaugaacuacuacuggacccugguggagcccggggacaagaucaaguucgaggccaccggcaaccucguggucccccgguacgcguucgccauggagcgcaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcugcggcucgccaccggccugcgcaacgugccguccauccagucgcgggggcuguucggcgcgaucgccggguucaucgagggcggcuggacggggaugguggacggcugguacggguaccaccaccagaacgagcagggcuccggguacgccgccgaccucaagagcacccagaacgccaucgacgagaucaccaacaaggugaacuccgucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacucgaccgucgcguccagccuggugcucguggucucgcugggggccaucuccuucuggaugugcagcaacggcucccugcagugccggaucugcaucuga

SEQ ID NO: 14022 - RNA, 1701 nt, Artificial Sequence
  derived and/or modified CDS sequence (AUadapt) from InfluenzaA__BAJ40036__HA
augaaggccauccuggugguccucaucuacaccuucgccaccgcgaacgccgacacgcugugcaucggcuaccacgccaacaacucgaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccagcuccgacaacggcacgugcuaccccggcgacuucaucgacuacgaggagcugcgggagcagcucucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcuggugaagaaggggaacucguaccccaagcucuccaagagcuacaucaacgacaagggcaaggaggugcugguccugugggggauccaccaccccucgaccuccgccgaccagcagagccucuaccagaacgccgacgccuacguguucgugggcacgucccgguacucgaagaaguucaagcccgagaucgccauccgcccgaagguccgggaccaggagggccgcaugaacuacuacuggaccaucguggagcccggggacaagaucaccuucgaggcgaccggcaaccugguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcuccggcuggcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacagcaacgugaagaaccuguacgagaaggucaagucccagcugaagaacaacgccaaggagaucgggaacggcugcuucgaguucuaccacaagugcgacaacacgugcauggagucggugaagaacgggaccuacgacuaccccaaguacuccgaggaggccaagcucaaccgcgaggagaucgacggcgugaagcuggagagcacccggaucuaccagauccuggcgaucuacuccaccgucgccucgagccucgugcugguggucucccugggggccaucucguucuggaugugcuccaacggcagccuccagugccgcaucugcaucuga

SEQ ID NO: 14023 - RNA, 1701 nt, Artificial Sequence; identical to SEQ ID NO: 9517
  derived and/or modified CDS sequence (AUadapt) from InfluenzaA__BAJ40037__HA

SEQ ID NO: 14024 - RNA, 1701 nt, Artificial Sequence
  derived and/or modified CDS sequence (AUadapt) from InfluenzaA__BAJ40038__HA
augaaggccauccugcucgugcugcuguacaccuucgccaccgcgaacgccgacacgcucugcaucggcuaccacgccaacaacucgaccgacaccgucgacaccgugcuggagaagaacgugacggucacccacuccgugaaccugcucgaggacaagcacaacgggaagcugugcaagcugcgcggcguggcgccccuccaccuggggaagugcaacaucgccggcuggauccuggggaacccggagugcgagucgcucuccaccgccagcuccuggucguacaucgucgagaccuccagcuccgacaacggcacgugcuaccccggcgacuucaucgacuacgaggagcugcgggagcagcugucguccgugagcuccuucgagcgcuucgagaucuuccccaagaccucguccuggcccaaccacgacagcaacaagggggugaccgccgccugcccgcacgccggcgcgaaguccuucuacaagaaccucaucuggcuggucaagaaggggaacucguaccccaagcuguccaagagcuacaucaacgacaagggcaaggaggugcucgugcugugggggauccaccaccccucgaccuccgccgaccagcagagccuguaccagaacgccgacacguacgucuucgugggcaccucccgguacucgaagaaguucaagcccgagaucgccauccgcccgaaggugcgggaccaggagggccgcaugaacuacuacuggaccaucgucgagcccggggacaagaucaccuucgaggccacgggcaaccucguggugccccgguacgcguucgccauggagcgcaacgccggguccggcaucaucaucagcgacacccccguccacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacgagaucaccaacaaggugaacuccgugaucgagaagaugaacacgcaguucaccgcggucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggccaucuacuccaccguggcgucgagccugguccucguggugucccugggggccaucucguucuggaugugcuccaacggcagccugcagugccggaucugcaucuga

SEQ ID NO: 14025 - RNA, 1701 nt, Artificial Sequence; identical to SEQ ID NO: 116
  derived and/or modified CDS sequence (AUadapt) from InfluenzaA__BAJ40039__HA

SEQ ID NO: 14026 - RNA, 1701 nt, Artificial Sequence
  derived and/or modified CDS sequence (AUadapt) from InfluenzaA__BAJ40040__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggccgggaggugcugguccucugggggauccaccaccccagcaccuccgccgaccagcagucgcuguaccagaacgccgacacguacguguucgugggcaccucccgcuacagcaagaaguucaagcccgagaucgccauccggccgaagguccgcgaccaggagggccggaugaacuacuacuggacccugguggagcccggggacaagaucaccuucgaggccacgggcaaccucguggucccccgcuacgcguucgccauggagcggaacgccggguacggcaucaucaucuccgacacccccgugcacgacugcaacacgaccugccagaccccgaagggcgccaucaacaccucgcugcccuuccagaacauccaccccaucaccaucgggaagugccccaaguacgugaaguccaccaagcugcgccucgccacgggccugcggaacgucccgagcauccagucccgcgggcuguucggcgcgaucgccggguucaucgagggcggcuggaccgggaugguggacggcugguacggguaccaccaccagaacgagcagggcucgggguacgccgccgaccucaaguccacccagaacgccaucgacgagaucaccaacaaggugaacagcgucaucgagaagaugaacacgcaguucaccgcggugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggccaucuacucgaccgucgcguccagccuggugcucguggucucgcugggggccaucuccuucuggaugugcagcaacggcucccugcagugccgcaucugcaucuga

SEQ ID NO: 14027 - RNA, 1701 nt, Artificial Sequence; identical to SEQ ID NO: 9517
  derived and/or modified CDS sequence (AUadapt) from InfluenzaA__BAJ40041__HA

SEQ ID NO: 14028 - RNA, 1701 nt, Artificial Sequence
  derived and/or modified CDS sequence (AUadapt) from InfluenzaA__BAJ40042__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcucaaggagccccugucguccgugagcuccuucgagcgguucgagaucuuccccaagaccucguccuggccgaaccacgacagcaacaagggggucaccgccgccugcccccacgccggcgcgaaguccuucuacaagaaccugaucuggcucgugaagaaggggaacucguaccccaagcuguccaagagcuacaucaacgacaagggccgcgaggugcugguccucugggggauccaccaccccucgaccuccgccgaccggcagagccuguaccagaacgccgacacguacguguucgugggcaccucccgcuacucgaagaaguucaagccggagaucgccauccggcccaagguccgcgaccaggagggccggaugaacuacuacuggacccugguggagcccggggacaagaucaccuucgaggccacgggcaaccucguggucccccgcuacgcguucgccauggagcggaacgccggguccggcaucaucaucagcgacaccccggugcacgacugcaacacgaccugccagacccccaagggcgccaucaacaccucccugcccuuccagaacauccaccccaucaccaucgggaagugcccgaaguacgucaagucgaccaagcugcgccucgccacgggccugcggaacgugcccuccauccagagccgcgggcuguucggcgcgaucgccggguucaucgagggcggcuggaccgggaugguggacggcugguacggguaccaccaccagaacgagcagggcuccggguacgccgccgaccucaagucgacccagaacgccaucgacgagaucaccaacaaggugaacuccgucaucgagaagaugaacacgcaguucaccgcggugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggccaucuacuccaccgucgcgucgagccuggugcucguggucucccugggggccaucucguucuggaugugcuccaacggcagccugcagugccgcaucugcaucuga

SEQ ID NO: 14029 - RNA, 1701 nt, Artificial Sequence; identical to SEQ ID NO: 9517
  derived and/or modified CDS sequence (AUadapt) from InfluenzaA__BAJ40043__HA

SEQ ID NO: 14030 - RNA, 1701 nt, Artificial Sequence
  derived and/or modified CDS sequence (AUadapt) from InfluenzaA__BAJ40044__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcagaaggagcagcucucguccgugagcuccuucgagcgguucgagaucuuccccaagaccucguccuggcccaaccacgacagcaacaagggggucaccgccgccugcccgcacgccggcgcgaaguccuucuacaagaaccugaucuggcuggugaagaaggggaacucguaccccaagcucuccaagagcuacaucaacgacaagggcaaggaggugcugguccugugggggauccaccaccccucgaccuccgccgaccagcagagccucuaccagaacgccgacgccuacguguucgugggcacgucccgcuacucgaagaaguucaagcccgagaucgccauccggccgaagguccgcgaccaggagggccggaugaacuacuacuggacccugguggagcccggggacaagaucaccuucgaggcgaccggcaaccugguggucccccgcuacgccuucgccauggagaucaacgccggguccggcaucaucaucagcgacacgcccgugcacgacugcaacacgaccugccagaccccgaagggcgccaucaacaccucccuccccuuccagaacauccaccccaucaccaucgggaagugccccaaguacgucaagucgaccaagcugcggcuggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcuggagagcacccgcaucuaccagauccucgcgaucuacuccaccgucgccucgagccuggugcugguggucucccucggggccaucucguucuggaugugcuccaacggcagccugcagugccggaucugcaucuga

SEQ ID NO: 14031 - RNA, 1701 nt, Artificial Sequence; identical to SEQ ID NO: 13993
  derived and/or modified CDS sequence (AUadapt) from InfluenzaA__BAJ40045__HA

SEQ ID NO: 14032 - RNA, 1701 nt, Artificial Sequence
  derived and/or modified CDS sequence (AUadapt) from InfluenzaA__BAJ40046__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggcggugcaacaucgccggcuggauccuggggaacccggagugcgagagccuguccaccgcgucguccuggagcuacaucguggagaccuccaucucggacaacggcacgugcuaccccggcgacuucaucgacuacgaggagcucaaggagcagcuguccagcguguccucguucgagcgcuucgagaucuuccccaagaccuccagcuggcccaaccacgacuccaacaagggggucaccgccgccugcccgcacgccggcgccaagucguucuacaagaaccugaucuggcucgugaagaaggggaacuccuaccccaagcugagcaaguccuacaucaacgacaagggcaaggaggugcugguccucugggggauccaccaccccucgaccagcgccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacaagaucaccaacaaggugaacagcgucaucgagaagaugaacacccaguucacggccgugggcaaggaguucaaccaccuggagaagaagaucgagaaccugaacaagaaggucgacgacggcuuccucgacaucuggaccuacaacgccaagcugcuggugcuccuggagaacgagcgcacccuggacuaccacgacuccaacgugaagaaccucuacgagaagguccggucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggcgaucuacucgaccgucgccuccagccuggugcucguggucucgcugggggccaucuccuucuggaugugcagcaacggcucccugcagugccgcaucugcaucuga

SEQ ID NO: 14033 - RNA, 1701 nt, Artificial Sequence; identical to SEQ ID NO: 14016
  derived and/or modified CDS sequence (AUadapt) from InfluenzaA__BAJ40047__HA

SEQ ID NO: 14034 - RNA, 1701 nt, Artificial Sequence; identical to SEQ ID NO: 13987
  derived and/or modified CDS sequence (AUadapt) from InfluenzaA__BAJ40048__HA

SEQ ID NO: 14035 - RNA, 1701 nt, Artificial Sequence
  derived and/or modified CDS sequence (AUadapt) from InfluenzaA__BAJ40050__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcucaaggagcagcugucguccgugagcuccuucgagcgguucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgcuacucgaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 14036 - RNA, 1701 nt, Artificial Sequence; identical to SEQ ID NO: 4078
  derived and/or modified CDS sequence (AUadapt) from InfluenzaA__BAJ40051__HA

SEQ ID NO: 14037 - RNA, 1701 nt, Artificial Sequence
  derived and/or modified CDS sequence (AUadapt) from InfluenzaA__BAJ40052__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggccgggaggugcugguccucugggggauccaccaccccucgaccacggccgaccagcagucccuguaccagaacgccgacaccuacguguucgugggcaccucgcgcuacuccaagaaguucaagcccgagaucgccauccggccgaagguccgcgaccaggagggccggaugaacuacuacuggacccugguggagcccggggacaagaucacguucgaggccaccggcaaccucguggucccccgcuacgcguucgccauggagcggaacgccgggagcggcaucaucaucuccgacacccccgugcacgacugcaacaccacgugccagaccccgaagggcgccaucaacaccucgcugcccuuccagaacauccaccccaucaccaucgggaagugccccaaguacgugaaguccacgaagcugcgccucgccaccggccugcggaacgucccgagcauccagucccgcgggcuguucggcgcgaucgccggguucaucgagggcggcuggaccgggaugguggacggcugguacggguaccaccaccagaacgagcagggcucgggguacgccgccgaccucaaguccacccagaacgccaucgacgagaucacgaacaaggugaacagcgucaucgagaagaugaacacccaguucaccgcggugggcaaggaguucaaccaccuggagaagcggaucgagaaccugaacaagaaggucgacgacggcuuccucgacaucuggaccuacaacgccgagcugcuggugcuccuggagaacgagcgcacgcuggacuaccacgacuccaacgugaagaaccucuacgagaagguccggucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggccaucuacucgaccgucgcguccagccuggugcucguggucucgcugggggccaucuccuucuggaugugcagcaacggcucccugcagugccgcaucugcaucuga

SEQ ID NO: 14038 - RNA, 1701 nt, Artificial Sequence
  derived and/or modified CDS sequence (AUadapt) from InfluenzaA__BAJ40053__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagucgcuguaccagaacgccgacacguacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucucggacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagucgcgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacucgaccgucgcguccagccuggugcucguggucucgcugggggccaucuccuucuggaugugcagcaacggcucccugcagugccggaucugcaucuga

SEQ ID NO: 14039 - RNA, 1701 nt, Artificial Sequence; identical to SEQ ID NO: 4078
  derived and/or modified CDS sequence (AUadapt) from InfluenzaA__BAJ40054__HA

SEQ ID NO: 14040 - RNA, 1701 nt, Artificial Sequence
  derived and/or modified CDS sequence (AUadapt) from InfluenzaA__BAJ40055__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccacggaccagcagucgcuguaccagaacgccgacaccuacguguucgugggcaccucccgguacagcaagaaguucaagcccgagaucgccauccgcccgaagguccgggaccaggagggccgcaugaacuacuacuggacccugguggagcccggggacaagaucacguucgaggccaccggcaaccucguggucccccgguacgccuucgcgauggagcgcaacgccggguccggcaucaucaucucggacacccccgugcacgacugcaacaccaucugccagacgccgaagggcgccaucaacaccucccugcccuuccagaacauccaccccaucaccaucgggaagugccccaaguacgucaagagcaccaagcugcggcucgccacgggccugcgcaacgugccguccgugcagucgcgggggcuguucggcgccaucgcgggguucaucgagggcggcuggaccgggaugguggacggcugguacggguaccaccaccagaacgagcagggcuccggguacgccgccgaccucaagagcacccagaacgccaucgacgagaucaccaacaaggucaacuccgugaucgagaagaugaacacgcaguucaccgccgucggcaaggaguucaaccaccuggagaagcgcaucgagaaccugaacaagaagguggacgacggcuuccucgacaucuggaccuacaacgcggagcugcuggugcuccuggagaacgagcggacccuggacuaccacgacucgaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagucgacccgcaucuaccagauccuggccaucuacuccaccguggccagcucgcuggugcucgucgugucccugggggcgaucagcuucuggaugugcuccaacggcagccugcagugccggaucugcaucuga

SEQ ID NO: 14041 - RNA, 1701 nt, Artificial Sequence
  derived and/or modified CDS sequence (AUadapt) from InfluenzaA__BAJ40056__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagcugcucucgaccgcguccagcugguccuacaucguggagaccucguccagcgacaacggcacgugcuaccccggcgacuucaucgacuacgaggagcugcgggagcagcuguccucgguguccagcuucgagcgcuucgagaucuuccccaagaccuccucguggcccaaccacgacuccaacaagggggucaccgccgccugcccgcacgccggcgccaagagcuucuacaagaaccucaucuggcaggucaagaaggggaacuccuaccccaagcugucgaaguccuacaucaacgacaagggcaaggaggugcuggugcucugggggauccaccaccccagcaccucggccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggcgaccggcaaccucguggucccccggcacgccuucgccauggagcgcaacgccgggagcggcaucaucaucuccgacacgcccgugcacaacugcaacacgaccugccagaccccgaagggcgccaucaacaccucgcugcccuuccagaacauccaccccaucaccaucgggaagugccccaaguacgugaaguccccgaagcugcggcucgcgaccggccugcgcaacguccccagcauccagucccgggggcuguucggcgccaucgccggguucaucgagggcggcuggaccgggaugguggacggcugguacggguaccaccaccagaacgagcagggcucgggguacgccgccgaccucaaguccacgcagaacgcgaucgacaagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccuacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 14042 - RNA, 1701 nt, Artificial Sequence
  derived and/or modified CDS sequence (AUadapt) from InfluenzaA__BAJ40057__HA
augaaggccauccuggugguccuccuguacaccuucgccaccgcgaacgccgacacgcugugcaucggcuaccacgccaacaacucgaccgacaccguggacaccgugcucgagcgcaacgucacggugacccacuccgugaaccugcuggaggacaagcacaacgggaagcucugcaagcugcggggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgcgagcagcugucguccgugagcuccuucgagcgguucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacacguacguguucgugggcaccucccgcuacucgaagaaguucaagcccgagaucgccauccggccgaagguccgcgaccaggagggccggaugaacuacuacuggacccugguggagcccggggacaagaucaccuucgaggccacgggcaaccucguggucccccgcuacgcguucgccauggagcggaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcgccucgccacgggccugcggaacgugccguccauccagagccgcgggcuguucggcgcgaucgccggguucaucgagggcggcuggaccgggaugguggacggcugguacggguaccaccaccagaacgagcagggcuccggguacgccgccgaccucaagucgacccagaacgccaucgacgagaucaccaacgaggugaacuccgucaucgagaagaugaacacgcaguucaccgcggugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggccaucuacuccaccgucgcgucgagccuggugcucguggucucccugggggccaucucguucuggaugugcuccaacggcagccugcagugccgcaucugcaucuga

SEQ ID NO: 14043 - RNA, 1701 nt, Artificial Sequence; identical to SEQ ID NO: 9517
  derived and/or modified CDS sequence (AUadapt) from InfluenzaA__BAJ40058__HA

SEQ ID NO: 14044 - RNA, 1701 nt, Artificial Sequence; identical to SEQ ID NO: 13987
  derived and/or modified CDS sequence (AUadapt) from InfluenzaA__BAJ40059__HA

SEQ ID NO: 14045 - RNA, 1701 nt, Artificial Sequence; identical to SEQ ID NO: 4078
  derived and/or modified CDS sequence (AUadapt) from InfluenzaA__BAJ40060__HA

SEQ ID NO: 14046 - RNA, 1701 nt, Artificial Sequence
  derived and/or modified CDS sequence (AUadapt) from InfluenzaA__BAJ40061__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaaggccucguccuggcccaaccacgacagcaacaagggggucaccgccgccugcccgcacgcgggcgccaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcaccucccgguacucgaagaaguucaagcccgagaucgcgauccgcccgaagguccgggaccaggagggccgcaugaacuacuacuggacgcugguggagcccggggacaagaucaccuucgaggccaccggcaaccucguggucccccgguacgccuucgccauggagcgcaacgccggguccggcaucaucaucagcgacacccccgugcacgacugcaacacgaccugccagaccccgaagggcgcgaucaacaccucccugcccuuccagaacauccaccccaucacgaucgggaagugccccaaguacgucaagucgaccaagcugcggcucgccaccggccugcgcaacgugccguccauccagagccgggggcuguucggcgccaucgccggguucaucgagggcggcuggaccgggaugguggacggcugguacggguaccaccaccagaacgagcagggcuccggguacgccgcggaccucaagucgacgcagaacgccaucgacaagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggcgaagcugaaccgggaggagaucgacggcgugaagcucgagagcacccgcaucuaccagauccuggccaucuacuccaccgucgccucgagccuggugcucguggucucccugggggccaucucguucuggaugugcuccaacggcagccugcagugccggaucugcaucuga

SEQ ID NO: 14047 - RNA, 1701 nt, Artificial Sequence
  derived and/or modified CDS sequence (AUadapt) from InfluenzaA__BAJ40062__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacacguacguguucgugggcaccucccgguacucgaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacgagaucaccaacaaggugaacuccgucaucgagaagaugaacacgcaguucaccgcggugggcaaggaguucaaccaccuggagaagaagaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggccaucuacuccaccgucgcgucgagccuggugcucguggucucccugggggccaucucguucuggaugugcuccaacggcagccugcagugcaagaucugcaucuga

SEQ ID NO: 14048 - RNA, 1701 nt, Artificial Sequence; identical to SEQ ID NO: 14046
  derived and/or modified CDS sequence (AUadapt) from InfluenzaA__BAJ40063__HA

SEQ ID NO: 14049 - RNA, 1701 nt, Artificial Sequence; identical to SEQ ID NO: 9517
  derived and/or modified CDS sequence (AUadapt) from InfluenzaA__BAJ40064__HA

SEQ ID NO: 14050 - RNA, 1707 nt, Artificial Sequence
  derived and/or modified CDS sequence (AUadapt) from InfluenzaA__BAK23398__HA
auggagaagaucgugcugcuccuggccaucgucucgcuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguuccugaacgugcccgaguggucguacaucguggagaagaucaaccccgucaacgaccugugcuaccccgggaacuucaacgacuacgaggagcucaagcaccuccugucccggaucaaccacuucgagaagauccagaucuuccccaagagcuccuggagcgaccacgaggccuccucgggcguguccagcgccugcccguaccagggccgcuccagcuucuuccggaacguggucuggcuggugaagaaggacaacgccuaccccaccaucaagaaguccuacaacaacacgaaccaggaggaccugcugauccucugggggauccaccaccccaacgacgcggccgagcagacccgccuguaccagaacccgaccaccuacaucucggugggcacguccacccugaaccagcggcucguccccaagaucgccacccgcagcaaggugaacgggcaguccggccggaucgaguucuucuggaccauccucaagagcaacgacgugaucaacuucgagucgaacgggaacuucaucgcccccgagaacgcguacaagaucgucaagaagggcgacuccacgaucaugaaguccgagcuggaguacggcaacugcaacaccaagugccagacccccaucggggccaucaacagcagcaugccguuccacaacauccacccccugaccaucggcgagugccccaaguacgugaaguccaaccgccuggugcuggccacggggcuccggaacucgccccgcggcgagcggcgccggaagaagcgcggccuguucggggccaucgccggcuucaucgagggcggguggcaggggauggucgacggcugguacggcuaccaccacuccaacgagcaggggagcggcuacgcggccgacaaggaguccacccagaaggccaucgacggggugaccaacaaggugaacagcaucaucgacaagaugaacacccaguucgaggccgucggccgggaguucaacaaccuggagcgccggaucgagaaccucaacaagaagauggaggacggguuccuggacguguggacguacaacgccgagcugcucguccugauggagaacgagcgcacccuggacuuccacgacuccaacgugaagaaccucuacgacaaggugcggcugcagcugcgcgacaacgcgaaggagcucggcaacggcugcuucgaguucuaccaccggugcgacaacgagugcauggagucggucaagaacgggaccuacgacuacccgcaguacuccgaggaggcccgccugaagcgcgaggagaucagcggcgugaagcuggaguccaucgggaccuaccagauccucagcaucuacuccacgguggccucgucccuggcccuggccaucaugauggcgggccucuuccuguggaugugcagcaacgggagccugcagugccggaucugcaucuga

SEQ ID NO: 14051 - RNA, 1707 nt, Artificial Sequence
  derived and/or modified CDS sequence (AUadapt) from InfluenzaA__BAK23400__HA
auggagaagaucgugcugcuccuggccaucgucucgcuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugcgcgacugcuccgucgccggguggcugcucggcaacccgaugugcgacgaguuccugaacgugcccgaguggucguacaucguggagaagaucaaccccgccaacgaccugugcuaccccggggacuucaacgacuacgaggagcucaagcaccuccugucccggaucaaccacuucgagaagauccagaucauccccaagagcuccuggagcgaccacgaggccuccucgggcgucuccagcgccugcccguaccagggccgcuccucguucuuccggaacgugguguggcugaucaagaaggacaacgcguaccccaccaucaagcgcuccuacaacaacacgaaccaggaggaccugcugguccucugggggauccaccaccccaacgacgccgccgagcagacccggcuguaccacaacccgaccaccuacaucagcgugggcacguccacccugaaccagcgccucgugcccaagaucgccacccggagcaaggucaacgggcaguccggccgcauggaguucuucuggaccauccugaagcccaacgacgcgaucaacuucgagucgaacgggaacuucaucgcccccgagaacgccuacaagaucgugaagaagggcgacagcacgaucaugaaguccgagcuggaguacggcaacugcaacaccaagugccagaccccgaucggggccaucaacucguccaugcccuuccacaacauccacccccucaccaucggcgagugccccaaguacgucaagagcucccggcuggugcuggccacggggcuccgcaacagcccgcagggcaagucccggcgcaagaagcggggccuguucggggcgaucgccggcuucaucgagggcggguggcaggggaugguggacggcugguacggcuaccaccacucgaacgagcagggguccggcuacgccgccgacaaggagagcacccagcgcgccaucgacggggugaccaacaaggucaacuccaucaucgacaagaugaacacccaguucgaggcggugggccgggaguucaacaaccuggagcgccggaucgagaaccucaacaagaagauggaggacggguuccuggacguguggacguacaacgccgagcugcucguccugauggagaacgagcgcacccuggacuuccacgacucgaacgugaagaaccucuacgacaagguccggcugcagcugcgcgacaacgccaaggagcucggcaacggcugcuucgaguucuaccaccggugcgacaacgagugcauggaguccgugcgcaacgggaccuacgacuacccccaguacagcgaggaggcccgccugaagcgggaggagaucuccggcgugaagcuggagagcaucgggaucuaccagauccucuccaucuacucgaccgucgccuccagccuggcgcuggccaucaugguggccggccucuuccuguggaugugcagcaacgggucccugcagugccgcaucugcaucuga

SEQ ID NO: 14052 - RNA, 1707 nt, Artificial Sequence
  derived and/or modified CDS sequence (AUadapt) from InfluenzaA__BAK23401__HA
auggagaagaucgugcugcuccuggccaucgucucgcuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguuccugaacgugucggagugguccuacaucguggagaagaucaaccccgccaacgaccugugcuaccccgggaacuucaacaacuacgaggagcucaagcaccuccugagccggaucaaccgcuucgagaagauccagaucauccccaaguccucguggccggaccacgaggccucccucggcgucagcuccgccugccccuaccagggcgggcccagcuucuaccggaacgugguguggcugaucaagaagaacaacaccuaccccaucaucaagaaguccuaccacaacacgaaccaggaggaccugcucguccuguggggcauccaccacccgaacgacgaggaggagcagacccgcaucuacaagaaccccaccaccuacaucucgguggggacguccacccugaaccagcggcucgugcccaagaucgcgacccgcagcaaggucaacggccaguccgggcggguggaguucuucuggaccauccucaagucgaacgacacgaucaacuucgaguccaacggcaacuucaucgcccccgagaacgccuacaagaucgugaagaagggcgacagcaccaucaugaaguccgagcuggaguacgggaacugcaacaccaagugccagaccccgaucggcgccaucaacucgagcaugcccuuccacaacauccacccccugacgaucggggagugccccaaguacgucaaguccaaccgccuggugcuggcgaccggccuccggaacagcccgcagggcgagcgccggcgcaagaagcgggggcuguucggcgccaucgccggguucaucgagggcggguggcagggcaugguggacggcugguacggguaccaccacuccaacgagcagggcucgggguacgccgccgacaaggaguccacccagaaggcgaucgacggcgucaccaacaaggugaacagcaucaucgacaagaugaacauccaguucgaggccguggggcgcgaguucaacaaccuggagcggcgcaucgagaaccucaacaagaagauggaggacggcuuccuggacgucuggacguacaacgccgagcugcucgugcugauggagaacgagcggacccuggacuuccacgacuccaacgucaagaaccucuacgacaaggugcgccugcagcugcgggacaacgccaaggagcucggcaacgggugcuucgaguucuaccaccgcugcgacaacgagugcauggagucggugcggaacggcaccuacgacuacccccaguacuccgaggaggcccgccugaagcgcgaggagaucagcggggucaagcuggaguccaucggcaccuaccagauccucucgaucuacuccacgguggcgagcucccuggcccuggccaucaugguggccgggcuguuccuguggaugugcagcaacggcucccugcagugccggaucugcaucuga

SEQ ID NO: 14053 - RNA, 1707 nt, Artificial Sequence
  derived and/or modified CDS sequence (AUadapt) from InfluenzaA__BAK23402__HA
auggagaagaucgugcugcuccuggccaucgucucgcuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguuccugaacgugcccgaguggucguacaucguggagaagaucaaccccgccaacgaccugugcuaccccgggaacuucaacgacuacgaggagcucaagcaccuccugucccggaucaaccacuucgagaagauccagaucauccccaagagcuccuggucgaaccacgaggccuccagcggcgucuccucggccugcccguaccagggccgcuccagcuucuuccggaacgugguguggcugaucaagaaggacaacgcguaccccaccaucaagaucuccuacaacaacacgaaccaggaggaccugcugguccucugggggauccaccaccccaacgacgccgccgagcagacccgccuguaccagaacccgaccaccuacaucucggugggcacguccacccugaaccagcggcucgugcccaagaucgccacccgcagcaaggucaacgggcaguccggccggauggaguucuucuggaccauccucaagucgaacgacgcgaucaacuucgagagcaacgggaacuucaucgcccccgagaacgccuacaagaucgugaagaagggcgacuccacgaucaugaaguccgagcuggaguacggcaacugcaacaccaagugccagacccccaucggggccaucaacucgagcaugccguuccacaacacccacccccugacgaucggcgagugccccaaguacgugaaguccaaccgccugguccuggccaccgggcuccggaacucgccccacggcgagcgccggcgcaagaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggugaccaacaaggucaacucgaucaucgacaagaugaacacgcaguucgaggcggugggccgcgaguucaacaaccuggagcggcgcaucgagaaccucaacaagaagauggaggacggguuccuggacguguggaccuacaacgccgagcugcucguccugauggagaacgagcggacccuggacuuccacgacuccaacgugaagaaccucuacgacaagguccgccugcagcugcgggacaacgccaaggagcucggcaacggcugcuucgaguucuaccaccgcugcgacaacgagugcauggagagcgugcggaacgggaccuacgacuacccgcaguacuccgaggaggcccgccugaagcgcgaggagaucucgggcgugaagcuggaguccaucgggacguaccagauccucagcaucuacuccaccgucgccucgucccuggcgcuggccaucaugguggccggccucuuccuguggaugugcagcaacgggagccugcagugccggaucugcaucuga

SEQ ID NO: 14054 - RNA, 1707 nt, Artificial Sequence
  derived and/or modified CDS sequence (AUadapt) from InfluenzaA__BAK23403__HA
auggagaagaucgugcugcuccuggccaucgucucgcuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguuccugaacgugcccgaguggucguacaucguggagaagaucaaccccgccaacgaccugugcuaccccgggaacuucaacgacuacgaggagcucaagcaccuccugucccggaucaaccacuucgagaagauccagaucauccccaagagcuccuggucgaaccacgaggccuccagcggcgucuccucggccugcccguaccagggccgcuccagcuucuuccggaacgugguguggcugaucaagaaggacaacgcguaccccaccaucaagaucuccuacaacaacacgaaccaggaggaccugcugguccucugggggauccaccaccccaacgacgccgccgagcagacccgccuguaccagaacccgaccaccuacaucagcgugggcacguccacccugaaccagcggcucgugcccaagaucgccacccgcucgaaggucaacgggcaguccggccggauggaguucuucuggaccauccucaagagcaacgacgcgaucaacuucgagucgaacgggaacuucaucgcccccgagaacgccuacaagaucgugaagaagggcgacuccacgaucaugaaguccgagcuggaguacggcaacugcaacaccaagugccagacccccaucggggccaucaacagcucgaugccguuccacaacauccacccccugaccaucggcgagugccccaaguacgugaaguccaaccgccugguccuggccacggggcuccggaacagcccccagggcgagcgccggcgcaagaagcggggccuguucggggcgaucgccggcuucaucgagggcggguggcaggggaugguggacggcugguacggcuaccaccacuccaacgagcaggggagcggcuacgccgccgacaaggaguccacccagaaggccaucgacggggugaccaacaaggucaacucgaucaucgacaagaugaacacccaguucgaggcggugggccgcgaguucaacaaccuggagcggcgcaucgagaaccucaacaagaagauggaggacggguuccuggacguguggacguacaacgccgagcugcucguccugauggagaacgagcggacccuggacuuccacgacuccaacgugaagaaccucuacgacaagguccgccugcagcugcgggacaacgccaaggagcucggcaacggcugcuucgaguucuaccaccgcugcgacaacgagugcauggagagcgugcggaacgggaccuacgacuacccgcaguacuccgaggaggcccgccugaagcgcgaggagaucucgggcgugaagcuggaguccaucgggaccuaccagauccucagcaucuacuccacggucgccucgucccuggcgcuggccaucaugguggccggccucuuccuguggaugugcagcaacgggagccugcagugccggaucugcaucuga

SEQ ID NO: 14055 - RNA, 1707 nt, Artificial Sequence
  derived and/or modified CDS sequence (AUadapt) from InfluenzaA__BAK23404__HA
auggagaagaucgugcugcuccuggccaucgucucgcuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguuccugaacgugcccgaguggucguacaucguggagaagaucaaccccgccaacgaccugugcuaccccgggaacuucaacgacuacgaggagcucaagcaccuccugucccggaucaaccacuucgagaagauccagaucauccccaagagcuccuggucggaccacgaggccuccagcggcgucuccucggccugcccguaccagggccgcuccagcuucuuccggaacgugguguggcugaucaagaaggacaacgcguaccccaccaucaagcgcuccuacaacaacacgaaccaggaggaccugcugguccucugggggauccaccaccccaacgacgccgccgagcagacccggcuguaccagaacccgaccaccuacaucucggugggcacguccacccugaaccagcgccucgugcccaagaucgccacccggagcaaggucaacgggcaguccggccgcauggaguucuucuggaccauccucaagucgaacgacgcgaucaacuucgagagcaacgggaacuucaucgcccccgagaacgccuacaagaucgugaagaagggcgacuccacgaucaugaaguccgagcuggaguacggcaacugcaacaccaagugccagacccccaucggggccaucaacucgagcaugccguuccacaacauccacccccugaccaucggcgagugccccaaguacgugaaguccaaccggcugguccuggccacggggcuccgcaacucgccccagggcgagcggcgccggaagaagcgcggccuguucggggcgaucgccggcuucaucgagggcggguggcaggggaugguggacggcugguacggcuaccaccacuccaacgagcaggggagcggcuacgccgccgacaaggaguccacccagaaggccaucgacggggugaccaacaaggucaacucgaucaucgacaagaugaacacccaguucgaggcggugggccgggaguucaacaaccuggagcgccggaucgagaaccucaacaagaagauggaggacggguuccuggacguguggacguacaacgccgagcugcucguccugauggagaacgagcgcacccuggacuuccacgacuccaacgugaagaaccucuacgacaagguccggcugcagcugcgcgacaacgccaaggagcucggcaacggcugcuucgaguucuaccaccggugcgacaacgagugcauggagagcgugcgcaacgggaccuacgacuacccgcaguacuccgaggaggcccgccugaagcgggaggagaucucgggcgugaagcuggaguccaucgggaccuaccagauccucagcaucuacuccacggucgccucgucccuggcgcuggccaucaugguggccggccucuuccuguggaugugcagcaacgggagccugcagugccgcaucugcaucuga

SEQ ID NO: 14056 - RNA, 1707 nt, Artificial Sequence; identical to SEQ ID NO: 14055
  derived and/or modified CDS sequence (AUadapt) from InfluenzaA__BAK23405__HA

SEQ ID NO: 14057 - RNA, 1707 nt, Artificial Sequence
  derived and/or modified CDS sequence (AUadapt) from InfluenzaA__BAK23406__HA
auggagaagaucgugcugcuccuggccaucgucucgcuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguuccugaacgugcccgaguggucguacaucguggagaagaucaaccccgucaacgaccugugcuaccccgggaacuucaacgacuacgaggagcucaagcaccuccugucccggaucaaccacuucgagaagauccagaucuuccccaagagcuccuggagcgaccacgaggccuccucgggcguguccagcgccugcccguaccagggccgcuccagcuucuuccggaacguggucuggcuggugaagaaggacaacgccuaccccaccaucaagaaguccuacaacaacacgaaccaggaggaccugcugauccucugggggauccaccaccccaacgacgcggccgagcagacccgccuguaccagaacccgaccaccuacaucucggugggcacguccacccugaaccagcggcucguccccaagaucgccacccgcagcaaggugaacgggcaguccggccggaucgaguucuucuggaccauccucaagagcaacgacgugaucaacuucgagucgaacgggaacuucaucgcccccgagaacgcguacaagaucgucaagaagggcgacuccacgaucaugaaguccgagcuggaguacggcaacugcaacaccaagugccagacccccaucggggccaucaacagcagcaugccguuccacaacauccacccccugaccaucggcgagugccccaaguacgugaaguccaaccgccuggugcuggccacggggcuccggaacucgccccagggcgagcgccggcgcaagaagcggggccuguucggggccaucgccggcuucaucgagggcggguggcaggggauggucgacggcugguacggcuaccaccacuccaacgagcaggggagcggcuacgcggccgacaaggaguccacccagaaggccaucgacggggugaccaacaaggugaacagcaucaucgacaagaugaacacccaguucgaggccgucggccgcgaguucaacaaccuggagcggcgcaucgagaaccucaacaagaagauggaggacggguuccuggacguguggacguacaacgccgagcugcucguccugauggagaacgagcggacccuggacuuccacgacuccaacgugaagaaccucuacgacaaggugcgccugcagcugcgggacaacgcgaaggagcucggcaacggcugcuucgaguucuaccaccgcugcgacaacgagugcauggagucggucaagaacgggaccuacgacuacccgcaguacuccgaggaggcccggcugaagcgcgaggagaucagcggcgugaagcuggaguccaucgggaccuaccagauccucagcaucuacuccacgguggccucgucccuggcccuggccaucaugauggcgggccucuuccuguggaugugcagcaacgggagccugcagugccgcaucugcaucuga

SEQ ID NO: 14058 - RNA, 1707 nt, Artificial Sequence
  derived and/or modified CDS sequence (AUadapt) from InfluenzaA__BAK23407__HA
auggagaagaucgugcugcuccuggccaucgucucgcuggugaaguccggccagaucugcaucggguaccacgccaacaacucgaccgagcaggucgacaccaucauggagaagaacgugacggugacccacgcgcaggacauccucgagaagacccacaacggcaagcugugcgaccuggacggggugaagccccucauccugcgcgacugcuccgucgccggcuggcugcucgggaacccgaugugcgacgaguuccugaacgugagcgagugguccuacaucguggagaagaucaaccccgccaacgaccugugcuaccccggcaacuucaacaacuacgaggagcucaagcaccuccugucgcggaucaaccgcuucgagaagauccagaucauccccaaguccagcuggccggaccacgaggccucccugggcgucucggccgcgugccccuaccagggcgggcccuccuucuaccggaacgugguguggcugaucaagaagaacaacaccuaccccacgaucgagaaguccuaccacaacaccaaccaggaggaccugcucguccugugggggauccaccacccgaacgacgaggccgagcagacccgcaucuacaagaaccccaccacguacaucagcgugggcaccucgacccugaaccagcggcucgugcccaagaucgccacccgcuccaaggucaacgggcagucgggccggguggaguucuucuggacgauccugaaguccaacgacaccaucaacuucgagagcaacggcaacuucaucgcccccgagaacgcguacaagaucgugaagaagggggacuccaccaucaugaaguccgagcuggaguacggcaacugcaacacccgcugccagacgccgaucggggccaucaacucgagcaugcccuuccacaacauccacccccucaccaucggcgagugccccaaguacgucaagucgaaccggcuggugcuggccaccggccuccgcaacuccccgcagggggagcggcgccggaagaagcgcggccuguucggggccaucgccggcuucaucgagggcggguggcagggcaugguggacgggugguacggcuaccaccacagcaacgagcagggguccggcuacgcggccgacaaggagucgacccagaaggccaucgacggggucacgaacaaggugaacuccaucaucgacaagaugaacacccaguucgaggccgugggccgggaguucaacaaccuggagcgccggaucgagaaccucaacaagaagauggaggacggcuuccuggacgucuggaccuacaacgccgagcugcucgugcugauggagaacgagcgcacccuggacuuccacgacucgaacgucaagaaccucuacgacaaggugcggcugcagcugcgcgacaacgcgaaggagcucgggaacggcugcuucgaguucuaccaccggugcgacaacgagugcauggaguccgugcgcaacgggacguacgacuacccccaguacagcgaggaggcccgccugaagcgggaggagaucuccggcgucaagcuggagucgaucgggaccuaccagauccucuccaucuacagcaccguggccuccucgcuggcccuggccaucaugguggcgggccucuuccuguggaugugcuccaacggcagccugcagugccgcaucugcaucuga

SEQ ID NO: 14059 - RNA, 1707 nt, Artificial Sequence
  derived and/or modified CDS sequence (AUadapt) from InfluenzaA__BAK23408__HA
auggagaagaucgugcugcuccuggccaucgucucgcuggugaaguccgaccagaucugcaucggcuaccacgccaacaacucgaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguuccccaacgugagcgagugguccuacaucguggagaagaucaaccccgccaacgaccugugcuaccccgggaacuucaacaacuacgaggagcugaagcaccuccugucgcggaucaaccgcuucgagaagauccagaucaucccgaaguccagcuggcccgaccacgaggccucccugggcgucucguccgccugccaguaccagggcgggcccagcuucuaccggaacgugguguggcucaucaagaaggacaacgcguaccccaccaucaagaaguccuaccacaacacgaacaaggaggaccugcugguccucuggggcauccaccacccgaacaacgaggaggagcagaccaagcuguaccagaaccccaccaccuacaucucgguggggacguccacccugaaccagcgccucgugcccaagaucgccacccggucgaaggucaacggccaguccgggcgcguggaguucuucuggaccauccucaagagcaacgacgccaucaacuucgaguccaacggcaacuucaucgcccccgagaacgcguacaagaucgugaagaagggcgacucgacgaucaugaaguccgagcuggaguacgggaacuacaacaccaagugccagaccccgaucggcgccaucaacagcucgaugcccuuccacaacauccacccccucaccaucggggagugccccaaguacgucaaguccaaccggcuggugcuggccacgggccuccgcaacagcccgcagggcgagcggcgccggaagaagcgcgggcuguucggcgccaucgccggguucaucgagggcggguggcagggcaugguggacggcugguacggguaccaccacuccaacgagcagggcucgggguacgcggccgacaaggaguccacccagaaggccaucgacggcgucaccaacaaggugaacucgaucaucgacaagaugaacacccaguucgaggccguggggaaggaguucaacaaccuggagcggcgcaucgagaaccucaacaagaagauggaggacggcuuccuggacgucuggacguacaacgccgagcugcucgugcugauggagaacgagcggacccuggacuuccacgacuccaacgucaagaaccucuacgacaaggugcgccugcagcugcgggacaacgcgaaggagcucggcaacgggugcuucgaguucuaccaccgcugcgacaacgagugcauggagagcgugcggaacggcaccuacgacuacccccaguacuccgaggaggcccgccugaagcgggaggagaucucgggggucaagcuggaguccaucggcaccuaccagauccucagcaucuacuccacgguggccucgucccuggcccuggccaucaugguggcggggcuguuccuguggaugugcagcaacggcucccugcagugccgcaucugcaucuga

SEQ ID NO: 14060 - RNA, 1707 nt, Artificial Sequence
  derived and/or modified CDS sequence (AUadapt) from InfluenzaA__BAK23411__HA
auggagaagaucgugcugcuccuggccaucgucucgcuggugaaguccgaccagaucugcaucggcuaccacgccaacaacucgaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguuccugaacgugagcgagugguccuacaucguggagaagaucaaccccgccaacgaccugugcuaccccgggaacuucaacaacuacgaggagcucaagcaccuccugucgcggaucaaccgcuucgagaagauccagaucauccccaaguccagcuggccggaccacgaggccucccugggcgucucguccgccugccaguaccagggcgggcccagcuucuaccggaacgugguguggcugaucaagaaggacaacgcguaccccaccaucaagaaguccuaccacaacacgaacaaggaggaccugcucguccuguggggcauccaccaccccaacaacgaggaggagcagaccaagcuguaccagaacccgaccaccuacaucucgguggggacguccacccucaaccagcgccuggugcccaagaucgccacccggagcaaggucaacggccaguccgggcgcguggaguucuucuggaccauccucaagucgaacgacgccaucaacuucgaguccaacggcaacuucaucgcccccgagaacgcguacaagaucgugaagaagggcgacagcacgaucaugaaguccgagcuggaguacgggaacugcaacaccaagugccagacccccaucggcgccaucaacucgagcaugccguuccacaacauccacccccugaccaucggggagugccccaaguacgucaaguccaaccggcuggugcucgccacgggccugcgcaacucgccccagggcgagcggcgccggaagaagcgcgggcuguucggcgccaucgccggguucaucgagggcggguggcagggcaugguggacggcugguacggguaccaccacuccaacgagcagggcagcggguacgcggccgacaaggaguccacccagaaggccaucgacggcgucaccaacaaggugaacucgaucaucgacaagaugaacacccaguucgaggccguggggaaggaguucaacaaccucgagcggcgcaucgagaaccugaacaagaagauggaggacggcuuccuggacgucuggacguacaacgccgagcuccuggugcugauggagaacgagcggacccucgacuuccacgacuccaacgucaagaaccuguacgacaaggugcgccugcagcuccgggacaacgcgaaggagcugggcaacgggugcuucgaguucuaccaccgcugcgacaacgagugcauggagagcgugcggaacggcaccuacgacuacccgcaguacuccgaggaggcccgccugaagcgggaggagaucucgggggucaagcucgaguccaucggcaccuaccagauccugagcaucuacuccacgguggccucgucccuggcccucgccaucaugguggcggggcuguuccuguggaugugcagcaacggcucccuccagugccgcaucugcaucuga

SEQ ID NO: 14061 - RNA, 1707 nt, Artificial Sequence
  derived and/or modified CDS sequence (AUadapt) from InfluenzaA__BAK23412__HA
auggagaagaucgugcugcuccuggccaucgucucgcuggugaaguccgaccagaucugcaucggcuaccacgccaacaacucgaccgagcaggucgacaccaucauggagaagaacgugacggugacccacgcgcaggacauccucgagaagacccacaaggggaagcugugcgaccuggacggcgugaagccccucauccugcgcgacugcuccgucgccggguggcugcucggcaacccgaugugcgacgaguuccugaacgugagcgagugguccuacaucguggagaagaucaaccccgccaacgaccugugcuaccccgggaacuucaacaacuacgaggagcucaagcaccuccugucgcggaucaaccgcuucgagaagauccagaucauccccaaguccagcuggccggaccacgaggccucccugggcgucucguccgccugccaguaccagggcgggcccagcuucuaccggaacgugguguggcugaucaagaaggacaacaccuaccccacgaucaagaaguccuaccacaacaccaacaaggaggaccugcucguccuguggggcauccaccaccccaacaacgaggaggagcagaccaagcuguaccagaacccgaccacguacaucucgguggggaccuccacccucaaccagcgccuggugcccaagaucgcgacccggucgaaggucaacggccaguccgggcgcguggaguucuucuggacgauccucaagagcaacgacgccaucaacuucgaguccaacggcaacuucaucgcccccgagaacgccuacaagaucgugaagaagggcgacucgaccaucaugaaguccgagcuggaguacgggaacugcaacaccaagugccagacccccaucggcgcgaucaacagcucgaugccguuccacaacauccacccccugacgaucggggagugccccaaguacgucaaguccaaccggcuggugcucgccaccggccugcgcaacagcccccagggcgagcggcgccggaagaagcgcgggcuguucggcgccaucgccggguucaucgagggcggguggcagggcaugguggacggcugguacggguaccaccacuccaacgagcagggcucgggguacgccgcggacaaggaguccacccagaaggccaucgacggcgucaccaacaaggugaacucgaucaucgacaagaugaacacgcaguucgaggccguggggaaggaguucaacaaccucgagcggcgcaucgagaaccugaacaagaagauggaggacggcuuccuggacgucuggaccuacaacgccgagcuccuggugcugauggagaacgagcggacccucgacuuccacgacuccaacgucaagaaccuguacgacaaggugcgccugcagcuccgggacaacgccaaggagcugggcaacgggugcuucgaguucuaccaccgcugcgacaacgagugcauggagagcgugcggaacggcaccuacgacuacccgcaguacuccgaggaggcgcgccugaagcgggaggagaucucgggggucaagcucgaguccacgggcaccuaccagauccugagcaucuacuccaccguggccucgucccuggcccucgccaucaugguggccgggcuguuccuguggaugugcagcaacggcucccuccagugccgcaucugcaucuga

SEQ ID NO: 14062 - RNA, 1707 nt, Artificial Sequence
  derived and/or modified CDS sequence (AUadapt) from InfluenzaA__BAK23413__HA
auggagaagaucgugcugcuccuggccaucgucucgcuggugaaguccgaccagaucugcaucggcuaccacgccaacaacucgaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguuccugaacgugagcgagugguccuacaucguggagaagaucaaccccgccaacgaccugugcuaccccgggaacuucaacaacuacgaggagcucaagcaccuccugucgcggaucaaccgcuucgagaagauccagaucauccccaaguccagcuggccggaccacgaggccucccugggcgucucguccgccugccaguaccagggcgggcccagcuucuaccggaacgugguguggcugaucaagaaggacaacaccuaccccacgaucaagaaguccuaccacaacaccaacaaggaggaccugcucguccuguggggcauccaccaccccaacaacgaggaggagcagaccaagcuguaccagaacccgaccacguacaucucgguggggaccuccacccucaaccagcgccuggugcccaagaucgcgacccggagcaaggucaacggccaguccgggcgcguggaguucuucuggacgauccucaagucgaacgacgccaucaacuucgaguccaacggcaacuucaucgcccccgagaacgccuacaagaucgugaagaagggcgacagcaccaucaugaaguccgagcuggaguacgggaacugcaacaccaagugccagacccccaucggcgcgaucaacucgagcaugccguuccacaacauccacccccugacgaucggggagugccccaaguacgucaaguccaaccggcuggugcucgccaccggccugcgcaacucgccccagggcgagcggcgccggaagaagcgcgggcuguucggcgccaucgccggguucaucgagggcggguggcagggcaugguggacggcugguacggguaccaccacuccaacgagcagggcagcggguacgccgcggacaaggaguccacccagaaggccaucgacggcgucaccaacaaggugaacucgaucaucgacaagaugaacacgcaguucgaggccguggggaaggaguucaacaaccucgagcggcgcaucgagaaccugaacaagaagauggaggacggcuuccuggacgucuggaccuacaacgccgagcuccuggugcugauggagaacgagcggacccucgacuuccacgacuccaacgucaagaaccuguacgacaaggugcgccugcagcuccgggacaacgccaaggagcugggcaacgggugcuucgaguucuaccaccgcugcgacaacgagugcauggagagcgugcggaacggcaccuacgacuacccgcaguacuccgaggaggcgcgccugaagcgggaggagaucucgggggucaagcucgaguccaucggcacguaccagauccugagcaucuacuccaccguggccucgucccuggcccucgccaucaugguggccgggcuguuccuguggaugugcagcaacggcucccuccagugccgcaucugcaucuga

SEQ ID NO: 14063 - RNA, 1707 nt, Artificial Sequence; identical to SEQ ID NO: 14060
  derived and/or modified CDS sequence (AUadapt) from InfluenzaA__BAK23414__HA

SEQ ID NO: 14064 - RNA, 1698 nt, Artificial Sequence
  derived and/or modified CDS sequence (AUadapt) from InfluenzaA__BAM65746__HA
auggaggugaagcugcucguccugcugugcaccuucaccgccacguacgccgacaccaucugcaucggcuaccacgcgaacaacucgaccgacaccguggacacgcuccccgagaagaacgugaccgucacccacuccgugaaccugcuggaggacacccacaacgggaagcucugccugcugaagggcaucgccccgcuccagcuggggaacugcagcguggccggcuggauccuggggaaccccgagugcgagcuccugaucucccgcgagagcugguccuacaucgucgagaagcccaaccccgagaacggcaucugcuacccgggccacuucgccgacuacgaggagcugcgggagcagcucucguccgugagcuccuucgagcgcuucgagaucuuccccaaggagagcuccuggcccaaccacacggccaccggggugucggcguccugcagccacaacggcaaguccagcuucuacaagaaccugcuguggcucaccgucaagaacgggcuguaccccaaccuguccaagucguacgccaacaacaaggagaaggaggugcucgugcuguggggcguccaccacccgaccaacaucggggaccagcgggcccuguaccacacggagaacgccuacguguccguggucagcagccacuacucccgccgguucacccccgagaucgcgaagcgccccaaggugcgggaccaggagggccgcaucaacuacuacuggacccuccuggagcccggcgacaccaucaucuucgaggccaacgggaaccugaucgccccgcgguacgccuucgcccucucgcgcggcuucggguccggcaucaucaagagcaacgcgcccauggacgagugcaacgccaagugccagacgccccagggcgccaucaacuccagccugcccuuccagaacgugcacccggucaccaucggggagugccccaaguacgugcgguccaccaagcugcgcauggugaccggccuccggaacacgcccucgauccagucccgcgggcuguucggcgccaucgccggguucaucgagggcggcuggaccgggauggucgacggcugguacggguaccaccaccagaacgagcagggcagcggguacgcggccgaccagaaguccacccagaacgccaucaacggcaucaccaacaaggugaacagcgugaucgagaagaugaacacgcaguucaccgccgucgacaaggaguucaacaagcuggagcggcgcauggagaacuucaacaagaagguggacgacggcuucaucgacaucuggaccuacaacgccgagcuccugauccugcucgagaacgagcggacccuggacuuccacgacuccaacgucaagaaccuguacgagaaggucaagucgcagcucaagaacaacgcgaaggagaucgggaacggcugcuucgaguucuaccacaagugcaacgacgagugcauggaguccgugaagaacgggacguacgacuaccccaaguacagcgaggaguccaagcugaaccgcgagaagaucgacggcgugaagcuggagagcauggggguguaccagauccucgccaucuacuccaccguggccucgagcaugguccugcuggugucccucggcgccaucagcuucuggaugugcuccaacggcagccugcagugccggaucugcaucuga

SEQ ID NO: 14065 - RNA, 1701 nt, Artificial Sequence; identical to SEQ ID NO: 12811
  derived and/or modified CDS sequence (AUadapt) from InfluenzaA__BAO79716__HA

SEQ ID NO: 14066 - RNA, 1683 nt, Artificial Sequence
  derived and/or modified CDS sequence (AUadapt) from InfluenzaA__CAB95856__HA
auggaaaccaucagucugaucaccauccuccugguggucacggccuccaacgccgacaagaucugcaucggccaccagagcaccaacuccaccgagaccguggacacgcugaccgagaccaaugugcccgucacccacgcgaaggagcuccugcacacggagcacaacgggaugcugugcgccaccagccucggccacccgcugauccuggauacgugcaccaucgaggggcucguguacggcaaccccuccugcgaccugcugcucgggggccgcgaguggagcuacaucguggagcgguccagugccgucaacgggaccugcuaccccggcaacguggagaaccuggaggagcugcgcacccucuucuccagcgccuccaguuaccagcggauccagaucuuccccgacaccaccuggaacgugacguacaccggcaccucccgcgccugcagcggguccuuuuaccggagcaugcgcuggcugacccagaaguccggcuucuacccgguccaggacgcgcaguacacgaacaaucggggcaagagcauccuguucgugugggggauccaccacccgcccaccuacaccgagcagaccaaccucuacauccgcaaugacacgaccaccuccgugaccacggaggaccugaaccggaccuucaagcccgucaucggcccccgcccccuggugaacgggcuccagggccggaucgacuacuauuggagcgugcugaagcccgggcagacccugcgcguccggagcaacggcaaccucaucgcccccugguacggccacgugcuguccgggggcagccaugggcgcauccugaagaccgaccucaagggcgggaacugcgugguccagugccagacggagaagggcggccugaacuccacccugccguuccacaacaucaguaaguacgccuucgggaccugccccaaguacgugcgggugaacucccucaagcuggccgucggccugcgcaacgugcccgcgcggagcucccgcggccucuuuggggccaucgccggguucaucgagggcggcuggcccgggcugguggccggcugguacggguuccagcacagcaacgaccagggcgucgggauggccgcggaucgggacuccacccagaaggccaucgacaagaucacgagcaaggugaacaacaucgucgacaagaugaacaagcaguaugagaucaucgaccacgaguucuccgagguggagacccgccugaacaugaucaacaacaagaucgacgaucagauccaggacgugugggccuacaacgccgagcuccugguccugcucgagaaccagaagacccuggacgagcacgacgccaaugugaacaaccuguacaacaaggugaagcgggcgcucggcagcaacgccauggaggacggcaagggguguuucgagcuguaccacaagugcgacgaccagugcauggagaccauccgcaauggcaccuacaaccgccggaaguaccgcgaggagucccggcuggagcgccagaagaucgagggggucaagcucgagagcgagggcacguacaagauccugaccaucuacuccaccguggccagcucccuggugcucgccaugggcuuugccgcguuccuguucugggccaugagcaacggguccugccggugcaacaucugcaucuga

SEQ ID NO: 14067 - RNA, 1683 nt, Artificial Sequence
  derived and/or modified CDS sequence (AUadapt) from InfluenzaA__CAB95857__HA
auggagaccaucagucugaucaccauccuccugguggucacggccuccaacgccgacaagaucugcaucggccaccagagcaccaacuccaccgagaccguggacacgcugaccgagaccaaugugcccgucacccacgcgaaggagcuccugcacacggagcacaacgggaugcugugcgccaccagccucggccacccgcugauccuggauacgugcaccaucgaggggcucguguacggcaaccccuccugcgaccugcugcucgaggggcgcgaguggagcuacaucguggagcgguccagugccgucaacgggaccugcuaccccggcaacguggagaaccuggaggagcugcgcacccucuucuccagcgccuccaguuaccagcggauccagaucuuccccgacaccaccuggaacgugacguacaccggcaccucccgcgccugcagcggcuccuuuuaccggagcaugcgcuggcugacccagaaguccggguucuacccgguccaggacgcgcaguacacgaacaaucggggcaagagcauccuguucgugugggggauccaccacccgcccaccuacaccgagcagaccaaccucuacauccgcaacgauacgaccaccuccgugaccacggaggaccugaaccggaccuucaagcccgucaucggcccccgcccccuggugaacggccuccaggggcggaucgacuacuacuggagugugcugaagcccggccagacccugcgcguccggagcaacgggaaccucaucgcccccugguacggccacgugcuguccggcgggagccacggccgcauccugaagaccgaucucaaguccgggaacugcgugguccagugccagacggagaagggcgggcugaacagcacccugccguuccacaauaucuccaaguacgccuucgggaccugccccaaguacgugcgggugaacagccucaagcuggccgucggccugcgcaacgugcccgcgcgguccagucgcggccucuucggcgccaucgccggguucaucgagggcggguggcccggccugguggccggcugguacggguuccagcacuccaacgaccagggcgucgggauggccgcggaucgggacagcacccagaaggccaucgacaagaucacguccaaggugaacaacaucgucgacaagaugaacaagcaguacgagaucaucgaucacgaguucagcgagguggagacccgccugaacaugaucaacaacaagaucgacgaucagauccaggacgugugggccuacaacgccgagcuccugguccugcucgagaaccagaagacccuggacgagcacgacgccaaugugaacaaccuguacaacaaggugaagcgggcgcucggcuccaacgccauggaggacgggaagggcugcuuugagcuguaccacaagugcgacgaccagugcauggagaccauccgcaacggcaccuauaaccgccggaaguaccgcgaggagagccggcuggagcgccagaagaucgagggggucaagcucgaguccgagggcgccuacaagauccugacgaucuacagcaccguggccuccagccuggugcucgccaugggguuugcggccuuccuguucugggccauguccaacggcagcugccggugcaacaucugcaucuga

SEQ ID NO: 14068 - RNA, 1707 nt, Artificial Sequence
  derived and/or modified CDS sequence (AUadapt) from InfluenzaA__CBW54815__HA
auggagaagaucgugcugcuccuggccaucgucucgcuggugaaguccgaccagaucugcaucggcuaccacgccaacaacucgaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguuccccaacgugagcgagugguccuacaucguggagaagaccaaccccgccaacgaccugugcuaccccgggaacuucgacaacuacgaggagcugaagcaccuccugucgcggaucaaccgcuucgagaagauccagaucaucccgaaguccagcuggcccgaccacgaggccucccugggcgucucguccgccugccccuaccagggcgggcccucguucuaccggaacgugguguggcucaucaagaagaacaacacguacccgaccaucaaggaguccuaccacaacaccaaccaggaggaccugcugguccucuggggcauccaccaccccaacgacgaggaggagcagacccgcaucuacaagaaccccacgaccuacaucagcguggggaccuccacccugaaccagcggcuggugcccaagaucgcgacgcgcucgaaggucaacggccaguccgggcggguggaguucuucuggaccauccucaagagcaacgacaccaucaacuucgaguccaacggcaacuucaucgccccggagaacgccuacaagaucgugaagaagggcgacucgaccaucaugaaguccgagcuggaguacgggaacugcuccacgaagugccagacccccaucggcgccaucaacucguccaugcccuuccacaacauccacccccugaccaucggggagugcccgaaguacgucaagagcaaccgccucgugcuggcgaccggccugcggaacucgccccagggcgaggggcgccggaagaagcgcggccucuucggggccaucgccggcuucaucgagggcggguggcagggcaugguggacgggugguacggcuaccaccacagcaacgagcagggguccggcuacgccgccgacaaggagucgacgcagaaggcgaucgacggggucaccaacaaggugaacuccaucaucgacaagaugaacacccaguucgaggccgugggccgggaguucaacaaccuggagaagcgcaucgagaaccugaacaagaagauggaggacggcuuccucgacgucuggaccuacaacgccgagcugcuggugcucauggagaacgagcggacgcuggacuuccacgacucgaacgucaagaaccuguacgacaaggugcgccuccagcugcgggacaacgccaaggagcuggggaacggcugcuucgaguucuaccaccgcugcgacaacgagugcauggaguccgugcggaacgggaccuacgacuacccccaguacagcgaggaggcccgccucaagcgggaggagaucuccggcgucaagcuggagucgaucgggaccuaccagauccuguccaucuacagcaccguggcguccucgcucgcccuggccaucaugguggccggccuguuccucuggaugugcuccaacggcagccugcagugccgcaucugcaucuga

SEQ ID NO: 14069 - RNA, 1707 nt, Artificial Sequence
  derived and/or modified CDS sequence (AUadapt) from InfluenzaA__CBW54817__HA
auggagaagaucgugcugcuccuggccaucgucucgcuggugaaguccgaccagaucugcaucggcuaccacgccaacaacucgaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguuccccaacgugagcgagugguccuacaucguggagaagaucaaccccgccaacgaccugugcuaccccgggaacuucaacaacuacgaggagcugaagcaccuccugucgcggaucaaccgcuucgagaagauccagaucaucccgaaguccagcuggcccgaccacgaggccucccugggcgucucguccgccugccccuaccagcggggccccagcuucuaccgcaacgugguguggcucaucaagaagaacgacaccuacccgacgaucaaggaguccuaccacaacaccaaccaggaggaccugcugguccucugggggauccaccaccccaacgacgaggaggagcagaagcggaucuacaagaaccccaccaccuacaucucggugggcacguccacccugaaccagcgccuggugcccaagaucgcgacccggucgaaggucaacgggcaguccggccgcguggaguucuucuggaccauccucaagagcaacgacacgaucaacuucgaguccaacgggaacuucaucgccccggagaacgccuacaagaucgugaagaagggcgacucgaccaucaugaaguccgagcuggaguacggcaacugcagcaccaagugccagacccccaucggggccaucaacacgucgaugcccuuccacaacauccacccccugaccaucggcgagugcccgaaguacgucaaguccaaccggcucgugcuggcgaccgggcugcgcaacagcccccagggcgagggccggcgcaagaagcggggccucuucggggccaucgccggguucaucgagggcggguggcagggcaugguggacggcugguacggguaccaccacuccaacgagcagggcucgggguacgccgccgacaaggaguccacccagaaggcgaucgacggcgucacgaacaaggugaacucgaucaucgacaagaugaacacccaguucgaggccguggggcgcgaguucaacaaccuggagaagcggaucgagaaccugaacaagaagauggaggacggcuuccucgacgucuggaccuacaacgccgagcugcuggugcucauggagaacgagcgcacccuggacuuccacgacuccaacguccggaaccuguacgacaaggugcgccuccagcugcgggacaacgccaaggagcugggcaacgggugcuucgaguucuaccaccgcugcgacaacgagugcauggagagcgugcggaacggcacguacgacuacccccaguacuccgaggaggcccgccucaagcgcgaggagaucucgggggucaagcuggaguccaucggcaccuaccagauccugagcaucuacuccaccguggcgucgucccucgcccuggccaucaugguggccgggcuguuccucuggaugugcagcaacggcucccugcagugccggaucugcaucuga

SEQ ID NO: 14070 - RNA, 1707 nt, Artificial Sequence
  derived and/or modified CDS sequence (AUadapt) from InfluenzaA__CBW54818__HA
auggagaagaucgugcugcuccuggccaucgucucgcuggugaaguccgaccagaucugcaucggcuaccacgccaacaacucgaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguuccccaacgugagcgagugguccuacaucguggagaagaccaaccccgccaacgaccugugcuaccccgggaacuucaacaacuacgaggagcugaagcaccuccugucgcggaucaaccgcuucgagaagaucaagaucaucccgaaguccucguggcccgaccacgaggccucccugggcgucagcuccgccugccccuaccagggcgggcccucguucuaccggaacgugguguggcucaucaagaagaacaacacguacccgaccaucaaggaguccuaccacaacaccaaccaggaggaccugcugguccucuggggcauccaccaccccaacgacgaggaggagcagacccgcaucuacaagaaccccacgaccuacaucucgguggggaccuccacccugaaccagcggcuggugcccaagaucgcgacgcgcagcaaggucaacggccaguccgggcggguggaguucuucuggaccauccucaagucgaacgacaccaucaacuucgaguccaacggcaacuucaucgccccggagaacgccuacaagaucgugaagaagggcgacagcaccaucaugaaguccgagcuggaguacgggaacugcuccacgaagugccagacccccgucggcgccaucaacucguccaugcccuuccacaacauccacccccugaccaucggggagugcccgaaguacgucaagucgaaccgccucgugcuggcgaccggccugcggaacagcccccagggcgaggggcgccggaagaagcgcggccucuucggggccaucgccggcuucaucgagggcggguggcagggcaugguggacgggugguacggcuaccaccacucgaacgagcagggguccggcuacgccgccgaccgggagucgacgcagaaggcgaucgacggggugaccaacaaggugaacuccaucaucgacaagaugaacacccaguucgaggccgucggccgcgaguucaacaaccuggagaagcggaucgagaaccugaacaagaagauggaggacggcuuccucgacguguggaccuacaacgccgagcugcugguccucauggagaacgagcgcacgcuggacuuccacgacagcaacgugaagaaccuguacgacaaggugcggcuccagcugcgcgacaacgccaaggagcuggggaacggcugcuucgaguucuaccaccggugcgacaacgagugcauggaguccguccgcaacgggaccuacgacuacccccaguacucggaggaggcccggcucaagcgcgaggagaucuccggcgugaagcuggagucgaucgggaccuaccagauccuguccaucuacagcaccguggcguccucgcucgcccuggccaucaucgucgccggccugcuccuguggaugugcuccaacggcagccugcagugccgcaucugcaucuga

SEQ ID NO: 14071 - RNA, 1701 nt, Artificial Sequence
  derived and/or modified CDS sequence (AUadapt) from InfluenzaA__CCG47908__HA
augaagaccgugaucgcccugucguacgucuucugccucggcuucgggcagggccugcccgggaagggcaacaacaccgccacgcugugccucgggcaccacgcggugccgaacggcacccuggugaagaccaucaccgacgaccagaucgaggucacgaacgccaccgagcuggugcagaacuucuccaugggcaagaucugcaagaacccccaccgcauccucgacggggccaacugcacccugaucgacagccugcucggcgacccccacugcgacggguuccaggacgagaagugggaccuguucaucgagcgguccaaggccuucucgaacugcuaccccuacgacgugccggaguacaccucccugcgcagcaucaucgccuccucgggcacgcucgaguucaccaacgaggacuucaacuggaccggggucacccagaacggcggcuccagcgcgugcaagcgggggcccaacaacuccuucuucucgcgccugaacuggcuguacaaguccggcaacacguaccccaugcucaacgugaccaugcccaacagcgacgacuucgacaagcuguacaucuggggcgugcaccacccguccaccgaccgggagcagaccaaccuguacauccaggccucggggaagaucaucgucuccacgaagcgcagccagcagaccaucauccccaacaucggcucccggcccugggugcgcgggcucucgagccggaucuccaucuacuggaccaucgugaagcccggcgacauccugaucaucaacucgaacgggaaccugaucgccccgcgcggcuacuucaagauccagaccgggaaguccagcgucaugcgguccgacgcccccaucgacacgugcaacucggagugcaucacccccaacggcuccauccccaacgacaagccguuccagaacgugaaccgcaucaccuacggcgcgugccccaaguacaucaagcagaacacccucaagcuggccacggggaugcggaacauccccgagcgccagacccggggcaucuucggggccaucgccggcuucaucgagaacgggugggagggcauggugaacggcugguacggguuccgccaccagaacagcgagggcaucgggcaggccgcggaccugaaguccacccaggccgccaucaaccagaucaacggcaagcucaaccgggucaucgagaagaccaacgagaaguuccaccagaucgagaaggaguucucggagguggaggggcgcauccaggaccuggagcgguacguggaggacacgaagaucgaccugugguccuacaacgccgagcuccuggucgcccuggagaaccagcacaccaucgaccucaccgacagcgagaugaacaagcuguucgagaagacccgcaagcagcugcgggagaacgcggaggacaugggcaacggcugcuucaagaucuaccacaagugcgacaacuccugcauggagucgauccgcaacgggacguacgaccacaacgaguaccgcgacgaggccgugaacaaccgguuccagaucaaguccguggagcucaagagcggcuacaaggacuggauccuguggaucuccuucgccaucagcugcuuccugcucugcgccgucuggcugggguucaucaucugggccugccagaagggcaacauccgcugcaacaucugcaucuga

SEQ ID NO: 14072 - RNA, 1701 nt, Artificial Sequence
  derived and/or modified CDS sequence (AUadapt) from InfluenzaA__AAB39851__HA
augaaggccauccugcucgugcugcugugcaccuucgccgcgaccaacgccgacacgcucugcaucggcuaccacgccaacaacucgaccgacaccgucgacaccgugcuggagaagaacgugacggucacccacuccgugaaccugcucgaggaccgccacaacgggaagcugugcaagcugggcgggaucgcgccccuccaccugggcaagugcaacaucgccgggcggcugcucggcaacccggagugcgagcugcugcucaccgugagcuccuggucguacaucgucgagaccuccaagagcgacaacggcacgugcuaccccggggacuucaucaacuacgaggagcugcgcgagcagcuguccucgguguccagcuucgagcgguucgagaucuuccccaagaccuccucguggcccaaccacgagaccaaccgcggcgugaccgccgccugcccguacgccggggccaacuccuucuaccggaaccucaucuggcuggucaagaaggagaacagcuaccccaagcuguccaagucguacgugaacaacaagggcaaggaggugcucguccugugggggauccaccacccgcccacguccaccgaccagcagagccuguaccagaacgcggacgccuacguguucgugggcuccucgaaguacaaccgcaaguucaagcccgagaucgccgcccggcccaagguccgcggccaggccgggcggaugagcuacuacuggacccucaucgagcccggcgacaccaucacguucgaggcgaccgggaaccugguggugccccgcuacgccuucgccaugaaccggggcuccggcucggggaucaucaucugggacgccccgguccacgacugcaacaccaagugccagacccccaagggcgccaucaacacgucccugcccuuccagaacauccaccccgugaccaucggggagugcccgaaguacgucaagagcaccaagcuccgcauggcgaccggccugcggaacgugcccuccauccagucgcgcgggcuguucggcgccaucgccggcuucaucgagggcggguggacggggaugaucgacggcugguacggguaccaccaccagaacgagcagggcuccggcuacgccgccgaccagcggagcacccagaacgcgaucgacgggaucaccaacaaggugaacuccgugaucgagaagaugaacacccaguucacggccgucggcaaggaguucaaccaccucgagaagcgcaucgagaaccugaacaagaagguggacgacggguuccuggacaucuggaccuacaacgccgagcuccugguccugcucgagaacgagcggacccuggacuuccacgacucgaacgugaagaaccuguacgagaaggugcgcucccagcuccggaacaacgccaaggagaucggcaacgggugcuucgaguucuaccacaagugcgacgacacgugcauggagagcgucaagaacggcaccuacgacuaccccaaguacuccgaggagucgaagcugaaccgcgaggagaucgacggcgugaagcuggaguccacccggaucuaccagauccucgccaucuacagcaccguggcguccucgcugguccugcucgugucccugggggccaucagcuucuggaugugcagcaacggcucccugcagugccgcaucugcaucuga

SEQ ID NO: 14073 - RNA, 1701 nt, Artificial Sequence
  derived and/or modified CDS sequence (AUadapt) from InfluenzaA__AAA43178__HA
augaagaccaucaucgcccugucguacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagucguccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucucgaacugcuaccccuacgacgugccggacuacgcgucccuccgcagccuggucgccuccucgggcacccuggaguucaucaccgagggguucaccuggacgggcgugacccagaacgggggcuccaacgccugcaagcgggggcccggcagcggcuucuucucccgccucaacuggcugaccaagucgggguccaccuaccccgugcugaacgucacgaugcccaacaacgacaacuucgacaagcucuacaucuggggcauccaccacccgagcaccaaccaggagcagaccucccuguacgugcaggccucggggcgggugaccgucuccacgcgccggagccagcagaccaucauccccaacaucggcucgcgccccugggugcggggccuguccagccgcaucuccaucuacuggaccaucgugaagcccggggacguccucgugaucaacucgaacggcaaccugaucgcgccgcggggguacuucaagaugcgcaccggcaaguccagcaucaugcgguccgacgcccccaucgacacgugcaucucggagugcaucacccccaacggguccauccccaacgacaagccguuccagaacgugaacaagaucaccuacggcgccugccccaaguacgucaagcagaacacccugaagcucgccacgggcaugcgcaacgugcccgagaagcagacccgggggcuguucggcgccaucgcgggguucaucgagaacggcugggaggggaugaucgacggcugguacggcuuccgccaccagaacagcgaggggaccggccaggccgccgaccugaaguccacccaggccgccaucgaccagaucaacgggaagcucaaccgggugaucgagaagacgaacgagaaguuccaccagaucgagaaggaguucucggaggucgagggccgcauccaggaccuggagaaguacguggaggacaccaagaucgaccugugguccuacaacgcggagcuccugguggcccuggagaaccagcacaccaucgaccucaccgacagcgagaugaacaagcuguucgagaagacgcggcgccagcugcgggagaacgccgaggagauggggaacggcugcuucaagaucuaccacaagugcgacaacgccugcaucgaguccauccgcaacggcaccuacgaccacgacgucuaccgcgacgaggcccucaacaaccgguuccagaucaaggggguggagcucaagucgggcuacaaggacuggauccuguggaucuccuucgcgaucagcugcuuccugcugugcgucgugcugcucggguucaucaugugggccugccagcgcggcaacauccggugcaacaucugcaucuga

SEQ ID NO: 14074 - RNA, 1689 nt, Artificial Sequence
  derived and/or modified CDS sequence (AUadapt) from InfluenzaA__AAA43185__HA
auggccaucaucuaccugauccuccuguucaccgccgugcgcggcgaccagaucugcaucggguaccacgcgaacaacucgaccgagaaggucgacacgaaccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugucgguccccgagugguccuacaucauggagaaggagaacccccgggacggccucugcuacccggggucguucaacgacuacgaggagcugaagcaccuccuguccucggugaagcacuucgagaaggugaagauccugcccaaggaccgcuggacgcagcacaccaccaccggcgggucccgggccugcgccgucucgggcaaccccuccuucuuccgcaacaugguguggcugacgaaggaggggucggacuaccccguggcgaagggcuccuacaacaacaccagcggcgagcagaugcucaucaucuggggcguccaccacccgaucgacgagaccgagcagcggacccuguaccagaacguggggacguacguguccgucgggaccucgacccugaacaagcgcuccacccccgagaucgccacgcggcccaaggugaacggccagggcgggcgcauggaguucucguggacccuccuggacaugugggacaccaucaacuucgaguccaccggcaaccugaucgcccccgaguacggguucaagaucucgaagcggggcuccucggggaucaugaagacggagggcacccucgagaacugcgagaccaagugccagaccccgcugggcgccaucaacacgacccugcccuuccacaacgugcacccccucaccaucggggagugccccaaguacgucaagucggagaagcuggugcuggcgaccggccuccgcaacgugccgcagaucgagucccgggggcuguucggcgccaucgccggguucaucgagggcggcuggcaggggauggucgacggcugguacggguaccaccacagcaacgaccagggcuccggguacgccgccgacaaggagucgacgcagaaggcguucgacggcaucaccaacaaggugaacuccgugaucgagaagaugaacacccaguucgaggccgucggcaaggaguucgggaaccuggagcgccggcucgagaaccugaacaagcgcauggaggacggcuuccuggacguguggaccuacaacgccgagcuccuggugcugauggagaacgagcggacgcucgacuuccacgacucgaacgucaagaaccuguacgacaaggugcgcaugcagcugcgggacaacgucaaggagcucgggaacggcugcuucgaguucuaccacaagugcgacgacgagugcaugaacuccgugaagaacggcaccuacgacuaccccaaguacgaggaggagucgaagcugaaccgcaacgagaucaagggggugaagcuguccucgaugggcgucuaccagauccucgccaucuacgccaccguggcggggucccugucgcuggccaucaugauggccggcaucuccuucuggaugugcagcaacgggucccuccagugccggaucugcaucuga

SEQ ID NO: 14075 - RNA, 1701 nt, Artificial Sequence
  derived and/or modified CDS sequence (AUadapt) from InfluenzaA__AAA43187__HA
augaagaccaucaucgcccugucgcacaucuucugccucgugcugggccaguaccugcccgggaacgacaacuccaccgccacgcucugccugggccaccacgcggucccgaacgggacccuggugaagaccaucaccaacgaccagaucgaggugacgaacgccaccgagcucguccagucguccagcaccggcaagaucugcaacaacccccaccgcauccuggacgggaucgacugcacccugaucgacgcccuccugggcgacccccacugcgacggcuuccagaacgagacgugggaccuguucguggagcgguccaaggccuucucgaacugcuaccccuacgacgugccggacuacgccucccuccgcagccuggucgcguccucggggacccuggaguucaucaccgagggcuucaccuggacgggggugacccagaacggcggguccaacgccugcaagcggggccccggcagcggguucuucucccgccucaacuggcugaccaagucggaguccaccuaccccgugcugaacgucacgaugcccaacaacgacaacuucgacaagcucuacaucuggggcgugcaccacccgagcaccaaccaggagcagaccucccuguacgugcaggccucggggcgggucaccguguccacgcgccggagccagcagaccaucauccccaacaucggcucgcgccccugggugcggggccuguccagccgcaucuccaucuacuggaccaucgucaagcccggggacgugcucgugaucaacucgaacgccaaccugaucgcgccgcggggcuacuucaagaugcgcaccgggaaguccagcaucaugcgguccgacgcccccaucgacacgugcaucucggagugcaucacccccaacggcuccauccccaacgacaagccguuccagaacgucaacaagaucaccuacggggccugccccaaguacgugaagcagaacacccugaagcucgccacgcgcaugcggaacgugcccgagaagcagacccgcggccuguucggcgccaucgcgggguucaucgagaacggcugggaggggaugaucgacggcugguacggguuccggcaccagaacagcgagggcaccggccaggccgccgaccugaaguccacccaggccgccaucgaccagaucaacgggaagcucaaccgcgucaucgagaagacgaacgagaaguuccaccagaucgagaaggaguucucggagguggagggccggauccaggaccuggagaaguacguggaggacaccaagaucgaccugugguccuacaacgcggagcuccuggucgcccuggagaaccagcacaccaucgaccucaccgacagcgagaugaacaagcuguucgagaagacgcgccggcagcugcgcgagaacgccgaggacauggggaacggcugcuucaagaucuacgacaagugcgacaacgccugcaucgaguccauccgcaacgggaccuacgaccacgacguguaccgggacgaggcccucaacaaccgcuuccagaucaagggcgucgagcucaagucgggcuacaaggacuggauccuguggaucuccuucgcgaucagcugcuuccugcugugcguggugcugcucggguucaucaugugggccugccagcggggcaacauccgcugcaacaucugcaucuga

SEQ ID NO: 14076 - RNA, 1698 nt, Artificial Sequence
  derived and/or modified CDS sequence (AUadapt) from InfluenzaA__AAA43209__HA
augaaggccaagcugcucgugcugcuguacgccuucgucgcgaccgacgccgacaccaucugcaucggcuaccacgccaacaacucgacggacaccguggacaccaucuucgagaagaacguggccgucacccacuccgugaaccuccuggaggaccgccacaacgggaagcugugcaagcucaagggcaucgcgccccugcagcuggggaagugcaacaucacgggcuggcuccuggggaacccggagugcgacagccugcuccccgcccgguccuggagcuacaucguggagacccccaacuccgagaacggcgccugcuaccccggcgacuucaucgacuacgaggagcugcgcgagcagcugagcuccgucucgucccucgagcgguucgagaucuucccgaaggagagcuccuggcccaaccacaccuucaacggggugaccgugagcugcucccaccgcggcaagagcuccuucuaccggaaccugcuguggcucacgaagaagggggacucguaccccaagcugaccaacuccuacgucaacaacaagggcaaggaggugcuggugcucuggggcguccaccaccccagcuccagcgacgagcagcagagccuguacuccaacgggaacgccuacgugagcguggccuccucgaacuacaaccgccgguucaccccggagaucgcggcccgccccaaggucaaggaccagcacggccggaugaacuacuacuggacccugcucgagcccggggacacgaucaucuucgaggccaccggcaaccugaucgcccccugguacgccuucgcgcugucccgcggguucgagagcggcaucaucaccuccaacgccagcaugcacgagugcaacaccaagugccagacgccgcagggcuccaucaacagcaaccuccccuuccagaacauccaccccgugaccaucggggagugccccaaguacgugcgguccaccaagcugcgcauggucaccggccugcggaacaucccgucgauccaguaccgcggccucuucggggccaucgccggguucaucgagggcggcuggacggggaugaucgacggcugguacggguaccaccaccagaacgagcagggcuccggguacgccgcggaccagaaguccacccagaacgccaucaacggcaucaccaacaaggugaacagcgugaucgagaagaugaacacccaguucacggccgucggcaaggaguucaacaaccuggagaagcggauggagaaccugaacaagaagguggacgacggguuccucgacaucuggaccuacaacgccgagcugcuggugcuccuggagaacgagcgcacccuggacuuccacgaccucaacgucaagaaccuguacgagaaggucaagagccagcugaagaacaacgccaaggagaucggcaacgggugcuucgaguucuaccacaagugcgacaacgagugcauggaguccgugcggaacggcaccuacgacuaccccaaguacagcgaggaguccaagcucaaccgcgagaagaucgacggggugaagcuggagucgaugggcguguaccagauccuggcgaucuacagcacggucgccuccagccucgugcugcuggugucccucggcgccaucagcuucuggaugugcuccaacgggagccugcagugccggaucugcaucuga

SEQ ID NO: 14077 - RNA, 1683 nt, Artificial Sequence
  derived and/or modified CDS sequence (AUadapt) from InfluenzaA__AAC40998__HA
augaauacccaaauccugauccucgcccugguggccaucauccccaccaacgcggacaagaucugccugggccaccacgccgucagcaauggggccaaggugaacacgcucaccgagcgcggcguggaggucgugaacgccaccgagaccguggagcggacgaacgucccgcgcaucugcuccaaggggaagcggaccguggaccugggccagugcgggcugcucggcaccaucaccggcccgccccagugcgaucaguuccuggaguucagcgccgaccugaucaucgagcgccgggaggggaacgacgugugcuaucccggcaaguucgucaacgaggaggcgcuccgccagauccugcggaaguccgggggcaucgacaaggagacgaugggguucaccuacagcggcauccgcaccaacggcgccaccuccgccugucggcgcagcggguccagcuucuacgccgaaaugaaguggcugcucuccaacacggacaacgcggccuuuccccagaugaccaagagcuacaagaacauccggaaggaccccgcccugaucaucuggggcauccaccacuccgggagcaccgccgagcagaccaagcuguauggcuccggcaacaagcucaucacgguggggagcuccaacuaccagcagagcuucgugcccucccccggcgcccgcccgcaggucaacgggcagaguggccggaucgacuuccacuggcugaugcugaaccccaacgacaccgugaccuucuccuuuaacggggcguucaucgcccccgaccgcgccagcuuccuccggggcaagagcaugggcauccaguccgaggugcaggucgacgccaauugcgagggggacugcuaccacagcggcgggaccauccuguccagucugcccuuccagaacaucaacucccgcacggugggcgagugcccgcgguacgugaagcaggaaagccuccugcuggccaccgggaugaagaacguccccgagauccccaagggccgcggccucuuuggggcgaucgccggcuucaucgagaacgggugggagggccugguggacgggugguacggcuuccggcaccagaacgcccagggcgaggggaccgccgccgauuacaaguccacccagagcgcgaucgaccagaucacgggcaagcugaaccgccucaucgagaagaccaaccagcaguucgagcugaucgacaaugaguucaccgagguggagaagcaaaucgggaacgucaucaacuggacccgggacucccugacggagauguggagcuacaacgccgagcuccugguggccauggagaaucagcacaccaucgaccuggccgacuccgagaugaacaagcucuacgagcgcgugcgccggcagcugcgcgagaacgccgaggaggacggcaccggcuguuucgagaucuuccacaagugcgacgacgacuguauggcgagcauccggaacaacaccuacgaccacuccaaguaccgcgaggaggccauccagaaucggauccagaucgaccccgucaagcugagcuccggguacaaggacgugauccucugguucagcuucggcgccuccuguuucauccugcuggccaucgcgauggggcucgucuucaucugcgugaagaacggcaacaugcgcugcacgaucugcaucuga

SEQ ID NO: 14078 - RNA, 1683 nt, Artificial Sequence
  derived and/or modified CDS sequence (AUadapt) from InfluenzaA__AAC40999__HA
augaauacccaaauccugauccucgcccugguggccaucauccccaccaacgcggacaagaucugccugggccaccacgccgucagcaaugggacgaaggugaacacccucaccgagcgcggcguggaggucgugaacgccaccgagacgguggagcggaccaacgucccgcgcaucugcuccaaggggaagcggaccguggaccugggccagugcgggcugcucggcaccaucacgggcccgccccagugcgaucaguuccuggaguucagcgccgaccugaucaucgagcgccgggagggggacgacguguguuaccccggcaaguucgucaacgaggaggcccuccgccagauccugcgggaguccgggggcaucgacaaggagaccaugggguucaccuacagcggcauccgcaccaauggcgcgacguccgccugccggcgcagcggguccagcuucuacgccgagaugaaguggcugcucuccaacaccgauaacgccgcguucccccagaugaccaagagcuacaagaacauccggaaggaccccgcccugaucaucuggggcauccaccauuccgggagcaccgccgagcagacgaagcuguacggcuccggcaacaagcucaucaccguggggagcuccaacuaccagcagaguuucgugcccauccccggcgcccgcccgcaggucaacgggcaguccggccggaucgacuuccacuggcugaugcugaaccccaacgauaccgugaccuucagcuucaacggggccuucaucgcgcccgaccgcgccuccuuucuccggggcaagagcaugggcauccagagcgaggugcaggucgacgccaacugcgagggggacugcuaucacuccggcgggacgauccugaacaaccugcccuuccagaacaucaacggccgcgccguggggaaguguccgcgguacgugaagcaggaaagccuccugcuggccaccggcaugaagaacguccccgagauccccaagggccgcggccucuucggggcgaucgccggguucaucgagaacggcugggaggggcugguggacggcugguauggcuuccggcaccagaacgcccagggggagggcaccgccgccgacuacaaguccacccagagcgcgaucgaucagaucacggggaagcugaaccgccucaucgagaagaccaaccagcaguucgagcugaucgacaacgaguucaccgagguggagaagcagaucggcaacgucaucaauuggacccgggacuccaugacggagguguggagcuacaacgccgagcugcucguggccauggagaaccagcacaccaucgaucuggccgacuccgagaugaacaagcuguacgagcgcguccgccggcagcuccgcgagaacgccgaggaggacggcaccgggugcuucgagaucuuucacaagugcgacgacgacugcauggcgaguauccggaacaacaccuacgaccacuccaaguaccgcgaggaggccauccagaaccggauccagaucgaucccgugaagcugagcuccggcuacaaggacgucauccugugguucagcuucggggccuccuguuucauccuccuggccaucgcgaugggccugguguucaucugcgugaagaacgggaacaugcgcugcacgaucugcaucuga

SEQ ID NO: 14079 - RNA, 1758 nt, Artificial Sequence
  derived and/or modified CDS sequence (AUadapt) from InfluenzaB__InfluBV(Brisbane2008)-HA
augaaggccaucaucgugcugcucauggucgugaccaguaacgccgaccggaucugcaccggcaucacguccucgaacuccccgcacguggucaagaccgcgacccagggggaggugaacgugaccggcgucaucccgcugacgaccacccccaccaagagccacuucgccaaccugaaggggacggagacccgcggcaagcucugccccaagugucugaacugcaccgaccuggacguggcccucgggcggcccaagugcaccggcaagaucccguccgcccgcgugucgauccugcacgagguccggcccgugacguccggcugcuuccccaucaugcacgaccgcaccaagauccggcagcugcccaaccuccugcgcggguaugagcacauccggcugagcacccacaacgugaucaacgccgagaacgcgccgggcgggcccuacaagaucggcaccuccgggucgugccccaacaucacgaacggcaacggcuuuuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguauggggacagcaagccccagaaguucacguccucggccaacggcgucaccacccacuacgugucccagaucggcggguuccccaaccagaccgaggacggcgggcugccgcagucgggccgcaucguggucgacuauauggugcagaaguccgggaagacgggcaccaucaccuaccagcggggcauccuccugccccagaagguguggugcgccagcgggcgcuccaaggucaucaagggcucgcugccccucaucggggaggccgacugccugcacgagaaguacggcgggcugaacaagagcaagcccuacuacaccggcgagcaugcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagaguacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucaguucccagaucgagcucgccgugcugcugucgaacgaggggaucaucaacuccgaggacgagcaccuccuggcgcuggagcggaagcucaagaagaugcugggcccgagcgccguggagaucgggaacggcugcuucgagaccaagcacaagugcaaccagaccugucuggaccgcaucgccgccgggaccuucgacgcgggcgaguucucccuccccacguucgacucgcugaacaucaccgccgccucccugaacgacgacggccuggacaaucacaccauccuccuguacuacagcaccgccgccuccucgcuggcggucacgcucaugaucgccaucuucgugguguacauggucucccgggacaacgugagcugcuccaucugccuguga

SEQ ID NO: 14080 - RNA, 1755 nt, Artificial Sequence
  derived and/or modified CDS sequence (AUadapt) from InfluenzaB__InfluBV(Phuket-3073-2013)-HA
augaaggccaucaucgugcugcucauggucgugaccaguaacgccgaccgcaucugcaccggcaucacguccagcaacuccccgcacguggucaagaccgcgacccagggggaggugaacgugaccggcgucaucccccugacgaccacccccaccaagaguuacuucgccaaccugaaggggacgcggacccgcggcaagcucugccccgacugccugaacuguaccgaccuggacguggcccucgggcggcccaugugcgugggcaccacgccguccgccaaggccagcauccugcacgagguccgccccgugaccuccggcugcuuccccaucaugcacgaucggaccaagauccgccagcugcccaaccuccugcggggguacgagaagauccgccugagcacccagaacgugaucgacgcggagaaggccccgggcgggcccuaccggcucggcacguccgggagcugucccaacgccaccuccaagaucggcuucuucgccaccauggcgugggccguccccaaggacaacuacaagaacgccaccaacccgcugacgguggaggugcccuauaucugcaccgagggcgaggaccagaucaccgucuggggguuccacagcgacaacaagacccagaugaagucccuguauggcgacucgaacccccagaaguucacguccagcgccaacggggugaccacccacuacgugucccagaucggcgauuuccccgaccagaccgaggacggcgggcucccgcagagcggccgcaucgucguggacuacaugaugcagaagcccgggaagacgggcaccaucguguaccagcggggcguccugcugccccagaagguguggugugccuccgggcgcagcaaggugaucaagggcagccucccccugaucggggaggcggacugccugcacgaggaguacggcgggcucaacaaguccaagccguacuauaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuucuggagggcgggugggaggggaugaucgccggcuggcacggcuacaccagccacggggcccacggcguggccgucgcggccgaccucaaguccacccaggaggccaucaacaagaucaccaagaaccugaauagccuguccgagcucgaggugaagaaccugcagcggcugucgggggccauggacgagcuccacaacgagauccuggagcuggacgagaagguggaugaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggauaucgggaacggcugcuucgagaccaagcacaagugcaaccagaccugccucgaucgcaucgccgcggggaccuucaacgccggcgaguucagccugcccaccuucgacucccugaacaucacggccgccagccugaaugacgacgggcucgacaaccacaccauccugcuguacuacuccaccgccgcgaguucccucgccgugacccugaugcuggccaucuucaucgucuacauggugagccgggacaacguguccugcagcaucugccucuga

SEQ ID NO: 14081 - RNA, 1755 nt, Artificial Sequence
  derived and/or modified CDS sequence (AUadapt) from InfluenzaB__InfluBV(Phuket-3073-2013)-HA(N211D)
augaaggccaucaucgugcugcucauggucgugaccaguaacgccgaccgcaucugcaccggcaucacguccagcaacuccccgcacguggucaagaccgcgacccagggggaggugaacgugaccggcgucaucccccugacgaccacccccaccaagaguuacuucgccaaccugaaggggacgcggacccgcggcaagcucugccccgacugccugaacuguaccgaccuggacguggcccucgggcggcccaugugcgugggcaccacgccguccgccaaggccagcauccugcacgagguccgccccgugaccuccggcugcuuccccaucaugcaugaccggaccaagauccgccagcugcccaaccuccugcggggguacgagaagauccgccugagcacccagaacgugaucgacgcggagaaggccccgggcgggcccuaccggcucggcacguccgggaguugccccaacgccaccuccaagaucggcuucuucgccaccauggcgugggccguccccaaggacaacuacaagaaugccaccaacccgcugacgguggaggugcccuacaucugcaccgagggcgaggaccagaucaccgucuggggguuccacagcgaugacaagacccagaugaagucccuguacggcgacagcaacccccagaaguucacguccagcgccaauggggugaccacccacuacgugucccagaucggcgacuuccccgaccagaccgaggacggcgggcucccgcagagcggccgcaucgucguggauuacaugaugcagaagcccgggaagacgggcaccaucguguaccagcggggcguccugcugccccagaagguguggugcgccuccgggcgcagcaaggugaucaagggcucgcucccccugaucggggaggcggacugccugcaugaggaguacggcgggcucaacaaguccaagccguacuacaccggcaagcacgccaaggccaucgggaacugccccaucugggucaagaccccgcugaagcuggccaauggcacgaaguaccggcccccggccaagcuccugaaggagcgcggcuucuucggggcgaucgccggcuuccuggagggcgggugggaggggaugaucgccggcuggcacggcuacaccagccauggggcccacggcguggccgucgcggccgaccucaaguccacccaggaggccaucaacaagaucaccaagaaccugaacagccuguccgagcucgaggugaagaaccugcagcggcugaguggggccauggacgagcuccacaacgagauccuggagcuggacgagaagguggacgaccuccgcgccgacacgaucuccagucagaucgagcuggcgguccugcucuccaacgagggcaucaucaacagcgaggacgagcaccuccuggcccucgagcggaagcugaagaagaugcugggccccuccgccguggacaucgggaacggcuguuucgagaccaagcacaagugcaaccagaccugccucgaccgcaucgccgcggggaccuucaaugccggcgaguucagccugcccaccuucgacucccugaacaucacggccgccagccugaacgaugacgggcucgacaaccacaccauccugcuguacuacuccaccgccgcgagcucccucgccgugacccugaugcuggccaucuuuaucgucuacauggugagccgggacaacguguccugcagcaucugccucuga

SEQ ID NO: 14082 - RNA, 1755 nt, Artificial Sequence
  derived and/or modified CDS sequence (AUadapt) from InfluenzaB__InfluBV(B-Lee-40)-HA
augaaggccaucaucgugcugcucauggucgugaccaguaacgccgaccgcaucugcaccggcaucacguccucgaacuccccgcacguggucaagaccgcgacccagggggaggugaacgugaccggcgucaucccgcugacgaccacccccaccaagucgcacuucgccaaccugaaggggacgcagacccggggcaagcucugccccaacugcuucaacugcaccgaccuggacguggcccuggggcgccccaagugcaugggcaacaccccguccgccaaggugucgauccuccacgaggucaagcccgccacguccggcugcuuccccaucaugcacgaccggaccaagauccgccagcugcccaaccugcuccggggguacgagaacauccgccugagcaccuccaacgugaucaacaccgagacggcgcccggcgggcccuacaaggugggcaccucgggguccugccccaacgucgccaacggcaacggcuucuucaacaccauggccugggugauccccaaggacaacaacaagaccgccaucaaccccgugacggucgaggugcccuacaucugcagugagggggaggaccagaucaccguguggggcuuccacuccgacgacaagacccagauggagcggcuguacggggacucgaacccccagaaguucaccuccagcgcgaacggcgucacgacccacuacgugucccagaucggcggguuccccaaccagaccgaggacgagggccucaagcagucggggcgcaucguggucgacuacauggugcagaagccgggcaagaccgggacgaucguguaccagcggggcauccugcugccccagaaggucuggugcgccuccggccgcucgaaggugaucaaggggucgcucccccugaucggcgaggccgacugccugcacgagaaguacgggggccucaacaaguccaagcccuacuacaccggggagcacgccaaggccaucggcaacugcccgaucugggucaagaccccgcugaagcuggcgaacggcaccaaguaccggccgcccgccaagcuccugaaggagcgcggguucuucggcgccaucgccggguuccuggagggcgggugggagggcaugaucgccggcuggcacggguacacgagccacggcgcgcacgggguggccguggccgccgaccucaaguccacccaggaggccaucaacaagaucaccaagaaccugaacuaucugucggagcucgaggucaagaaccugcagcggcuguccggcgcgaugaacgagcuccacgacgagauccuggagcuggacgagaagguggacgaccuccgcgccgacaccaucucgucccagaucgagcuggccgugcugcucucgaacgagggcaucaucaacuccgaggacgagcaccugcuggcccucgagcggaagcugaagaagaugcuggggccgagcgccgucgagaucggcaacgggugcuucgagacgaagcacaagugcaaccagaccugccucgaccgcaucgcggccggcaccuucaacgccggggacuucucccugcccaccuucgacucgcugaacaucaccgccgcgucccucaacgacgacggccuggacaaccacacgauccugcuguacuacucgaccgccgccuccucgcucgccgugacccugaugaucgccaucuucaucguguacauggucucccgggacaacgugagcugcuccaucugccuguga

SEQ ID NO: 14083 - RNA, 1755 nt, Artificial Sequence
  derived and/or modified CDS sequence (AUadapt) from InfluenzaB__InfluBV(B-Lee-40)-HA(K53R,T91I,A105V,T142A,G164R,Y415 S,E433G,G542D)
augaaggccaucaucgugcugcucauggucgugaccaguaacgccgaccgcaucugcaccggcaucacguccucgaacuccccgcacguggucaagaccgcgacccagggggaggugaacgugaccggcgucaucccgcugacgaccacccccacccggagccacuucgccaaccugaaggggacgcagacccggggcaagcucugccccaacugcuucaacugcaccgaccuggacguggcccuggggcgccccaagugcaugggcaacaucccguccgccaaggugucgauccuccacgaggucaagcccgugacguccggcugcuuccccaucaugcacgaccggaccaagauccgccagcugcccaaccugcuccggggguaugagaacauccgccugagcaccuccaacgugaucaacgccgagacggcgcccggcgggcccuacaaggugggcaccucgggguccugccccaacgucgccaaccgcaacggcuucuucaacaccauggccugggugauccccaaggacaacaacaagaccgccaucaaccccgugacggucgaggugcccuacaucugcucggagggggaggaccagaucaccguguggggcuuccacuccgacgacaagacccagauggagcggcuguacggggacagcaacccccagaaguuuaccuccucggcgaacggcgucacgacccacuacgugucccagaucggcggguuccccaaccagaccgaggacgagggccucaagcagagcgggcgcaucguggucgacuacauggugcagaagccgggcaagaccgggacgaucguguaccagcggggcauccugcugccccagaaggucuggugcgccuccggccgcucgaaggugaucaaggggucgcucccccugaucggcgaggccgacugccugcacgagaaguacgggggccucaacaaguccaagcccuacuacaccggggagcacgccaaggccaucggcaacugcccgaucugggucaagaccccgcugaagcuggcgaacggcaccaaguaccggccgcccgccaagcuccugaaggagcgcggguucuucggcgccaucgccggguuccuggagggcgggugggagggcaugaucgccggcuggcauggguacacgagccacggcgcgcacgggguggccguggccgccgaccucaaguccacccaggaggccaucaacaagaucaccaagaaccugaacucgcugagcgagcucgaggucaagaaccugcagcggcuguccggcgcgaugaacggccuccacgacgagauccuggagcuggacgagaagguggacgaccuccgcgccgacaccaucucgucccagaucgagcuggccgugcugcucucgaacgagggcaucaucaacuccgaggacgagcaccugcuggcccucgagcggaagcugaagaagaugcuggggccgagcgccgucgagaucggcaacgggugcuucgagacgaagcacaaguguaaccagaccugccucgaccgcaucgcggccggcaccuucaacgccggggacuucucccugcccaccuucgacucgcugaacaucaccgccgcgucccucaacgacgacgaccuggacaaccacacgauccugcuguacuacagcaccgccgccuccucgcucgccgugacccugaugaucgccaucuucaucguguacauggucucccgggacaacgugagcugcuccaucugccuguga

SEQ ID NO: 14084 - RNA, 1755 nt, Artificial Sequence
  derived and/or modified CDS sequence (AUadapt) from InfluenzaB__H0N0(Massachusetts2012)-HA
augaaggccaucaucgugcugcucauggucgugaccaguaacgccgaccgcaucugcaccggcaucacguccagcaacuccccgcacguggucaagaccgcgacccagggggaggugaacgugaccggcgucaucccccugacgaccacccccaccaagaguuacuucgccaaccugaaggggacgaagacccggggcaagcucugccccgacugccugaacuguaccgaccuggacguggcccucgggcgccccaugugcgugggcaccacgccguccgccaaggccagcauccugcacgagguccggcccgugaccuccggcugcuuccccaucaugcaugaccgcaccaagauccggcagcuggcgaaccuccugcgcggguacgagaacauccggcugagcacccagaacgugaucgacgccgagaaggcccccggcgggccguaucgccucggcacguccgggucgugccccaacgccaccuccaagagcggcuucuucgcgaccauggccugggccguccccaaggacaauaacaagaacgccaccaacccccugacgguggaggugccguacaucugcgccgagggcgaggaccagaucaccgucuggggguuccauuccgacgacaagacccagaugaagaaccuguacggcgacagcaacccccagaaguuuaccuccagcgcgaacggggugacgacccacuacgugucccagaucggcggcuuccccgaccagaccgaggacgggggccucccccagagugggcggaucgucguggacuacaugaugcagaagccgggcaagaccgggacgaucguguaccagcgcggcguccugcugccccagaagguguggugcgccuccggccggagcaaggugaucaaggggucgcucccccugaucggcgaggccgacugucugcacgagaaguacgggggccucaacaaguccaagccguacuacaccggggagcacgccaaggccaucggcaacugucccaucugggucaagaccccgcugaagcuggcgaacggcaccaaguaccgcccgcccgccaagcuccugaaggagcggggguucuucggcgccaucgccggguuccuggagggcgggugggagggcaugaucgccggcuggcacggguacacgagucacggcgcgcacgggguggccgucgccgccgaccucaaguccacccaggaggccaucaacaagaucaccaagaaccugaacagccuguccgagcucgaggugaagaaucugcagcgccugagcggcgcgauggacgagcuccacaacgagauccuggagcuggacgagaagguggacgaccuccgggccgauaccaucuccagccagaucgagcuggccguccugcucuccaacgagggcaucaucaacucggaggacgagcaccugcuggcccucgagcgcaagcugaagaagaugcuggggccguccgcgguggacaucggcaaugggugcuucgagacgaagcacaagugcaaccagaccugccucgaccggaucgccgccggcaccuuuaacgccggggaguucagccugcccaccuucgacucccugaacaucaccgccgcgagccugaaugacgacggccucgacaaccacacgauccugcuguacuacuccaccgccgccaguucccucgccgugacccugaugcuggccaucuucaucgucuacauggugagccgcgacaacguguccugcagcaucugccucuga

SEQ ID NO: 14085 - RNA, 1758 nt, Artificial Sequence
  derived and/or modified CDS sequence (AUadapt) from InfluenzaB__ACN29380__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugucccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaucuccugcggggguacgagcacauccgccugucgacccacaacgugaucaacgccgagaacgcgccgggcgggcccuacaagaucggcaccuccgggagcugccccaacaucacgaacggcaauggcuucuucgccaccauggccugggccguccccaagaacgacaagaacaagaccgcgaccaacccgcucacgaucgaggugcccuacaucugcaccgagggggaggaccagaucaccguguggggcuuccacuccgacaaugagacccagauggccaagcuguacggggacucgaagccccagaaguucacguccucggccaacggcgucaccacccacuacgugucccagaucggcggguuccccaaccagaccgaggacggcgggcugccgcagagcggccggaucguggucgauuacauggugcagaaguccgggaagacgggcaccaucaccuaccagcgcggcauccuccugccccagaagguguggugcgccucggggcgguccaaggucaucaagggcagccugccccucaucggggaggccgacugccugcacgagaaguacggcgggcugaacaagucgaagcccuacuauaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcguggccgucgccgcggaucugaaguccacccaggaggccaucaacaagaucacgaagaaccucaacucccugagcgagcuggaggugaagaaccuccagcgccuguccggcgccauggacgagcugcacaacgagauccucgagcuggacgagaaggucgacgaccugcgggccgacaccaucaguucccagaucgagcucgccgugcugcugucgaacgaggggaucaucaacuccgaggacgagcaccuccuggcgcuggagcgcaagcucaagaagaugcugggccccagcgccguggagaucgggaacggcugcuucgagaccaagcacaagugcaaccagaccugucuggaccggaucgccgccgggaccuucgacgcgggcgaguucucccuccccacguucgacucgcugaacaucaccgccgccucccugaacgacgacggccucgacaaucacaccauccugcuguacuacagcaccgccgccuccucgcuggcggucacgcucaugaucgccaucuucgugguguacauggucucccgcgacaacgugagcugcuccaucugccuguga

SEQ ID NO: 14086 - RNA, 1758 nt, Artificial Sequence
  derived and/or modified CDS sequence (AUadapt) from InfluenzaB__EPI498048__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccacuuugccaaccugaaggggacggagacccggggcaagcucugccccaagugccugaacugcaccgaccuggacguggcccucgggcgccccaagugcaccggcaagaucccguccgcccgggugucgauccugcacgagguccgccccgugacguccggcugcuuucccaucaugcacgaccggaccaagauccgccagcugcccaaccuccugcggggguacgagcacauccgccugagcacccacaacgugaucaacgccgagaacgcgccgggcgggcccuacaagaucggcaccuccgggaguugccccaacaucacgaacggcaacggcuucuucgccaccauggccugggccguccccaagaacgacaagaacaagaccgcgaccaacccgcucacgaucgaggugcccuacaucuguaccgagggggaggaccagaucaccguguggggcuuccacuccgacagcgagacccagauggccaagcuguacggggacuccaagccccagaaguucacgucguccgccaacggcgucaccacccacuaugugagccagaucggcggguuccccaaccagaccgaggacggcgggcugccgcaguccggccggaucguggucgacuacauggugcagaaguccgggaagacgggcaccaucaccuaccagcgcggcauccuccugccccagaagguguggugcgccuccgggcggucgaaggucaucaagggcagccugccccucaucggggaggccgacugucugcacgagaaguacggcgggcugaacaaguccaagcccuacuacaccggcgagcacgcgaaggccaucggcaacugcccgaucugggugaagacgccccucaagcuggccaacgggaccaaguaccgcccgcccgccaagcugcucaaggagcggggcuucuuuggggccaucgcgggcuuccuggagggcgggugggagggcaugaucgccggguggcacggcuacaccucgcacggggcccacggcguggccgucgccgcggaccugaaguccacccaggaggccaucaacaagaucacgaagaaccucaacagccuguccgagcuggaggugaagaaucuccagcgccugucgggcgccauggacgagcugcacaacgagauccucgagcuggacgagaaggucgacgaccugcgggccgacaccaucuccagccagaucgagcucgccgugcugcuguccaacgaggggaucaucaacagugaggacgagcaccuccuggcgcuggagcgcaagcucaagaagaugcugggccccuccgccguggagaucgggaacggcugcuucgagaccaagcacaagugcaaccagaccugccuggaccggaucgccgccgggaccuucgaugcgggcgaguucagccuccccacguucgacucccugaacaucaccgccgccucgcugaacgacgacggccucgacaaccauaccauccugcuguacuacuccaccgccgccagcucccuggcggucacgcucaugaucgccaucuucgugguguacauggucucgcgcgacaacguguccugcagcaucugccuguga

SEQ ID NO: 14087 - RNA, 1758 nt, Artificial Sequence
  derived and/or modified CDS sequence (AUadapt) from InfluenzaB__ANC28539__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuuugccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuucccaucaugcacgaccggaccaagauccgccagcugcccaaccuccugcggggguacgagcacauccgccugucgacccacaacgugaucaacgccgagaacgcgccgggcgggcccuacaagaucggcaccuccgggaguugccccaacaucacgaacggcaacggcuucuucgccaccauggccugggccguccccaagaacgacaagaacaagaccgcgaccaacccgcucacgaucgaggugcccuacaucuguaccgagggggaggaccagaucaccguguggggcuuccacuccgacaacgaggcccagauggccaagcuguacggggacucgaagccccagaaguucaccuccagcgccaacggcgucacgacccauuacgugucccagaucggcggguuccccaaccagaccgaggacggcgggcugccgcagucgggccggaucguggucgacuacauggugcagaaguccgggaagaccggcacgaucaccuaccagcgcggcauccuccugccccagaagguguggugcgccagcgggcgguccaaggucaucaagggcucgcugccccucaucggggaggcggauugccugcacgagaaguacggcgggcugaacaagagcaagcccuacuacaccggcgagcacgccaaggccaucggcaacugcccgaucugggugaagacgccccucaagcuggccaacgggaccaaguaucgcccgcccgccaagcugcucaaggagcggggcuucuucggggcgaucgccggcuuccuggagggcgggugggagggcaugaucgccggguggcacggcuacaccucccacggggcccacggcguggccgucgcggccgaccugaaguccacccaggaggccaucaacaagaucaccaagaaccucaacucccugagugagcuggaggugaagaaccuccagcgccuguccggcgccauggacgagcugcacaacgagauccucgagcuggacgagaaggucgacgaccugcgggccgacacgaucagcucccagaucgagcucgcggugcugcugucgaacgaggggaucaucaauuccgaggacgagcaccuccuggcccuggagcgcaagcucaagaagaugcugggccccagcgccguggagaucgggaacggcugcuucgagaccaagcacaagugcaaccagaccugccuggaccggaucgccgcggggaccuuugacgccggcgaguucucccuccccaccuucgacucgcugaacaucacggccgccucccugaacgacgacggccucgacaaccauaccauccugcuguacuacagcaccgccgcguccucgcuggccgucacccucaugaucgccaucuucgugguguacauggucucccgcgacaacgugagcugcuccaucugccuguga

SEQ ID NO: 14088 - RNA, 1758 nt, Artificial Sequence
  derived and/or modified CDS sequence (AUadapt) from InfluenzaB__EPI827073__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucccacuucgccaaccugaaggggacggagacccggggcaagcucugucccaagugccugaacugcaccgaccuggacguggcccucgggcgccccaagugcaccggcaagaucccguccgcccgggugucgauccugcacgagguccgccccgugacguccggcugcuuccccaucaugcacgaccggaccaagauccgccagcugcccaaucuccugcggggguacgagcacauccgccugagcacccacaacgugaucaacgccgagaacgcgccgggcgggcccuacaagaucggcaccuccgggucgugccccaacaucacgaacggcaauggcuucuucgccaccauggccugggccguccccaagaacgacaagaacaagaccgcgaccaacccgcucacgaucgaggugcccuacaucugcaccgagggggaggaccagaucaccguguggggccugcacuccgacaacgagauccagauggccaagcuguauggggacagcaagccccagaaguucaccuccucggccaacggcgucacgacccacuacgugucccagaucggcggguuccccaaccagaccgaggacggcgggcucccgcagucgggccggaucguggucgacuauauggugcagaaguccgggaagaccggcacgaucaccuaccagcgcggcauccugcugccccagaagguguggugcgccagcgggcgguccaaggucaucaagggcucgcucccccugaucggggaggccgacugccugcacgagaaguacggcgggcucaacaagagcaagcccuacuacaccggcgagcaugcgaaggccaucggcaacugcccgaucugggugaagacgccccugaagcuggccaacgggaccaaguaccgcccgcccgccaagcuccugaaggagcggggcuucuucggggccaucgcgggcuuccuggagggcgggugggagggcaugaucgccggguggcacggcuacaccucccacggggcccacggcguggccgucgccgcggaccucaagaguacccaggaggccaucaacaagaucaccaagaaccugaacucccugagcgagcucgaggugaagaaccugcagcgccuguccggcgccauggacgagcuccacaacgagauccuggagcuggacgagaaggucgacgaccuccgggccgacacgaucaguucccagaucgagcuggccgugcugcucucgaacgaggggaucaucaacuccgaggacgagcaccuccuggcgcuggagcgcaagcugaagaagaugcugggccccagcgccguggagaucgggaacggcugcuucgagaccaagcacaagugcaaccagaccugucucgaccggaucgccgccgggaccuucgacgcgggcgaguucucccugcccaccuucgacucgcugaacaucacggccgccucccucaacgacgacggccuggacaaucacaccauccugcuguacuacagcaccgccgccuccucgcucgcggucacccugaugaucgccaucuucgugguguacauggucucccgcgacaacgugagcugcuccaucugccuguga

SEQ ID NO: 14089 - RNA, 1758 nt, Artificial Sequence
  derived and/or modified CDS sequence (AUadapt) from InfluenzaB__EPI244699__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugccccaagugucugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcauauccgccugucgacccacaacgugaucaacgccgagaacgcgccgggcgggcccuacaagaucggcaccuccgggagcugccccaacaucacgaacggcaacggcuucuucgccaccauggccugggccguccccaagaaugacaagaacaagaccgcgaccaacccgcucacgaucgaggugcccuacaucugcaccgagggggaggaccagaucaccguguggggcuuccacuccgacaacgagauccagauggccaagcuguacggggacucgaagccccagaaguucaccuccagugccaacggcgucacgacccacuacgugucccagaucggcggguuccccaaccagaccgaggacggcgggcugccgcagagcggccggaucguggucgacuacauggugcagaaguccgggaagaccggcacgaucaccuaccagcgcggcauccuccugccccagaagguguggugcgccucggggcgguccaaggucaucaagggcagccugccccucaucggggaggccgauugccugcacgagaaguacggcgggcugaacaagucgaagcccuacuacaccggcgagcacgcgaaggccaucggcaacugcccgaucugggugaagacgccccucaagcuggccaacgggaccaaguaccgcccgcccgccaagcugcucaaggagcggggcuucuuuggggccaucgcgggcuuccuggagggcgggugggagggcaugaucgccggguggcacggcuacaccucccacggggcccacggcguggccgucgccgcggaccugaaguccacccaggaggccaucaacaagaucaccaagaaccucaacucccugagcgagcuggaggugaagaaccuccagcgccuguccggcgccauggacgagcugcacaacgagauccucgagcuggaugagaaggucgacgaccugcgggccgacacgaucucgucccagaucgagcucgccgugcugcugucgaacgaggggaucaucaacuccgaggacgagcaccuccuggcgcuggagcgcaagcucaagaagaugcugggccccagcgccguggagaucgggaacggcugcuucgagaccaagcauaagugcaaccagaccugccuggaccggaucgccgccgggaccuucgacgcgggcgaguucucccuccccaccuucgacucgcugaacaucacggccgccucccugaacgacgauggccucgacaaccacaccauccugcuguacuacagcaccgccgccuccucgcuggcggucacccucaugaucgccaucuucgugguguacauggucucccgcgacaacgugagcugcuccaucugccuguga

SEQ ID NO: 14090 - RNA, 1758 nt, Artificial Sequence
  derived and/or modified CDS sequence (AUadapt) from InfluenzaB__EPI244702__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuuugccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuucccaucaugcacgaccggaccaagauccgccagcugcccaaccuccugcggggguacgagcacauccgccugucgacccacaacgugaucaacgccgagaacgcgccgggcgggcccuacaagaucggcaccuccgggaguugccccaacaucacgaacggcaacggcuucuucgccaccauggccugggccguccccaagaacgacaagaacaagaccgcgaccaacccgcucacgaucgaggugcccuacaucuguaccgagggggaggaccagaucaccguguggggcuuccacuccgacgacgagacccagauggccaagcuguacggggacucgaagccccagaaguucacguccagcgccaacggcgucaccacccauuacgugucccagaucggcggguuccccaaccagaccgaggacggcgggcugccgcagucgggccggaucguggucgacuacauggugcagaaguccgggaagacgggcaccaucaccuaccagcgcggcauccuccugccccagaagguguggugcgccagcgggcgguccaaggucaucaagggcucgcugccccucaucggggaggccgauugccugcacgagaaguacggcgggcugaacaagagcaagcccuacuacaccggcgagcacgcgaaggccaucggcaacugcccgaucugggugaagacgccccucaagcuggccaacgggaccaaguaucgcccgcccgccaagcugcucaaggagcggggcuucuucggggccaucgcgggcuuccuggagggcgggugggagggcaugaucgccggguggcacggcuacaccucccacggggcccacggcguggccgucgccgcggaccugaaguccacccaggaggccaucaacaagaucacgaagaaccucaacucccugagugagcuggaggugaagaaccuccagcgccuguccggcgccauggacgagcugcacaacgagauccucgagcuggacgagaaggucgacgaccugcgggccgacaccaucagcucccagaucgagcucgccgugcugcugucgaacgaggggaucaucaauuccgaggacgagcaccuccuggcgcuggagcgcaagcucaagaagaugcugggccccagcgccguggagaucgggaacggcugcuucgagaccaagcacaagugcaaccagaccugccuggaccggaucgccgccgggaccuuugacgcgggcgaguucucccuccccacguucgacucgcugaacaucaccgccgccucccugaacgacgacggccucgacaaccauaccauccugcuguacuacagcaccgccgccuccucgcuggcggucacgcucaugaucgccaucuucgugguguacauggucucccgcgacaacgugagcugcuccaucugccuguga

SEQ ID NO: 14091 - RNA, 1755 nt, Artificial Sequence
  derived and/or modified CDS sequence (AUadapt) from InfluenzaB__NP_056660__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagucccacuucgccaaccugaaggggacgcagacccggggcaagcucugccccaacugcuucaacugcaccgaccuggacguggcccuggggcgccccaagugcaugggcaacaccccguccgccaaggugucgauccuccacgaggucaagcccgccacguccggcugcuuccccaucaugcacgaccggaccaagauccgccagcugcccaaccugcuccggggguacgagaacauccgccugagcaccuccaacgugaucaacaccgagacggcgccgggcgggcccuacaaggugggcaccucgggguccugccccaacgucgccaacggcaacggcuucuucaacaccauggccugggugauccccaaggacaacaacaagaccgccaucaacccggugacggucgaggugcccuacaucugcagugagggggaggaccagaucaccguguggggcuuccacuccgacgacaagacccagauggagcggcuguacggggacucgaacccccagaaguucaccuccagcgcgaacggcgucacgacccacuacgugucccagaucggcggguuccccaaccagaccgaggacgagggccucaagcagucggggcgcaucguggucgacuacauggugcagaagccgggcaagaccgggacgaucguguaccagcggggcauccugcugccccagaaggucuggugcgccuccggccgcucgaaggugaucaaggggucgcucccccugaucggcgaggccgacugccugcacgagaaguacgggggccucaacaaguccaagcccuacuacaccggggagcacgccaaggccaucggcaacugcccgaucugggucaagacgccccugaagcuggcgaacggcaccaaguaccggccgcccgccaagcuccugaaggagcgcggguucuucggcgccaucgccggguuccuggagggcgggugggagggcaugaucgccggcuggcacggguacaccagccacggcgcgcacgggguggccguggccgccgaccucaaguccacccaggaggccaucaacaagaucaccaagaaccugaacuaucugucggagcucgaggucaagaaccugcagcggcuguccggcgcgaugaacgagcuccacgacgagauccuggagcuggacgagaagguggacgaccuccgcgccgacaccaucucgucccagaucgagcuggccgugcugcucucgaacgagggcaucaucaacuccgaggacgagcaccuccuggcccuggagcggaagcugaagaagaugcuggggcccagcgccgucgagaucggcaacgggugcuucgagacgaagcacaagugcaaccagaccugccucgaccgcaucgcggccggcaccuucaacgccggggacuucucccugcccaccuucgacucgcugaacaucaccgccgcgucccucaacgacgacggccuggacaaccacacgauccugcucuacuacucgaccgccgccuccucgcuggccgugacccugaugaucgccaucuucaucguguacauggucucccgggacaacgugagcugcuccaucugccuguga

SEQ ID NO: 14092 - RNA, 1755 nt, Artificial Sequence
  derived and/or modified CDS sequence (AUadapt) from InfluenzaB__ABG85167__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccacccggucccacuucgccaaccugaaggggacgcagacccgcggcaagcucugccccaacugcuucaacugcaccgaccuggacguggcccuggggcggcccaagugcaugggcaacaucccguccgccaaggugucgauccuccacgaggucaagcccgugaccuccggcugcuuccccaucaugcacgaccgcacgaagauccggcagcugcccaaccugcuccgcggguaugagaacauccggcugagcaccuccaacgugaucaacgccgagaccgcgccgggcgggcccuacaaggucggcaccucgggguccugccccaacguggccaaccgcaacggcuucuucaacacgauggccugggugauccccaaggacaacaacaagaccgccaucaacccggucaccguggaggugcccuacaucugcucggagggcgaggaccagaucaccgucuggggguuccacuccgacgacaagacgcagauggagcggcuguacggcgacagcaacccccagaaguuuaccuccucggcgaacggggugaccacccacuacgugucccagaucggcggcuuccccaaccagacggaggacgaggggcucaagcagagcggccgcaucgucguggacuacauggugcagaagccggggaagaccggcaccaucgucuaccagcgggggauccugcugccccagaagguguggugcgccuccggccgcucgaaggucaucaagggcucgcucccccugaucggggaggccgacugccugcacgagaaguacggcgggcucaacaaguccaagcccuacuacaccggcgagcacgccaaggccaucgggaacugcccgaucugggugaagacgccccugaagcuggcgaacggcaccaaguaccggccgcccgccaagcuccugaaggagcgcggcuucuucggggccaucgccggcuuccuggagggcgggugggaggggaugaucgccggcuggcauggcuacaccagccacggggcgcacggcguggccgucgccgccgaccucaaguccacccaggaggccaucaacaagaucacgaagaaccugaacucgcuguccgagcucgaggugaagaaccugcagcggcugagcggggcgaugaacggccuccacgacgagauccuggagcuggacgagaagguggacgaccuccgcgccgacaccaucuccucgcagaucgagcuggccguccugcucuccaacgagggcaucaucaacucggaggacgagcaccuccuggcccuggagcggaagcugaagaagaugcuggggcccuccgccguggagaucggcaacgggugcuucgagaccaagcacaagugcaaucagaccugccucgaccgcaucgcggccggcacguucaacgccggggacuucagccugcccaccuucgacucccugaacaucaccgccgcgucgcucaacgacgacgaccuggacaaccacaccauccugcucuacuacuccaccgccgccagcucccuggccgugacgcugaugaucgccaucuucaucgucuacauggugucgcgggacaacguguccugcagcaucugccuguga

SEQ ID NO: 14093 - RNA, 1755 nt, Artificial Sequence
  derived and/or modified CDS sequence (AUadapt) from InfluenzaB__EPI540671__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacuguaccgaccuggacguggcccucgggcggcccaugugcgugggcaccacgccguccgccaaggccagcauccugcacgagguccgccccgugaccuccggcugcuuccccaucaugcacgaucggaccaagauccgccagcugcccaaccuccugcggggguacgagaagauccgccugagcacccagaacgugaucgacgcggagaaggccccgggcgggcccuaccggcucggcacguccgggagcugucccaacgccaccuccaagaucggcuucuucgccaccauggcgugggccguccccaaggacaacuacaagaacgccaccaacccgcugacgguggaggugcccuauaucugcaccgagggcgaggaccagaucaccgucuggggguuccacagcgacaacaagacccagaugaagucccuguauggcgacucgaacccccagaaguucacguccagcgccaacggggugaccacccacuacgugucccagaucggcgauuuccccgaccagaccgaggacggcgggcucccgcagagcggccgcaucgucguggacuacaugaugcagaagcccgggaagacgggcaccaucguguaccagcgcgggguccugcugccccagaagguguggugugccuccggccggagcaaggugaucaagggcagccucccccugaucggggaggcggacugccugcacgaggaguacggcgggcucaacaaguccaagccguacuauaccggcaagcacgccaaggccaucgggaacugccccaucugggucaagacgccccugaagcuggccaacggcaccaaguaccggcccccggccaagcuccugaaggagcgcggcuucuucggggcgaucgccggcuuucuggagggcgggugggaggggaugaucgccggcuggcacggcuacaccagccacggggcccacggcguggccgucgcggccgaccucaaguccacccaggaggccaucaacaagaucaccaagaaccugaauagccuguccgagcucgaggugaagaaccugcagcggcugucgggggccauggacgagcuccacaacgagauccuggagcuggacgagaagguggaugaccuccgcgccgacacgaucuccagccagaucgagcuggcgguccugcucuccaacgagggcaucaucaacagcgaggacgagcaccuccuggcccuggagcggaagcugaagaagaugcugggccccuccgccguggauaucgggaacggcugcuucgagaccaagcacaagugcaaccagaccugccucgaucgcaucgccgcggggaccuucaacgccggcgaguucagccugcccaccuucgacucccugaacaucacggccgccagccucaaugacgacgggcuggacaaccacaccauccugcuguacuacuccaccgccgcgaguucccucgccgugacccugaugcuggccaucuucaucgucuacauggugagccgggacaacguguccugcagcaucugccucuga

SEQ ID NO: 14094 - RNA, 1755 nt, Artificial Sequence
  derived and/or modified CDS sequence (AUadapt) from InfluenzaB__EPI573303__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacuguaccgaccuggacguggcccucgggcggcccaugugcgugggcaccacgccguccgccaaggccagcauccugcacgagguccgccccgugaccuccggcugcuuccccaucaugcaugaccggaccaagauccgccagcugcccaaccuccugcggggguacgagaagauccgccugagcacccagaacgugaucgacgcggagaaggccccgggcgggcccuaccggcucggcacguccgggaguugccccaacgccaccuccaagaucggcuucuucgccaccauggcgugggccguccccaaggacaacuacaagaaugccaccaacccgcugacgguggaggugcccuacaucugcaccgagggcgaggaccagaucaccgucuggggguuccacagcgaugacaagacccagaugaagucccuguacggcgacagcaacccccagaaguucacguccagcgccaauggggugaccacccacuacgugucccagaucggcgacuuccccgaccagaccgaggacggcgggcucccgcagagcggccgcaucgucguggauuacaugaugcagaagcccgggaagacgggcaccaucguguaccagcgcgggguccugcugccccagaagguguggugcgccuccggccggagcaaggugaucaagggcucgcucccccugaucggggaggcggacugccugcaugaggaguacggcgggcucaacaaguccaagccguacuacaccggcaagcacgccaaggccaucgggaacugccccaucugggucaagacgccccugaagcuggccaauggcaccaaguaccggcccccggccaagcuccugaaggagcgcggcuucuucggggcgaucgccggcuuccuggagggcgggugggaggggaugaucgccggcuggcacggcuacaccagccauggggcccacggcguggccgucgcggccgaccucaaguccacccaggaggccaucaacaagaucaccaagaaccugaacagccuguccgagcucgaggugaagaaccugcagcggcugaguggggccauggacgagcuccacaacgagauccuggagcuggacgagaagguggacgaccuccgcgccgacacgaucuccagucagaucgagcuggcgguccugcucuccaacgagggcaucaucaacagcgaggacgagcaccuccuggcccuggagcggaagcugaagaagaugcugggccccuccgccguggacaucgggaacggcuguuucgagaccaagcacaagugcaaccagaccugccucgaccgcaucgccgcggggaccuucaaugccggcgaguucagccugcccaccuucgacucccugaacaucacggccgccagccucaacgaugacgggcuggacaaccacaccauccugcuguacuacuccaccgccgcgagcucccucgccgugacccugaugcuggccaucuuuaucgucuacauggugagccgggacaacguguccugcagcaucugccucuga

SEQ ID NO: 14095 - RNA, 1755 nt, Artificial Sequence
  derived and/or modified CDS sequence (AUadapt) from InfluenzaB__EPI829466__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacuguaccgaccuggacguggcccucgggcggcccaugugcgugggcaccacgccguccgccaaggccagcauccugcacgagguccgccccgugaccuccggcugcuuccccaucaugcacgaucggaccaagauccgccagcugcccaaccuccugcggggguacgagaagauccgccugagcacccagaacgugaucgacgcggagaaggccccgggcgggcccuaccggcucggcacguccgggagcugucccaacgccaccuccaagaucggcuucuucgccaccauggcgugggccguccccaaggacaacuacaagaacgccaccaacccgcugacgguggaggugcccuauaucugcaccgagggcgaggaccagaucaccgucuggggguuccacagcgacgacaagacccagaugaagucccuguauggcgacucgaacccccagaaguucacguccagcgccaacggggugaccacccacuacgugucccagaucggcgauuuccccgaccagaccgaggacgagggccucccgcagagcgggcgcaucgucguggacuacaugaugcagaagcccggcaagacggggaccaucguguaccagcggggcguccugcugccccagaagguguggugugccuccgggcgcagcaaggugaucaagggcagccucccccugaucggcgaggcggacugccugcacgaggaguacgggggccucaacaaguccaagccguacuauaccgggaagcacgccaaggccaucggcaacugccccaucugggucaagacgccccugaagcuggccaacgggaccaaguaccggcccccggccaagcuccugaaggagcgcggcuucuucggcgcgaucgccggguuucuggagggcgggugggagggcaugaucgccggguggcacggcuacaccagccacggcgcccacgggguggccgucgcggccgaccucaaguccacccaggaggccaucaacaagaucaccaagaaccugaauagccuguccgagcucgaggugaagaaccugcagcggcugucgggcgccauggacgagcuccacaacgagauccuggagcuggacgagaagguggaugaccuccgcgccgacacgaucuccagccagaucgagcuggcgguccugcucuccaacgaggggaucaucaacagcgaggacgagcaccuccuggcccuggagcggaagcugaagaagaugcugggccccuccgccguggauaucggcaacgggugcuucgagaccaagcacaagugcaaccagaccugccucgaucgcaucgccgcgggcaccuucaacgccggggaguucagccugcccaccuucgacucccugaacaucacggccgccagccucaaugacgacggccuggacaaccacaccauccugcuguacuacuccaccgccgcgaguucccucgccgugacccugaugcuggccaucuucaucgucuacauggugagccgggacaacguguccugcagcaucugccucuga

SEQ ID NO: 14096 - RNA, 1755 nt, Artificial Sequence
  derived and/or modified CDS sequence (AUadapt) from InfluenzaB__EPI684429__HA
augaaggccaucaucgugcugcucauggucgugaugaguaacgccgaccgcaucugcaccggcaucaccuccagcaacagcccccacguggucaagacggcgacccagggggaggugaacgugaccggcgucaucccgcugaccacgacccccaccaaguccuauuucgccaaccugaaggggacccggacgcgcggcaagcucugccccgacugccugaacugcaccgaccuggauguggcccucgggcggcccaugugcgugggcaccaccccguccgccaaggccagcauccugcacgagguccgccccgugacguccggcugcuuccccaucaugcacgaccggaccaagauccgccagcugcccaaccuccugcggggguaugagaagauccgccugagcacccagaacgugaucgacgcggagaaggccccgggcgggcccuaccggcucggcaccuccgggagcugccccaacgccacguccaagaucggcuucuuugccaccauggcgugggccguccccaaggacaacuacaagaacgccaccaacccgcagaccguggaggugcccuacaucugcacggagggcgaggaccagaucaccgucuggggguuucacagcgacaacaagacccagaugaagucccuguacggcgacucgaacccccagaaguuuaccuccagcgccaacggggugacgacccacuacgugucccagaucggcgacuuccccgaccagaccgaggacggcgggcugccgcagaguggccgcaucgucguggacuacauggugcagaagcccgggaagaccggcacgaucgucuaccagcgcggggugcuccugccccagaagguguggugcgucuccggccggagcaaggugaucaagggcagccugccccucaucggggaggccgacugccugcaugaggaguacggcgggcugaacaaguccaagccguacuacaccggcaagcacgcgaaggccaucgggaacugccccaucugggucaagacgccccucaagcuggccaacggcaccaaguaucggcccccggccaagcugcucaaggagcgcggcuucuucggggccaucgcgggcuuccuggagggcgggugggaggggaugaucgccggcuggcacggcuacaccagccacggggcccacggcguggccguggccgcggaucugaaguccacccaggaggccaucaacaagaucaccaagaaccucaacagccuguccgagcuggaggucaagaaccuccagcggcugucgggggccauggacgagcugcacaaugagauccucgagcuggacgagaagguggacgaccugcgcgccgacaccaucuccagccagaucgagcucgccgugcugcuguccaacgagggcaucaucaacagcgaggaugagcaccuccuggcgcuggagcggaagcucaagaagaugcugggccccuccgccgucgacaucgggaacggcugcuucgagacgaagcacaagugcaaccagaccugucuggaccgcaucgccgccgggaccuucaacgcgggcgaguucagccuccccaccuucgacucccugaacaucaccgccgccagucugaacgacgacgggcucgacaaccacacgauccugcuguacuacuccaccgccgccaguucccuggcggugacccucaugcuggccaucuucaucguguacauggucagccgggacaacguguccugcagcaucugccuguga

SEQ ID NO: 14097 - RNA, 1758 nt, Artificial Sequence
  derived and/or modified CDS sequence (AUadapt) from InfluenzaB__AFH58447__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccacuuugccaaccugaaggggacggagacccggggcaagcucugccccaagugccugaacugcaccgaccuggacguggcccucgggcgccccaagugcaccggcaagaucccguccgcccgggugucgauccugcacgagguccgccccgugacguccggcugcuuucccaucaugcacgaccggaccaagauccgccagcugcccaaccuccugcggggguacgagcacauccgccugagcaccaacaacgugaucaacgccgagaacgcgccgggcgggcccuacaagaucggcaccuccgggaguugccccaacgucacgaacggcaacggcuucuucgccaccauggccugggccgugcccaagaacgacaagaacaagaccgcgaccaacccgcucacgaucgaggugcccuacaucuguaccgagggggaggaccagaucaccgucuggggcuuccacuccgacaacgagauccagauggccaagcuguacggggacagccggccccagaaguucaccuccucggccaacggcgugacgacccauuacgugucccagaucggcggguuccccaaccagaccgaggacggcgggcugccgcagagcggccgcaucgucguggacuacauggugcagaaguccgggaagaccggcacgaucaccuaccagcggggcauccuccugccccagaaggucuggugcgccucggggcgcuccaaggugaucaagggcagccugccccucaucggggaggccgauugccugcacgagaaguacggcgggcugaacaagucgaagcccuacuacaccggcgagcacgcgaaggccaucggcaacugcccgaucugggugaagacgccccucaagcuggccaacgggaccaaguaucggccgcccgccaagcugcucaaggagcgcggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucaccaagaaccucaacucccugagugagcuggaggucaagaaccuccagcggcuguccggcgccauggacgagcugcacaacgagauccucgagcuggacgagaagguggacgaccugcgcgccgacacgaucucgucccagaucgagcucgccgugcugcugagcaacgaggggaucaucaauuccgaggacgagcaccuccuggcgcuggagcggaagcucaagaagaugcugggccccucggccgucgagaucgggaacggcugcuucgagaccaagcacaagugcaaccagaccugccuggaccgcaucgccgccgggaccuuugacgcgggcgaguucucccuccccaccuucgacagccugaacaucacggccgccucccugaacgacgacggccucgacaaccauaccauccugcuguacuacucgaccgccgccuccagccuggcggugacccucaugaucgccaucuucguggucuacauggugucccgggacaacgugagcugcuccaucugccuguga

SEQ ID NO: 14098 - RNA, 1758 nt, Artificial Sequence
  derived and/or modified CDS sequence (AUadapt) from InfluenzaB__EPI173279__HA
augaaggccaucaucgugauccugauggucgugaccaguaacgccgaccgcaucugcaccggcaucacguccucgaacagcccccacguggucaagaccgcgacccagggggaggugaacgugaccggcgucaucccgcucacgaccacccccaccaagucgcacuucgccaaccugaaggggacggagacccggggcaagcugugucccaagugccucaacugcaccgaccuggacguggcccuggggcgccccaagugcaccggcaagaucccguccgcccgggugagcauccuccacgagguccgccccgugacguccggcugcuuccccaucaugcacgaccggaccaagauccgccagcugcccaaucugcuccggggguacgagcacauccgccugucgacccacaacgugaucaacgccgagaacgcgccgggcgggcccuacaagaucggcaccuccgggagcugccccaacaucacgaacggcaauggcuucuucgccaccauggccugggccguccccaagaacgacaagaacaagaccgcgaccaacccgcugacgaucgaggugcccuacaucugcaccgagggggaggaccagaucaccguguggggcuuccacuccgacagugagacccagauggccaagcucuacggggacuccaagccccagaaguucacgagcuccgccaacggcgucaccacccacuacgugucgcagaucggcggguuccccaaccagaccgaggacggcgggcugccgcaguccggccggaucguggucgacuauauggugcagaaguccgggaagacgggcaccaucaccuaccagcgcggcauccugcucccccagaagguguggugcgccuccgggcggagcaaggucaucaagggcucgcugccccugaucggggaggccgacugccuccacgagaaguacggcgggcugaacaaguccaagcccuacuacaccggcgagcacgcgaaggccaucggcaauugcccgaucugggugaagacgccccugaagcucgccaacgggaccaaguaccgcccgcccgccaagcugcugaaggagcggggcuucuucggggccaucgcgggcuuccucgagggcgggugggagggcaugaucgccggguggcacggcuacaccucgcacggggcccacggcguggccgucgccgcggaccugaaguccacccaggaggccaucaauaagaucacgaagaaccugaacagccucuccgagcuggaggugaagaaccugcagcgccucucgggcgccauggacgagcugcacaacgagauccuggagcucgacgagaaggucgacgaccugcgggccgacaccaucuccagucagaucgagcuggccgugcuccuguccaacgaggggaucaucaacucggaggacgagcaccuccuggcgcuggagcgcaagcugaagaagaugcucggccccuccgccguggagaucgggaacggcugcuucgagaccaagcacaagugcaaccagaccugccuggaucggaucgccgccgggaccuucgacgcgggcgaguucagccugcccacguucgacucccucaacaucaccgccgccucgcugaacgacgacggccuggacaaucacaccauccuccuguacuacuccaccgccgccagcucccuggcggucacgcugaugaucgccaucuucgugguguacauggucucgcgcgacaacguguccugcagcaucugccucuga

SEQ ID NO: 14099 - RNA, 1758 nt, Artificial Sequence; identical to SEQ ID NO: 14086
  derived and/or modified CDS sequence (AUadapt) from InfluenzaB__EPI163726__HA

SEQ ID NO: 14100 - RNA, 1758 nt, Artificial Sequence
  derived and/or modified CDS sequence (AUadapt) from InfluenzaB__EPI636340__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccacuuugccaaccugaaggggacggagacccggggcaagcucugccccaagugccugaacugcaccgaccuggacguggcccucgggcgccccaagugcaccggcaagaucccguccgcccgggugucgauccugcacgagguccgccccgugacguccggcuguuuccccaucaugcacgaccggaccaagauccgccagcugcccaaccuccugcggggguacgagcacgugcgccugagcacccacaacgucaucaacgccgaggaugcgccgggcgggcccuacaagaucggcaccuccgggucgugccccaacaucacgaacggcaacggcuucuucgccaccauggccugggccgugcccaagaacgacaagaauaagaccgcgaccaacccgcucacgaucgaggugcccuacaucugcaccgagggggaggaccagaucaccgucuggggcuuccacuccgacaacgagacccagauggccaagcuguacggggacaguaagccccagaaguucacguccucggccaacggcgugaccacccacuacgugucccagaucggcggguuccccaaccagaccgaggacggcgggcugccgcagagcggccggaucgucguggacuauauggugcagaaguccgggaagacgggcaccaucaccuaccagcgcggcauccuccugccccagaaggucuggugcgccucggggcgguccaaggugaucaagggcagccugccccucaucggggaggccgacugccugcacgagaaguacggcgggcugaacaagucgaagcccuauuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuauaccucccacggggcccacggcgucgccguggccgcggaccugaaguccacccaggaggccaucaacaagaucacgaagaaccucaacucccugagcgagcuggaggucaagaaccuccagcgccuguccggcgccauggacgagcugcacaaugagauccucgagcuggacgagaagguggacgaccugcgggccgacaccaucucgucccagaucgagcucgccgugcugcugagcaacgaggggaucaucaacuccgaggacgagcaccuccuggcgcuggagcgcaagcucaagaagaugcugggccccagugccgucgagaucgggaacggcugcuucgagaccaagcacaagugcaaccagaccugccuggaccggaucgccgccgggaccuucgacgcgggcgaguuuucccuccccacguucgacagccugaacaucaccgccgccucccugaacgacgacggccucgacaaccacaccauccugcuguauuacucgaccgccgccuccagccuggcggugacgcucaugaucgccaucuucguggucuacauggugucccgcgacaacgugagcugcuccaucugccuguga

SEQ ID NO: 14101 - RNA, 1758 nt, Artificial Sequence
  derived and/or modified CDS sequence (AUadapt) from InfluenzaB__EPI645995__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccauuucgccaaccugaaggggacggagacccggggcaagcucugccccaagugccugaacugcaccgaccuggacguggcccucgggcgccccaagugcaccggcaagaucccguccgcccgggugaguauccugcacgagguccgccccgugacguccggcugcuuccccaucaugcacgaccggaccaagauccgccagcugcccaaccuccugcggggguacgagcacgugcgccugagcacccauaacgucaucaacgccgaggacgcgccgggcgggcccuacaagaucggcaccuccgggagcugccccaacaucacgaacggcaacggcuuuuucgccaccauggccugggccgugcccaagaacgacaagaacaagaccgcgaccaacccgcucacgaucgaggugcccuacaucugcaccgagggggaggaccagaucaccgucuggggcuuccacuccgaugacgagacccagauggccaagcuguacggggacucgaagccccagaaguucacguccagcgccaacggcgugaccacccacuacgugucccagaucggcggguuucccaaccagaccgaggacggcgggcugccgcagucgggccggaucgucguggacuacauggugcagaaguccgggaagacgggcaccaucaccuaccagcgcggcauccuccugccccagaaggucuggugcgccagcgggcgguccaaggugaucaagggcucgcugccccucaucggggaggccgauugccugcacgagaaguacggcgggcugaacaagagcaagcccuacuacaccggcgagcacgcgaaggccaucggcaacuguccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaucugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaucugcgggccgacaccaucucgucccagaucgagcucgccgugcugcugagcaacgaggggaucaucaacuccgaggacgagcaccuccuggcgcuggagcgcaagcucaagaagaugcugggccccucggccgucgagaucgggaacggcuguuucgagaccaagcacaagugcaaccagaccugccuggaccggaucgccgccgggaccuucgacgcgggcgaguucucccuccccacguuugacagccugaacaucaccgccgccucccugaacgacgacggccucgacaaccacaccauccugcuguauuacucgaccgccgccuccagccuggcggugacgcucaugaucgccaucuucguggucuacauggugucccgcgacaacgugagcugcuccaucugccuguga

SEQ ID NO: 14102 - RNA, 1755 nt, Artificial Sequence; identical to SEQ ID NO: 14093
  derived and/or modified CDS sequence (AUadapt) from InfluenzaB__EPI539769__HA

SEQ ID NO: 14103 - RNA, 1755 nt, Artificial Sequence; identical to SEQ ID NO: 14094
  derived and/or modified CDS sequence (AUadapt) from InfluenzaB__EPI551249__HA

SEQ ID NO: 14104 - RNA, 1755 nt, Artificial Sequence
  derived and/or modified CDS sequence (AUadapt) from InfluenzaB__EPI544259__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuauuucgccaaccugaaggggacgcggacccgcggcaagcucugccccgacugccugaacugcaccgaccuggauguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguaugagaagauccgccugagcacccagaacgugaucgacgcggagaaggccccgggcgggcccuaccggcucggcacguccgggucgugccccaacgccaccuccaagaucggcuucuuugccaccauggcgugggccguccccaaggacaacuacaagaacgccaccaacccgcugacgguggaggugcccuacaucugcaccgagggcgaggaccagaucaccgucuggggguuucacagcgacaacaagaaccagaugaagucccuguacggcgacagcaauccccagaaguucaccuccagcgccaacggggugacgacccacuacgugucccagaucggcgacuuccccgaccagaccgaggauggcgggcucccgcagagcggccgcaucgucguggacuacaugaugcagaagcccgggaagaccggcacgaucguguaccagcgcgggguccugcugccccagaagguguggugcgccuccggccggagcaaggugaucaagggcucgcucccccugaucggggaggcggacugucugcacgaggaguacggcgggcucaacaaguccaagccguacuacaccggcaagcacgccaaggccaucgggaacugccccaucugggucaagacgccccugaagcuggccaauggcaccaaguaccggcccccggccaagcuccugaaggagcgcggcuucuucggggcgaucgccggcuuccuggagggcgggugggaggggaugaucgccggcuggcacggcuacaccagccacggggcccauggcguggccgucgcggccgaccucaaguccacccaggaggccaucaacaagaucaccaagaaccugaacagccuguccgagcucgaggugaagaaccugcagcggcugagcggggccauggacgagcuccauaacgagauccuggagcuggacgagaagguggacgaccuccgcgccgacaccaucuccagccagaucgagcuggcgguccugcucuccaacgagggcaucaucaacagugaggacgagcaccuccuggcccuggagcggaagcugaagaagaugcugggccccuccgccguggacaucgggaacggcugcuucgagacgaagcacaagugcaaucagaccugccucgaccgcaucgccgcggggaccuucaacgccggcgaguucagccugcccaccuucgacucccugaauaucaccgccgccagccucaacgacgacgggcuggacaaccacacgauccugcuguacuauuccaccgccgcgagcucccucgccgugacccugaugcuggccaucuucaucgucuacauggugagccgggacaacguguccugcagcaucugccucuga

SEQ ID NO: 14105 - RNA, 1755 nt, Artificial Sequence
  derived and/or modified CDS sequence (AUadapt) from InfluenzaB__EPI592699__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacuguaccgaccuggacguggcccucgggcggcccaugugcgugggcaccacgccguccgccaaggccagcauccugcacgagguccgccccgugaccuccggcugcuuccccaucaugcacgaucggaccaagauccgccagcugcccaaccuccugcggggguacgagaagauccgccugagcacccagaacgugaucgacgcggagaaggccccgggcgggcccuaccggcucggcacguccgggagcugucccaacgccaccuccaagaucggcuucuucgccaccauggcgugggccguccccaaggacaacuacaagaacgccaccaacccgcagacgguggaggugcccuauaucugcaccgagggcgaggaccagaucaccgucuggggguuccacagcgacaacaagauccagaugaagucccuguauggcgacucgaacccccagaaguucaccuccagcgccaacggggugacgacccacuacgugucccagaucggcgauuuccccgaccagaccgaggacggcgggcugccgcagagcggccgcaucgucguggacuacauggugcagaagcccgggaagaccggcacgaucgucuaccagcgcggggugcuccugccccagaagguguggugugccuccggccggagcaaggucaucaagggcagccugccccucaucggggaggcggacugccugcacgaggaguacggcgggcugaacaaguccaagccguacuauaccggcaagcacgccaaggccaucgggaacugccccaucugggugaagacgccccucaagcuggccaacggcaccaaguaccggcccccggccaagcugcucaaggagcgcggcuucuucggggcgaucgccggcuuucuggagggcgggugggaggggaugaucgccggcuggcacggcuacaccagccacggggcccacggcgucgccguggcggccgaccugaaguccacccaggaggccaucaacaagaucaccaagaaccucaauagccuguccgagcuggaggugaagaaccuccagcggcugucgggggccauggacgagcugcacaacgagauccucgagcuggacgagaaggucgaugaccugcgcgccgacaccaucuccagccagaucgagcucgcggugcugcuguccaacgagggcaucaucaacagcgaggacgagcaccuccuggcccuggagcggaagcucaagaagaugcugggccccuccgccguggauaucgggaacggcugcuucgagacgaagcacaagugcaaccagaccugccuggaucgcaucgccgcggggaccuucaacgccggcgaguucagccuccccaccuucgacucccugaacaucaccgccgccagccugaaugacgacgggcucgacaaccacacgauccugcuguacuacuccaccgccgcgaguucccuggccgucacccucaugcuggccaucuucaucguguacauggugagccgggacaacgucuccugcagcaucugccuguga

SEQ ID NO: 14106 - RNA, 1755 nt, Artificial Sequence
  derived and/or modified CDS sequence (AUadapt) from InfluenzaB__EPI592707__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacuguaccgaccuggacguggcccucgggcggcccaugugcgugggcaccacgccguccgccaaggccagcauccugcacgagguccgccccgugaccuccggcugcuuccccaucaugcaugaccggaccaagauccgccagcugcccaaccuccugcggggguacgagaagauccgccugagcacccagaacgugaucgacgcggagaaggccccgggcgggcccuaccggcucggcacguccgggaguugccccaacgccaccuccaagaucggcuucuucgccaccauggcgugggccguccccaaggacaacuacaagaaugccaccaacccgcagacgguggaggugcccuacaucugcaccgagggcgaggaccagaucaccgucuggggguuccacagcgauaacaagacccagaugaagucccuguacggcgacucgaacccccagaaguucacguccagcgccaauggggugaccacccacuacgugucccagaucggcgacuuccccgaccagaccgaggacggcgggcugccgcagagcggccgcaucgucguggauuacauggugcagaagcccgggaagacgggcaccaucgucuaccagcgcggggugcuccugccccagaagguguggugcgccuccggccggagcaaggucaucaagggcagccugccccucaucggggaggcggacugccugcaugaggaguacggcgggcugaacaaguccaagccguacuacaccggcaagcacgccaaggccaucgggaacugccccaucugggugaagacgccccucaagcuggccaauggcaccaaguaccggcccccggccaagcugcucaaggagcgcggcuucuucggggcgaucgccggcuuccuggagggcgggugggaggggaugaucgccggcuggcacggcuacaccagccauggggcccacggcgucgccguggcggccgaccugaaguccacccaggaggccaucaacaagaucaccaagaaccucaacagccuguccgagcuggaggugaagaaccuccagcggcugaguggggccauggacgagcugcacaacgagauccucgagcuggacgagaaggucgacgaccugcgcgccgacacgaucuccagucagaucgagcucgcggugcugcuguccaacgagggcaucaucaacagcgaggacgagcaccuccuggcccuggagcggaagcucaagaagaugcugggccccuccgccguggacaucgggaacggcuguuucgagaccaagcacaagugcaaccagaccugccuggaccgcaucgccgcggggaccuucaaugccggcgaguucagccuccccaccuucgacucccugaacaucacggccgccagccugaacgaugacgggcucgacaaccacaccauccugcuguacuacuccaccgccgcgagcucccuggccgucacccucaugcuggccaucuuuaucguguacauggugagccgggacaacgucuccugcagcaucugccuguga

SEQ ID NO: 14107 - RNA, 1755 nt, Artificial Sequence
  derived and/or modified CDS sequence (AUadapt) from InfluenzaB__EPI693094__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuauuucgccaaccugaaggggacgcggacccgcggcaagcucugccccgacugccugaacugcaccgaccuggauguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguaugagaagauccgccugagcacccagaacgugaucgacgcggagaaggccccgggcgggcccuaccggcucggcacguccgagucgugccccaacgccaccuccaagaucggguucuuugccaccauggcgugggccguccccaaggacaacuacaagaacgccaccaacccgcagacgguggaggugcccuacaucugcaccgagggcgaggaccagaucaccgucuggggcuuucacagcgacaacaagauccagaugaagucccuguacggggacagcaacccccagaaguuuaccuccagcgccaacggcgugacgacccacuacgugucccagaucggggacuuccccgaccagaccgaggacggcggccugccgcagagugggcgcaucgucguggacuacauggugcagaagcccggcaagaccgggacgaucgucuaccagcggggcgugcuccugccccagaagguguggugcgccuccgggcgcagcaaggucaucaagggcucgcugccccucaucggcgaggcggacugccugcaugaggaguacgggggccugaacaaguccaagccguacuacaccgggaagcacgccaaggccaucggcaacugccccaucugggugaagacgccccucaagcuggccaacgggaccaaguaucggcccccggccaagcugcucaaggagcgcggcuucuucggcgcgaucgccggguuccuggagggcgggugggagggcaugaucgccggguggcacggcuacaccagccacggcgcccacggggucgccguggcggccgaucugaaguccacccaggaggccaucaacaagaucaccaagaaccucaacagccuguccgagcuggaggugaagaaccuccagcggcugagcggcgccauggacgagcugcacaaugagauccucgagcuggacgagaaggucgacgaccugcgcgccgacaccaucuccagccagaucgagcucgcggugcugcuguccaacgaggggaucaucaacucggaggaugagcaccuccuggcccuggagcggaagcucaagaagaugcugggccccuccgccguggacaucggcaacgggugcuucgagacgaagcacaagugcaaccagaccugucuggaccgcaucgccgcgggcaccuucaacgccggggaguucagccuccccaccuucgacucccugaacaucaccgccgccagucugaacgacgacggccucgacaaccacacgauccugcuguacuacuccaccgccgcgaguucccuggccgucacccucaugcuggccaucuucaucguguacauggugagccgggacaacgucuccugcagcaucugccuguga

SEQ ID NO: 14108 - RNA, 1758 nt, Artificial Sequence; identical to SEQ ID NO: 14100
  derived and/or modified CDS sequence (AUadapt) from InfluenzaB__EPI678796__HA

SEQ ID NO: 14109 - RNA, 1758 nt, Artificial Sequence
  derived and/or modified CDS sequence (AUadapt) from InfluenzaB__EPI721064__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccacuuugccaaccugaaggggacggagacccggggcaagcucugccccaagugccugaacugcaccgaccuggacguggcccucgggcgccccaagugcaccggcaagaucccguccgcccgggugucgauccugcacgagguccgccccgugacguccggcuguuuccccaucaugcacgaccggaccaagauccgccagcugcccaaccuccugcggggguacgagcacgugcgccugagcacccacaacgucaucaacgccgaggaugcgccgggcgggcccuacaagaucggcaccucccggucgugccccaacaucacgaacgggaacggcuucuucgccaccauggccugggccgugcccaagaacgacaagaauaagaccgcgaccaacccgcucacgaucgaggugcccuacaucugcaccgagggcgaggaccagaucaccgucuggggguuccacuccgacaacgagacccagauggccaagcuguacggcgacaguaagccccagaaguucacguccucggccaacggggugaccacccacuacgugucccagaucggcggcuuccccaaccagaccgaggacgggggccugccgcagagcgggcgcaucgucguggacuauauggugcagaaguccggcaagacggggaccaucaccuaccagcggggcauccuccugccccagaaggucuggugcgccucgggccgcuccaaggugaucaaggggagccugccccucaucggcgaggccgacugccugcacgagaaguacgggggccugaacaagucgaagcccuauuacaccggggagcacgcgaaggccaucggcaacugcccgaucugggugaagacgccccucaagcuggccaacggcaccaaguaccggccgcccgccaagcugcucaaggagcgcggguucuucggcgccaucgcgggguuccuggagggcgggugggagggcaugaucgccggcuggcacggguauaccucccacggcgcccacggggucgccguggccgcggaccugaaguccacccaggaggccaucaacaagaucacgaagaaccucaacucccugagcgagcuggaggucaagaaccuccagcggcuguccggcgccauggacgagcugcacaaugagauccucgagcuggacgagaagguggacgaccugcgcgccgacaccaucucgucccagaucgagcucgccgugcugcugagcaacgagggcaucaucaacuccgaggacgagcaccuccuggcgcuggagcggaagcucaagaagaugcuggggcccagugccgucgagaucggcaacgggugcuucgagaccaagcacaagugcaaccagaccugccuggaccgcaucgccgccggcaccuucgacgcgggggaguuuucccuccccacguucgacagccugaacaucaccgccgccucccugaacgacgacggccucgacaaccacaccauccugcuguauuacucgaccgccgccuccagccuggcggugacgcucaugaucgccaucuucguggucuacauggugucccgggacaacgugagcugcuccaucugccuguga

SEQ ID NO: 14110 - RNA, 1758 nt, Artificial Sequence
  derived and/or modified CDS sequence (AUadapt) from InfluenzaB__EPI328904__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccauuucgccaaccugaaggggacggagacccggggcaagcucugccccaagugccccaacugcaccgaccuggacguggcccuggggcgcccgaagugcaccggcaagauccccuccgcccgggugaguauccuccacgagguccgccccgugacguccggcugcuuccccaucaugcacgaccggaccaagauccgccagcugccgaaccugcuccggggguacgagcacauccgccugagcacccauaacgugaucaacgccgagaacgcgcccggcgggcccuacaagaucggcaccuccgggucgugccccaacgucacgaacggcaacggcuuuuucgccaccauggccugggccgugccgaagaacgacaagaacaagaccgcgaccaacccccugacgaucgaggugcccuacaucugcaccgagggggaggaccagaucaccgucuggggcuuccacuccgaugacgagacccagauggccaagcucuacggggacagcaagccccagaaguucacguccucggccaacggcgugaccacccacuacgugucccagaucggcggguuuccgaaccagaccgaggacggcgggcugccccagagcggccggaucgucguggacuacauggugcagaaguccgggaagacgggcaccaucaccuaccagcgcggcauccugcucccccagaaggucuggugcgccucggggcgguccaaggugaucaagggcagccugccccugaucggggaggccgauugccuccacgagaaguacggcgggcugaacaagucgaagccguacuacaccggcgagcacgcgaaggccaucggcaacugucccaucugggugaagacgccccugaagcucgccaacgggaccaaguaccggcccccggccaagcugcugaaggagcgcggcuucuucggggccaucgcgggcuuccucgagggcgggugggagggcaugaucgccggguggcacggcuacaccucccacggggcccacggcgucgccguggccgcggaucugaaguccacccaggaggccaucaacaagaucacgaagaaccugaacucccucagcgagcuggaggucaagaaccugcagcgccucuccggcgccauggacgagcugcacaacgagauccuggagcucgacgagaagguggacgaucugcgggccgacaccaucucgucccagaucgagcuggccgugcuccugagcaacgaggggaucaucaacuccgaggacgagcaccuccuggcgcuggagcgcaagcugaagaagaugcucggccccucggccgucgagaucgggaacggcuguuucgagaccaagcacaagugcaaccagaccugccuggaccggaucgccgccgggaccuucgacgcgggcgaguucucccugcccacguuugacagccucaacaucaccgccgccucccugaacgacgacggccuggacaaccacaccauccuccuguauuacucgaccgccgccuccagccuggcggugacgcugaugaucgccaucuucguggucuacauggugucccgcgacaacgugagcugcuccaucugccucuga

SEQ ID NO: 14111 - RNA, 1755 nt, Artificial Sequence
  derived and/or modified CDS sequence (AUadapt) from InfluenzaB__EPI543191__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacuguaccgaccuggacguggcccucgggcggcccaugugcgugggcaccacgccguccgccaaggccagcauccugcacgagguccgccccgugaccuccggcugcuuccccaucaugcacgaucggaccaagauccgccagcugcccaaccuccugcggggguacgagaagauccgccugagcacccagaacgugaucgacgcggagaaggccccgggcgggcccuaccggcucggcacguccgggagcugucccaacgccaccuccaagaucggcuucuucgccaccauggcgugggccguccccaaggacaacuacaagaacgccaccaacccgcugacgguggaggugcccuauaucugcaccgagggcgaggaccagaucaccgucuggggguuccacagcgacaagaagacccagaugaagucccuguacggcgauucgaacccccagaaguucacguccagcgccaacggggugaccacccacuacgugucccagaucggcgauuuccccgaccagaccgaggacggcgggcucccgcagagcggccgcaucgucguggacuacaugaugcagaagcccgggaagacgggcaccaucguguaccagcgcgggguccugcugccccagaagguguggugcgccuccggccggaguaaggugaucaagggcagccucccccugaucggggaggcggacugccugcacgaggaguacggcgggcucaacaaguccaagccguacuauaccggcaagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcauggcuacaccagccacggggcccacggcguggccgucgcggccgaccucaaguccacccaggaggccaucaacaagaucaccaagaaccugaauagccuguccgagcucgaggugaagaaccugcagcggcugucgggggccauggacgagcuccacaacgagauccuggagcuggacgagaagguggaugaccuccgcgccgacacgaucuccagccagaucgagcuggcgguccugcucuccaacgagggcaucaucaacagcgaggacgagcaccuccuggcccuggagcggaagcugaagaagaugcugggccccuccgccguggauaucgggaacggcugcuucgagaccaagcacaagugcaaccagaccugccucgaucgcaucgccgcggggaccuucaacgccggcgaguucagccugcccaccuucgacucccugaacaucacggccgccagccucaaugacgacgggcuggacaaccacaccauccugcuguacuacuccaccgccgcgaguucccucgccgugacccugaugcuggccaucuucaucgucuacauggugagccgggacaacguguccugcagcaucugccucuga

SEQ ID NO: 14112 - RNA, 1755 nt, Artificial Sequence; identical to SEQ ID NO: 14093
  derived and/or modified CDS sequence (AUadapt) from InfluenzaB__EPI500359__HA

SEQ ID NO: 14113 - RNA, 1755 nt, Artificial Sequence
  derived and/or modified CDS sequence (AUadapt) from InfluenzaB__EPI543185__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuauuucgccaaccugaaggggacgcggacccgcggcaagcucugccccgacugccugaacugcaccgaccuggauguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguaugagaagauccgccugucgacccagaacgugaucgacgcggagaaggccccgggcgggcccuaccggcucggcacguccgggagcugccccaacgccaccuccaagaucggcuucuuugccaccauggcgugggccguccccaaggacaacuacaagaacgccaccaacccgcagacgguggaggugcccuacaucugcaccgagggcgaggaccagaucaccgucuggggguuucacagcgacaacaagaaccagaugaagucccuguacggcgacagcaauccccagaaguucaccuccucggccaacggggugacgacccacuacgugucccagaucggcgacuuccccgaccagaccgaggauggcgggcugccgcagagcggccgcaucgucguggacuacaugaugcagaagcccgggaagaccggcacgaucguguaccagcgcgggguccuccugccccagaagguguggugcgccuccggccggagcaaggugaucaagggcagccugccccucaucggggaggcggacugucugcacgaggaguacggcgggcugaacaaguccaagccguacuacaccggcaagcacgccaaggccaucgggaacugccccaucugggucaagacgccccucaagcuggccaauggcaccaaguaccggcccccggccaagcugcucaaggagcgcggcuucuucggggcgaucgccggcuuccuggagggcgggugggaggggaugaucgccggcuggcacggcuacaccagccacggggcccauggcguggccgucgcggccgaccugaaguccacccaggaggccaucaacaagaucaccaagaaccucaacucgcuguccgagcuggaggugaagaaccuccagcggcugagcggggccauggacgagcugcauaacgagauccucgagcuggacgagaagguggacgaccugcgcgccgacaccaucuccagccagaucgagcucgcgguccugcuguccaacgagggcaucaucaacagugaggacgagcaccuccuggcccuggagcggaagcucaagaagaugcugggccccuccgccguggacaucgggaacggcugcuucgagacgaagcacaagugcaaucagaccugccuggaccgcaucgccgcggggaccuucaacgccggcgaguucucgcuccccaccuucgacucccugaauaucaccgccgccagccugaacgacgacgggcucgacaaccacacgauccugcuguacuauuccaccgccgcgagcucccuggccgugacccucaugcuggccaucuucaucgucuacauggugagccgggacaacguguccugcagcaucugccuguga

SEQ ID NO: 14114 - RNA, 1755 nt, Artificial Sequence
  derived and/or modified CDS sequence (AUadapt) from InfluenzaB__EPI536447__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacuguaccgaccuggacguggcccucgggcggcccaugugcgugggcaccacgccguccgccaaggccagcauccugcacgagguccgccccgugaccuccggcugcuuccccaucaugcacgaucggaccaagauccgccagcugcccaaccuccugcggggguacgagaagauccgccugagcacccagaacgugaucgacgcggagaaggccccgggcgggcccuaccggcucggcacguccgggucgugucccaacgccaccuccaagaucggcuucuucgccaccauggcgugggccguccccaaggacaacuacaagaacgccaccaacccgcagacgguggaggugcccuauaucugcaccgagggcgaggaccagaucaccgucuggggguuccacagcgacaacaagacccagaugaagucccuguauggcgacagcaacccccagaaguucacguccagcgccaacggggugaccacccacuacgugucccagaucggcgauuuccccgaccagaccgaggacggcgggcugccgcagagcggccgcaucgucguggacuacaugaugcagaagcccgggaagacgggcaccaucguguaccagcgcgggguccuccugccccagaagguguggugugccuccggccggagcaaggugaucaagggcucgcugccccucaucggggaggcggacugccugcacgaggaguacggcgggcugaacaaguccaagccguacuauaccggcaagcacgccaaggccaucgggaacugccccaucugggucaagacgccccucaagcuggccaacggcaccaaguaccggcccccggccaagcugcucaaggagcgcggcuucuucggggcgaucgccggcuuucuggagggcgggugggaggggaugaucgccggcuggcacggcuacaccagccacggggcccacggcguggccgucgcggccgaccugaaguccacccaggaggccaucaacaagaucaccaagaaccucaauagccuguccgagcuggaggugaagaaccuccagcggcugagcggggccauggacgagcugcacaacgagauccucgagcuggacgagaagguggaugaccugcgcgccgacacgaucuccagccagaucgagcucgcgguccugcuguccaacgagggcaucaucaacucggaggacgagcaccuccuggcccuggagcggaagcucaagaagaugcugggccccuccgccguggauaucgggaacggcugcuucgagaccaagcacaagugcaaccagaccugccuggaucgcaucgccgcggggaccuucaacgccggcgaguucagccuccccaccuucgacucccugaacaucacggccgccagccugaaugacgacgggcucgacaaccacaccauccugcuguacuacuccaccgccgcgaguucccuggccgugacccucaugcuggccaucuucaucgucuacauggugagccgggacaacguguccugcagcaucugccuguga

SEQ ID NO: 14115 - RNA, 1755 nt, Artificial Sequence
  derived and/or modified CDS sequence (AUadapt) from InfluenzaB__EPI376346__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgaagacccggggcaagcucugccccgacugccugaacuguaccgaccuggacguggcccucgggcgccccaugugcgugggcaccacgccguccgccaaggccagcauccugcacgagguccggcccgugaccuccggcugcuuccccaucaugcaugaccgcaccaagauccggcagcuggcgaaccuccugcgcggguacgagaacauccggcugagcacccagaacgugaucgacgccgagaaggcccccggcgggccguaucgccucggcacguccgggucgugccccaacgccaccuccaagagcggcuucuucgcgaccauggccugggccguccccaaggacaauaacaagaacgccaccaacccccugacgguggaggugccguacaucugcgccgagggcgaggaccagaucaccgucuggggguuccauuccgacgacaagacccagaugaagaaccuguacggcgacagcaacccccagaaguuuaccuccagcgcgaacggggugacgacccacuacgugucccagaucggcggcuuccccgaccagaccgaggacgggggccucccccagagugggcggaucgucguggacuacaugaugcagaagccgggcaagaccgggacgaucguguaccagcgcggcguccugcugccccagaagguguggugcgccuccggccggagcaaggugaucaaggggucgcucccccugaucggcgaggccgacugucugcacgagaaguacgggggccucaacaaguccaagcccuacuacaccggggagcacgccaaggccaucggcaacuguccgaucugggucaagacgccccugaagcuggcgaacggcaccaaguaccgcccgcccgccaagcuccugaaggagcggggguucuucggcgccaucgccggguuccuggagggcgggugggagggcaugaucgccggcuggcacggguacaccagucacggcgcgcacgggguggccgucgccgccgaccucaaguccacccaggaggccaucaacaagaucaccaagaaccugaacagccuguccgagcucgaggugaagaaucugcagcgccugagcggcgcgauggacgagcuccacaacgagauccuggagcuggacgagaagguggacgaccuccgggccgauaccaucuccagccagaucgagcuggccguccugcucuccaacgagggcaucaucaacucggaggacgagcaccuccuggcccuggagcgcaagcugaagaagaugcuggggcccuccgcgguggacaucggcaaugggugcuucgagacgaagcacaagugcaaccagaccugccucgaccggaucgccgccggcaccuuuaacgccggggaguucagccugcccaccuucgacucccugaacaucaccgccgcgagccucaaugacgacggccuggacaaccacacgauccugcuguacuacuccaccgccgccaguucccucgccgugacccugaugcuggccaucuucaucgucuacauggugagccgcgacaacguguccugcagcaucugccucuga

SEQ ID NO: 14116 - RNA, 1755 nt, Artificial Sequence
  derived and/or modified CDS sequence (AUadapt) from InfluenzaB__EPI368425__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgaagacccggggcaagcucugccccgacugccugaacugcaccgaucuggacguggcccucgggcgccccaugugcgugggcaccacgccguccgccaaggccagcauccugcacgagguccggcccgugaccuccggcugcuuccccaucaugcacgaucgcaccaagauccggcagcuggcgaaccuccugcgcggguacgagaacauccggcugucgacccagaacgugaucgacgccgagaaggcccccggcgggccguaccgccucggcacguccgggagcugucccaacgccaccuccaagagcggcuucuucgcgaccauggccugggccguccccaaggacaacaacaagaaugccaccaacccccugacgguggaggugccguacaucugcgccgagggcgaggaccagaucaccgucuggggguuccacuccgacaacaagacccagaugaagaaucuguacggcgacagcaacccccagaaguucaccuccucggcgaacggggugacgacccauuacgugucccagaucggcggcuuccccgaccagaccgaggacgggggccucccccagagcgggcggaucgucguggacuacaugaugcagaagccgggcaagaccgggacgaucguguaccagcgcggcguccugcugccccagaagguguggugugccuccggccggagcaaggugaucaaggggagccucccccugaucggcgaggccgacugccugcacgagaaguacgggggccucaacaaguccaagcccuauuacaccggggagcacgccaaggccaucggcaacugcccgaucugggucaagacgccccugaagcuggcgaacggcaccaaguaccgcccgcccgccaagcuccugaaggagcggggguucuucggcgccaucgccggguuucuggagggcgggugggagggcaugaucgccggcuggcacggguacaccagccacggcgcgcacgggguggccgucgccgccgaccucaaguccacccaggaggccaucaacaagaucaccaagaaucugaacucgcuguccgagcucgaggugaagaaccugcagcgccugagcggcgcgauggacgagcuccacaacgagauccuggagcuggacgagaagguggaugaccuccgggccgacaccaucuccagccagaucgagcuggccguccugcucuccaacgagggcaucaucaacagcgaggacgagcaucuccuggcccuggagcgcaagcugaagaagaugcuggggcccuccgcgguggacaucggcaacgggugcuucgagacgaagcacaagugcaaccagaccugccucgaucggaucgccgccggcaccuucaacgccggggaguucucgcugcccaccuucgacucccugaacaucaccgccgcgagucucaacgacgacggccuggacaaccacacgauccugcuguacuacuccaccgccgccaguucccucgccgugacccugaugcuggccaucuucaucgucuacauggugagccgcgacaacguguccugcagcaucugccucuga

SEQ ID NO: 14117 - RNA, 1755 nt, Artificial Sequence
  derived and/or modified CDS sequence (AUadapt) from InfluenzaB__ACH53430__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuauuucgccaaccugaaggggacgcggacccgcggcaagcucugccccgacugccugaacugcaccgaccuggauguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguaugagaacauccgccugagcacccagaacgugaucgacgcggagaaggccccgggcgggcccuaccggcucggcacguccgggucgugccccaacgccaccuccaagaucggcuuuuucgccaccauggcgugggccguccccaaggacaacuacaagaacgccaccaacccgcugacgguggaggugcccuacaucugcaccgagggcgaggaucagaucaccgucuggggguuccacagcgacaacaagacccagaugaagaaccuguacggcgacuccaauccccagaaguucacgagcuccgccaacggggugaccacccacuacgugagccagaucggcgacuuccccgaucagaccgaggacggcgggcucccgcaguccggccgcaucgucguggacuacaugaugcagaagcccgggaagacgggcaccaucguguaccagcgcgggguccugcugccccagaagguguggugcgccagcggccgguccaaggugaucaagggcucgcucccccugaucggggaggcggacugucugcacgagaaguacggcgggcucaacaagagcaagccguacuacaccggcgagcacgccaaggccaucgggaacugucccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccucccacggggcccauggcguggccgucgcggccgaccucaagagcacccaggaggccaucaacaagaucaccaagaaccugaacucccugagcgagcucgaggugaagaaccugcagcggcuguccggggccauggacgagcuccauaacgagauccuggagcuggacgagaagguggacgaccuccgcgccgacacgaucagcucccagaucgagcuggcgguccugcucucgaacgagggcaucaucaauuccgaggacgagcaccuccuggcccuggagcggaagcugaagaagaugcugggccccagcgccguggacaucgggaacggcugcuucgagaccaagcacaaguguaaccagaccugccucgaccgcaucgccgcggggaccuucaacgccggcgaguucucccugcccaccuucgacagucugaacaucacggccgccucccucaacgacgacgggcuggacaaccacaccauccugcuguacuauagcaccgccgcguccagccucgccgugacccugaugcuggccaucuucaucgucuacauggugucccgggacaacgugagcugcuccaucugccucuga

SEQ ID NO: 14118 - RNA, 1758 nt, Artificial Sequence
  derived and/or modified CDS sequence (AUadapt) from InfluenzaB__EPI331151__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuuugccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuucccaucaugcacgaccggaccaagauccgccagcugcccaaccuccugcggggguacgagcacauccgccugucgacccacaacgugaucaacgccgagaacgcgccgggcgggcccuacaagaucggcaccuccgggaguugccccaacgucacgaacggcaacggcuucuucgccaccauggccugggccgugcccaagaacgacaagaacaagaccgcgaccaacccgcucacgaucgaggugcccuacaucuguaccgagggggaggaccagaucaccgucuggggcuuccacuccgacaacgagacccagauggccaagcuguacggggacucgaagccccagaaguucacguccagcgccaacggcgugaccacccauuacgugucccagaucggcggguuccccaaccagaccgaggacggcgggcugccgcagucgggccggaucgucguggacuacauggugcagaaguccgggaagacgggcaccaucaccuaccagcgcggcauccuccugccccagaaggucuggugcgccagcgggcgguccaaggugaucaagggcucgcugccccucaucggggaggccgauugccugcacgagaaguacggcgggcugaacaagagcaagcccuacuacaccggcgagcacgcgaaggccaucggcaacugcccgaucugggugaagacgccccucaagcuggccaacgggaccaaguaucgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagugagcuggaggucaagaaccuccagcgccuguccggcgccauggacgagcugcacaacgagauccucgagcuggacgagaagguggacgaccugcgggccgacaccaucagcucccagaucgagcucgccgugcugcugucgaacgaggggaucaucaauuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuuugacgcgggcgaguucucccuccccacguucgacucgcugaacaucaccgccgccucccugaacgacgacggccucgacaaccauaccauccugcuguacuacagcaccgccgccuccucgcuggcggugacgcucaugaucgccaucuucguggucuacauggugucccgcgacaacgugagcugcuccaucugccuguga

SEQ ID NO: 14119 - RNA, 1758 nt, Artificial Sequence
  derived and/or modified CDS sequence (AUadapt) from InfluenzaB__EPI356777__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccacuuugccaaccugaaggggacggagacccggggcaagcucugccccaagugccugaacugcaccgaccuggacguggcccucgggcgccccaagugcaccggcaagaucccguccgcccgggugucgauccugcacgagguccgccccgugacguccggcuguuuccccaucaugcacgaccggaccaagauccgccagcugcccaaccuccugcggggguacgagcacauccgccugagcacccacaacgugaucaacgccgagaaugcgccgggcgggcccuacaagaucggcaccuccgggucgugccccaacgucacgaacggcaacggcuucuucgccaccauggccugggccgugcccaagaacgacaagaauaagaccgcgaccaacccgcucacgaucgaggugcccuacaucugcaccgagggggaggaccagaucaccgucuggggcuuccacuccgacgacgagacccagauggccaagcuguacggggacaguaagccccagaaguucacguccucggccaacggcgugaccacccacuacgugucccagaucggcggguuccccaaccagaccgaggacggcgggcugccgcagagcggccggaucgucguggacuauauggugcagaaguccgggaagacgggcaccaucaccuaccagcgcggcauccuccugccccagaaggucuggugcgccucggggcgguccaaggugaucaagggcagccugccccucaucggggaggccgacugccugcacgagaaguacggcgggcugaacaagucgaagcccuauuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuauaccucccacggggcccacggcgucgccguggccgcggaccugaaguccacccaggaggccaucaacaagaucacgaagaaccucaacucccugagcgagcuggaggucaagaaccuccagcgccuguccggcgccauggacgagcugcacaaugagauccucgagcuggacgagaagguggacgaccugcgggccgacaccaucucgucccagaucgagcucgccgugcugcugagcaacgaggggaucaucaacuccgaggacgagcaccuccuggcgcuggagcgcaagcucaagaagaugcugggccccagugccgucgagaucgggaacggcugcuucgagaccaagcacaagugcaaccagaccugccuggaccggaucgccgccgggaccuucgacgcgggcgaguuuucccuccccacguucgacagccugaacaucaccgccgccucccugaacgacgacggccucgacaaccacaccauccugcuguauuacucgaccgccgccuccagccuggcggugacgcucaugaucgccaucuucguggucuacauggugucccgcgacaacgugagcugcuccaucugccuguga

SEQ ID NO: 14120 - RNA, 1752 nt, Artificial Sequence
  derived and/or modified CDS sequence (AUadapt) from InfluenzaB__CY018349__HA
augaaggccaucaucgugcugcucauggucgugaccaguaacgccgaccgcaucugcaccggcaucacguccagcaacaguccccacguggucaagaccgcgacccagggggaggugaacgugaccggcgucaucccgcugacgaccacccccaccaagucccacuucgccaaccugaaggggacgaagacccggggcaagcucugccccaauugccugaacugcaccgaccuggacguggcccucgggcgccccaugugcgugggcaccacgccguccgccaaggccaguauccugcacgagguccggcccgugaccuccggcugcuuccccaucaugcacgaccgcaccaagauccggcagcugcccaaccuccugcgcggguaugagaacauccggcugagcacccagaacgugaucaacgcggagcgcgccccgggcgggcccuaccggcucggcacguccgggagcugucccaacgucaccucccgcgacggcuucuucgccaccauggccugggcggugccccgggacaauaagaccgccacgaacccgcugaccguggagguccccuacaucugcaccaagggcgaggaccagaucaccguguggggguuccacagugacaacaagacgcagaugaagaaccuguacggcgacuccaacccccagaaguuuaccagcuccgccaacggggugaccacccacuacgucagccagaucggcggcuuccccaaucagacggaggacgggggccucccgcaguccgggcgcaucgugguggacuacaugguccagaagcccggcaagaccgggaccaucguguaccagcggggcgugcugcugccccagaaggucuggugcgccagcggccgcuccaaggugaucaaggggagucucccccugaucggcgaggccgacugccugcacgagaaguacgggggccucaacaagaguaagccguacuacaccggggagcacgcgaaggccaucggcaacugccccaucugggucaagacgccccugaagcuggccaacggcaccaaguaucggcccccggccaagcuccugaaggagcgcggguucuucggcgccaucgcgggguuccuggagggcgggugggagggcaugaucgccggcuggcacggguacaccucccacggcgcccaugggguggccguggccgcggaccucaagagcacccaggaggccaucaacaagaucacgaagaaccugaacucccugagcgagcucgaggucaagaaucugcagcggcuguccggcgccauggacgagcuccacaacgagauccuggagcuggacgagaagguggacgaccuccgcgccgauaccaucagcucccagaucgagcuggccgugcugcucagcaacgagggcaucaucaacuccgaggacgagcaucuccuggcgcuggagcggaagcugaagaagaugcuggggcccagcgccgucgacaucggcaacgggugcuucgagaccaagcacaaguguaaccagaccugccucgaccgcaucgccgccggcaccuucaacgcgggggaguucucccugcccacguuugacagccugaacaucaccgccgccucccucaacgacgacggccuggauaaccacaccauccugcuguacuacagcaccgccgccuccagccucgcggugacgcugaugaucgccaucuuuaucguguacauggucucccgggacaacgugagcugcuccaucugccuguga

SEQ ID NO: 14121 - RNA, 1752 nt, Artificial Sequence
  derived and/or modified CDS sequence (AUadapt) from InfluenzaB__AY581945__HA
augaaggccaucaucgugcugcucauggucgugaccaguaacgccgaccgcaucugcaccggcaucacguccagcaacuccccgcauguggucaagaccgcgacccagggggaggugaacgugaccggcgucaucccgcugacgaccacccccaccaagagccacuucgccaaccugaaggggacgaagacccggggcaagcucugccccaauugccugaacugcaccgaccuggacguggcccucgcccgccccaugugcguggggaccacgccguccgccaaggcgaguauccugcacgagguccggcccgugaccuccggcugcuuccccaucaugcacgaccgcaccaagauccggcagcugcccaaccuccugcgcggcuaugagaacauccggcugagcacccagaacgugaucaacgccgagcgcgcccccgggggccccuaccggcucgggacguccggcagcugucccaacgucaccucccgcgacggguucuucgccaccauggcgugggccgugccccgggacaauaagaccgccacgaacccgcugaccguggagguccccuacaucugcaccaagggcgaggaccagaucaccguguggggcuuccacagugacaacaagacgcagaugaagaaccuguacggggacuccaacccccagaaguuuaccagcuccgccaacggcgugaccacccacuacgucagccagaucgggggcuuccccaaucagacggaggacggcgggcucccgcaguccggccgcaucgugguggacuacaugguccagaagcccgggaagaccggcaccaucguguaccagcgcggggugcugcugccccagaaggucuggugcgccagcggccgguccaaggugaucaagggcagucucccccugaucggggaggcggacugccugcacgagaaguacggcgggcucaacaagaguaagccguacuacaccggcgagcacgccaaggccaucgggaacugccccaucugggucaagacgccccugaagcuggccaacggcaccaaguaucggcccccggccaagcuccugaaggagcgcggcuucuucggggcgaucgccggcuuccuggagggcgggugggaggggaugaucgccggcuggcacggcuacaccucccacggggcccauggcguggccguggcggccgaccucaagagcacccaggaggccaucaacaagaucacgaagaaccugaacucccugagcgagcucgaggucaagaaucugcagcggcuguccggggccauggacgagcuccacaacgagauccuggagcuggacgagaagguggacgaccuccgcgccgauaccaucagcucccagaucgagcuggcggugcugcucagcaacgagggcaucaucaacuccgaggacgagcaucuccuggcccuggagcggaagcugaagaagaugcugggccccagcgccgucgacaucgggaacggcugcuucgagaccaagcacaaguguaaccagaccugccucgaccgcaucgccgcggggaccuucaacgccggcgaguucucccugcccacguuugacagccugaacaucaccgccgccucccucaacgacgacgggcuggauaaccacaccauccugcuguacuacagcaccgccgcguccagccucgccgugacgcugaugaucgccaucuuuaucguguacauggucucccgggacaacgugagcugcuccaucugccuguga

SEQ ID NO: 14122 - RNA, 1755 nt, Artificial Sequence
  derived and/or modified CDS sequence (AUadapt) from InfluenzaB__EPI541351__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgaagacccggggcaagcucugccccgacugccugaacuguaccgaccuggacguggcccucgggcgccccaugugcgugggcaccacgccguccgccaaggccagcauccugcacgagguccggcccgugaccuccggcugcuuccccaucaugcaugaccgcaccaagauccggcagcuggcgaaccuccugcgcggguacgagaacauccggcugagcacccagaacgugaucgacgccgagaaggcccccggcgggccguaucgccucggcacguccgggucgugccccaacgccaccuccaagagcggcuucuucgcgaccauggccugggccguccccaaggacaauaacaagaacgccaccaacccccugacgguggaggugccguacaucugcgccgagggcgaggaccagaucaccgucuggggguuccauuccgacaacaagacccagaugaagaaccuguacggcgacagcaacccccagaaguuuaccuccagcgcgaacggggugacgacccacuacgugucccagaucggcggcuuccccgaccagcgggaggacgggggccucccccagagugggcgcaucgucguggacuacaugaugcagaagccgggcaagaccgggaccaucguguaccagcggggcguccugcugccccagaagguguggugcgccuccggccgcagcaaggugaucaaggggucgcucccccugaucggcgaggccgacugucugcacgagaaguacgggggccucaacaaguccaagcccuacuacacgggggagcacgccaaggccaucggcaacuguccgaucugggucaagacgccccugaagcuggcgaacggcaccaaguaccggccgcccgccaagcuccugaaggagcgcggguucuucggcgccaucgccggguuccuggagggcgggugggagggcaugaucgccggcuggcacggguacaccagucacggcgcgcacgggguggccgucgccgccgaccucaaguccacccaggaggccaucaacaagaucaccaagaaccugaacagccuguccgagcucgaggugaagaaucugcagcggcugagcggcgcgauggacgagcuccacaacgagauccuggagcuggacgagaagguggacgaccuccgcgccgauaccaucuccagccagaucgagcuggccguccugcucuccaacgagggcaucaucaacucggaggacgagcaccuccuggcccuggagcggaagcugaagaagaugcuggggcccuccgcgguggacaucggcaaugggugcuucgagaccaagcacaagugcaaccagacgugccucgaccgcaucgccgccggcaccuuuaacgccggggaguucagccugcccaccuucgacucccugaacaucaccgccgcgagccucaaugacgacggccuggacaaccacaccauccugcuguacuacuccacggccgccaguucccucgccgugacccugaugcuggccaucuucaucgucuacauggugagccgggacaacguguccugcagcaucugccucuga

SEQ ID NO: 14123 - RNA, 1755 nt, Artificial Sequence
  derived and/or modified CDS sequence (AUadapt) from InfluenzaB__EPI541760__HA
augaaggccgugaucguccugcucaugguggugaccaguaacgccgaccgcaucugcaccggcaucacguccagcaacagcccccacgucgugaagaccgcgacccagggggaggugaaugucaccggcgugaucccgcugacgaccacccccaccaaguccuacuucgccaaccugaaggggacgcggacccgcggcaagcucugccccgacugccugaacuguaccgaccuggacguggcccucgggcggcccaugugcgucggcaccacgccguccgccaaggccagcauccugcacgaggugcgccccgugaccuccggcugcuuccccaucaugcaugaccggaccaagauccgccagcugcccaaccuccugcggggguacgagaagauccgccugagcacccagaacgucaucgacgcggagaaggccccgggcgggcccuaccggcucggcacguccgggaguugccccaacgccaccuccaagaucggcuucuucgccaccauggcgugggccgugcccaaggacaacuacaagaaugccaccaacccgcugacgguggagguccccuacaucugcaccgagggcgaggaccagaucaccguguggggguuccacagcgauaacaagacccagaugaagucccuguacggcgacagcaacccccagaaguucacguccagcgccaauggggugaccacccacuacgucucccagaucggcgacuuccccgaccagaccgaggacggcgggcucccgcagagcggccgcaucgugguggauuacaugaugcagaagcccgggaagacgggcaccaucgucuaccagcgcggggugcugcugccccagaagguguggugcgccuccggccggagcaaggucaucaagggcucgcucccccugaucggggaggcggacugccugcaugaggaguacggcgggcucaacaaguccaagccguacuacaccggcaagcacgccaaggccaucgggaacugccccaucugggugaagacgccccugaagcuggccaauggcaccaaguaccggcccccggccaagcuccugaaggagcgcggcuucuucggggcgaucgccggcuuccuggagggcgggugggaggggaugaucgccggcuggcacggcuacaccagccauggggcccacggcgucgccguggcggccgaccucaaguccacccaggaggccaucaacaagaucaccaagaaccugaacagccuguccgagcucgaggugaagaaccugcagcggcugaguggggccauggacgagcuccacaacgagauccuggagcuggacgagaaggucgacgaccuccgcgccgacacgaucuccagucagaucgagcuggcggugcugcucuccaacgagggcaucaucaacagcgaggacgagcaccuccuggcccuggagcggaagcugaagaagaugcugggccccuccgccguggacaucgggaacggcuguuucgagaccaagcacaagugcaaccagaccugccucgaccgcaucgccgcggggaccuucaaugccggcgaguucagccugcccaccuucgacucccugaacaucacggccgccagccucaacgaugacgggcuggacaaccacaccauccugcuguacuacuccaccgccgcgagcucccucgccgucacccugaugcuggccaucuuuaucguguacauggugagccgggacaacgucuccugcagcaucugccucuga

SEQ ID NO: 14124 - RNA, 1758 nt, Artificial Sequence
  derived and/or modified CDS sequence (AUadapt) from InfluenzaB__EPI477397__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccacuuugccaaccugaaggggacggagacccggggcaagcucugccccaagugccugaacugcaccgaccuggacguggcccucgggcgccccaagugcaccggcaagaucccguccgcccgggugucgauccugcacgagguccgccccgugacguccggcuguuuccccaucaugcacgaccggaccaagauccgccagcugcccaaccuccugcggggguacgagcacauccgccugagcacccacaacgugaucaacgccgaggaugcgccgggcgggcccuacaagaucggcaccuccgggucgugccccaacgucacgaacggcaacggcuucuucgccaccauggccugggccgugcccaagaacgacaagaauaagaccgcgaccaacccgcucacgaucgaggugcccuacaucugcaccgagggggaggaccagaucaccgucuggggcuuccacuccgacaacgagacccagauggccaagcuguacggggacaguaagccccagaaguucacguccucggccaacggcgugaccacccacuacgugucccagaucggcggguuccccaaccagaccgaggacggcgggcugccgcagagcggccggaucgucguggacuauauggugcagaaguccgggaagacgggcaccaucaccuaccagcgcggcauccuccugccccagaaggucuggugcgccucggggcgguccaaggugaucaagggcagccugccccucaucggggaggccgacugccugcacgagaaguacggcgggcugaacaagucgaagcccuauuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuauaccucccacggggcccacggcgucgccguggccgcggaccugaaguccacccaggaggccaucaacaagaucacgaagaaccucaacucccugagcgagcuggaggucaagaaccuccagcgccuguccggcgccauggacgagcugcacaaugagauccucgagcuggacgagaagguggacgaccugcgggccgacaccaucucgucccagaucgagcucgccgugcugcugagcaacgaggggaucaucaacuccgaggacgagcaccuccuggcgcuggagcgcaagcucaagaagaugcugggccccagugccgucgagaucgggaacggcugcuucgagaccaagcacaagugcaaccagaccugccuggaccggaucgccgccgggaccuucgacgcgggcgaguuuucccuccccacguucgacagccugaacaucaccgccgccucccugaacgacgacggccucgacaaccacaccauccugcuguauuacucgaccgccgccuccagccuggcggugacgcucaugaucgccaucuucguggucuacauggugucccgcgacaacgugagcugcuccaucugccuguga

SEQ ID NO: 14125 - RNA, 1758 nt, Artificial Sequence
  derived and/or modified CDS sequence (AUadapt) from InfluenzaB__EPI492571__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccauuucgccaaccugaaggggacggagacccggggcaagcucugccccaagugccugaacugcaccgaccuggacguggcccucgggcgccccaagugcaccggcaagaucccguccgcccgggugucgauccugcaugagguccgccccgugacguccggcugcuuccccaucaugcacgaccggaccaagauccgccagcugcccaaccuccugcggggguacgagcacauccgccugagcacccacaacgugaucaaugccgaggacgcgccgggcgggcccuacaagaucggcaccuccgggagcugccccaacgucacgaacggcaacggcuucuucgccaccauggccugggccgugcccaagaacgauaagaacaagaccgcgaccaacccgcucacgaucgaggugcccuacaucugcaccgagggggaggaccagaucaccgucuggggcuuccacuccgacaucgagacccagauggccaagcuguacggggacaguaagccccagaaguucacguccagcgccaacggcgugaccacccacuacgugucccagaucggcggguuccccaaccagaccgaggacggcgggcugccgcagucgggccggaucgucguggacuauauggugcagaaguccgggaagacgggcaccaucaccuaccagcgcggcauccuccugccccagaaggucuggugcgccagcgggcgguccaaggugaucaagggcucgcugccccucaucggggaggccgacugccugcacgagaaguacggcgggcugaacaagagcaagcccuauuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuauaccucccacggggcccacggcgucgccguggccgcggaccugaaguccacccaggaggccaucaacaagaucacgaagaaccucaacucccugagcgagcuggaggucaagaaccuccagcgccuguccggcgccauggacgagcugcacaaugagauccucgagcuggacgagaagguggacgaccugcgggccgacaccaucucgucccagaucgagcucgccgugcugcugagcaacgaggggaucaucaacuccgaggacgagcaccuccuggcgcuggagcgcaagcucaagaagaugcugggccccagugccgucgagaucgggaacggcugcuucgagaccaagcacaagugcaaccagaccugccuggaccggaucgccgccgggaccuucgacgcgggcgaguuuucccuccccacguucgacagccugaacaucaccgccgccucccugaacgacgacggccucgacaaccacaccauccugcuguauuacucgaccgccgccuccagccuggcggugacgcucaugaucgccaucuucguggucuacauggugucccgcgacaacgugagcugcuccaucugccuguga

SEQ ID NO: 14126 - RNA, 1758 nt, Artificial Sequence
  derived and/or modified CDS sequence (AUadapt) from InfluenzaB__EPI498340__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccacuuugccaaccugaaggggacggagacccggggcaagcucugccccaagugccugaacugcaccgaccuggacguggcccucgggcgccccaagugcaccggcaagaucccguccgcccgggugucgauccugcacgagguccgccccgugacguccggcugcuuucccaucaugcacgaccggaccaagauccgccagcugcccaaccuccugcggggguacgagcacauccgccugagcacccacaacgugaucaacaccgaggacgccccgggcgggcccuacaagaucggcacguccgggaguugccccaacgucaccaacggcaacggcuucuucgcgaccauggccugggccgugcccaagaacgacaagaacaagaccgccacgaacccgcucaccaucgaggugcccuacaucuguaccgagggggaggaccagaucaccgucuggggcuuccacuccgacaucgagacgcagauggcgaagcuguacggggacagcaagccccagaaguucaccuccucggccaacggcgugaccacccacuaugugucccagaucggcggguuccccaaccagacggaggacggcgggcugccgcagagcggccggaucgucguggacuacauggugcagaaguccgggaagaccggcaccaucaccuaccagcgcggcauccuccugccccagaaggucuggugcgccucggggcgguccaaggugaucaagggcagccugccccucaucggggaggccgacugucugcacgagaaguacggcgggcugaacaagucgaagcccuacuacacgggcgagcacgccaaggcgaucggcaacugcccgaucugggugaagacgccccucaagcuggccaacgggaccaaguaucgcccgcccgccaagcugcucaaggagcggggcuucuucggggccaucgccggcuuccuggagggcgggugggagggcaugaucgcgggguggcacggcuacaccucccacggggcccacggcgucgccguggccgccgaccugaaguccacccaggaggcgaucaacaagaucaccaagaaccucaacucccugagugagcuggaggucaagaaccuccagcgccuguccggcgccauggacgagcugcacaacgagauccucgagcuggacgagaagguggacgaccugcgggccgacaccaucucgucccagaucgagcucgccgugcugcugagcaacgaggggaucaucaauuccgaggacgagcaccuccuggcccuggagcgcaagcucaagaagaugcugggccccucggcggucgagaucgggaacggcugcuucgagaccaagcacaagugcaaccagaccugccuggaccggaucgccgccgggacguuugacgccggcgaguucucccuccccaccuucgacagccugaacaucaccgcggccucccugaacgacgacggccucgacaaccauaccauccugcuguacuacucgacggccgccuccagccuggccgugacccucaugaucgcgaucuucguggucuacauggugucccgcgacaacgugagcugcuccaucugccuguga

SEQ ID NO: 14127 - RNA, 1758 nt, Artificial Sequence
  derived and/or modified CDS sequence (AUadapt) from InfluenzaB__EPI516490__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccacuuugccaaccugaaggggacggagacccggggcaagcucugccccaagugccugaacugcaccgaccuggacguggcccucgggcgccccaagugcaccggcaagaucccguccgcccgggugucgauccugcacgagguccgccccgugacguccggcugcuuucccaucaugcacgaccggaccaagauccgccagcugcccaaccuccugcggggguacgagcacauccgccugagcacccacaacgugaucaacgccgaggacgcgccgggcgggcccuacaagaucggcaccuccgggaguugccccaacgucacgaacggcaacggcuucuucgccaccauggccugggccgugcccaagaacgacaagaacaagaccgcgaccaacccgcucacgaucgaggugcccuacaucuguaccgagggggaggaccagaucaccgucuggggcuuccacuccgacaacgagauccagauggccaagcuguacggggacagcaagccccagaaguucaccuccucggccaacggcgugacgacccauuacgugucccagaucggcggguuccccaaccagaccgaggacggcgggcugccgcagagcggccggaucgucguggacuacauggugcagaaguccgggaagaccggcacgaucaccuaccagcgcggcauccuccugccccagaaggucuggugcgccucggggcgguccaaggugaucaagggcagccugccccucaucggggaggccgauugccugcacgagaaguacggcgggcugaacaagucgaagcccuacuacaccggcgagcacgcgaaggccaucggcaacugcccgaucugggugaagacgccccucaagcuggccaacgggaccaaguaucgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucaccaagaaccucaacucccugagugagcuggaggucaagaaccuccagcgccuguccggcgccauggacgagcugcacaacgagauccucgagcuggacgagaagguggacgaccugcgggccgacacgaucucgucccagaucgagcucgccgugcugcugagcaacgaggggaucaucaauuccgaggacgagcaccuccuggcgcuggagcgcaagcucaagaagaugcugggccccucggccgucgagaucgggaacggcugcuucgagaccaagcacaagugcaaccagaccugccuggaccggaucgccgccgggaccuuugacgcgggcgaguucucccuccccaccuucgacagccugaacaucacggccgccucccugaacgacgacggccucgacaaccauaccauccugcuguacuacucgaccgccgccuccagccuggcggugacccucaugaucgccaucuucguggucuacauggugucccgcgacaacgugagcugcuccaucugccuguga

SEQ ID NO: 14128 - RNA, 1755 nt, Artificial Sequence; identical to SEQ ID NO: 14093
  derived and/or modified CDS sequence (AUadapt) from InfluenzaB__EPI538119__HA

SEQ ID NO: 14129 - RNA, 1755 nt, Artificial Sequence; identical to SEQ ID NO: 14111
  derived and/or modified CDS sequence (AUadapt) from InfluenzaB__EPI538125__HA

SEQ ID NO: 14130 - RNA, 1755 nt, Artificial Sequence
  derived and/or modified CDS sequence (AUadapt) from InfluenzaB__EPI556422__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacuguaccgaccuggacguggcccucgggcggcccaugugcgugggcaccacgccguccgccaaggccagcauccugcacgagguccgccccgugaccuccggcugcuuccccaucaugcacgaucggaccaagauccgccagcugcccaaccuccugcggggguacgagaagauccgccugagcacccagaacgugaucgacgcggagaaggccccgggcgggcccuaccggcucggcacguccgggagcugucccaacgccaccuccaagaucggcuucuucgccaccauggcgugggccguccccaaggacaacuacaagaacgccaccaacccgcugacgguggaggugcccuauaucugcaccgagggcgaggaccagaucaccgucuggggguuccacagcgacaucaagacccagaugaagucccuguacggcgauagcaacccccagaaguucacguccagcgccaacggggugaccacccacuacgugucccagaucggcgauuuccccgaccagaccgaggacggcgggcucccgcagagcggccgcaucgucguggacuacaugaugcagaagcccgggaagacgggcaccaucguguaccagcgcgggguccugcugccccagaagguguggugcgccuccggccggaguaaggugaucaagggcucgcucccccugaucggggaggcggacugccugcacgaggaguacggcgggcucaacaaguccaagccguacuauaccggcaagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcauggcuacaccagccacggggcccacggcguggccgucgcggccgaccucaaguccacccaggaggccaucaacaagaucaccaagaaccugaauagccuguccgagcucgaggugaagaaccugcagcggcugagcggggccauggacgagcuccacaacgagauccuggagcuggacgagaagguggaugaccuccgcgccgacacgaucuccagccagaucgagcuggcgguccugcucuccaacgagggcaucaucaacagcgaggacgagcaccuccuggcccuggagcggaagcugaagaagaugcugggccccuccgccguggauaucgggaacggcugcuucgagaccaagcacaagugcaaccagaccugccucgaucgcaucgccgcggggaccuucaacgccggcgaguucagccugcccaccuucgacucccugaacaucacggccgccagccucaaugacgacgggcuggacaaccacaccauccugcuguacuacuccaccgccgcgaguucccucgccgugacccugaugcuggccaucuucaucgucuacauggugagccgggacaacguguccugcagcaucugccucuga

SEQ ID NO: 14131 - RNA, 1755 nt, Artificial Sequence
  derived and/or modified CDS sequence (AUadapt) from InfluenzaB__EPI614608__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacuguaccgaccuggacguggcccucgggcggcccaugugcgugggcaccacgccguccgccaaggccagcauccugcacgagguccgccccaucaccuccggcugcuuccccaucaugcacgaucggaccaagauccgccagcugcccaaccuccugcggggguacgagaagauccgccugagcacccagaacgugaucgacgcggagaaggccccgggcgggcccuaccggcucggcacguccgggagcugucccaacgccaccuccaagaucggcuucuucgccaccauggcgugggccgugcccaaggacaacuacaagaacgccaccaacccgcugacggucgaggugcccuauaucugcaccgagggcgaggaccagaucaccguguggggguuccacagcgacgagaagacccagaugaagucccuguacggcgauucgaacccccagaaguucacguccagcgccaacggggucaccacccacuacgugucccagaucggcgauuuccccgaccagaccgaggacggcgggcucccgcagagcggccgcaucguggucgacuacaugaugcagaagcccgggaagacgggcaccaucguguaccagcgcggggugcugcugccccagaaggucuggugcgccuccggccggaguaaggugaucaagggcagccucccccugaucggggaggcggacugccugcacgaggaguacggcgggcucaacaaguccaagccguacuauaccggcaagcacgccaaggccaucgggaacugccccaucugggugaagacgccccugaagcuggccaacggcaccaaguaccggcccccggccaagcuccugaaggagcgcggcuucuucggggcgaucgccggcuuccuggagggcgggugggaggggaugaucgccggcuggcauggcuacaccagccacggggcccacggcgucgccguggcggccgaccucaaguccacccaggaggccaucaacaagaucaccaagaaccugaauagccuguccgagcucgaggucaagaaccugcagcggcugucgggggccauggacgagcuccacaacgagauccuggagcuggacgagaagguggaugaccuccgcgccgacacgaucuccagccagaucgagcuggcggugcugcucuccaacgagggcaucaucaacagcgaggacgagcaccuccuggcccuggagcggaagcugaagaagaugcugggccccuccgccgucgauaucgggaacggcugcuucgagaccaagcacaagugcaaccagaccugccucgaucgcaucgccgcggggaccuucaacgccggcgaguucagccugcccaccuucgacucccugaacaucacggccgccagccucaaugacgacgggcuggacaaccacaccauccugcuguacuacuccaccgccgcgaguucccucgccgugacccugaugcuggccaucuucaucguguacauggucagccgggacaacguguccugcagcaucugccucuga

SEQ ID NO: 14132 - RNA, 1755 nt, Artificial Sequence
  derived and/or modified CDS sequence (AUadapt) from InfluenzaB__EPI614610__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaaguccuacuucgccaaccugaaggggacgcggacccgcggcaagcucugccccgacugccugaauugcaccgaccuggacguggcccucgggcggcccaugugcgugggcaccacgccguccgccaaggccagcauccugcacgagguccgccccgugaccuccggcugcuuucccaucaugcacgaccggaccaagauccgccagcugcccaaccuccugcggggguacgagaagauccgccugagcacccagaacgugaucgacgcggagaaggccccgggcgggcccuaucggcucggcacguccgggagcugccccaacgccaccuccaagaucggcuucuucgccaccauggcgugggccguccccaaggacaacuauaagaacgccaccaacccgcugacgguggaggugcccuacaucugcaccgagggcgaggaccagaucaccgucuggggguuccacagugacgagaagacccagaugaagucccuguacggcgacagcaacccccagaaguucacguccagcgccaauggggugaccacccacuacgugucccagaucggcgacuuccccgaccagaccgaggacggcgggcucccgcagagcggccgcaucgucguggauuacaugaugcagaagcccgggaagacgggcaccaucguguaccagcgcgggguccugcugccccagaagguguggugcgccuccggccggagcaaggugaucaagggcucgcucccccugaucggggaggcggacugccugcaugaggaguacggcgggcucaacaaguccaagccguacuacaccggcaagcacgccaaggccaucgggaacugccccaucugggucaagacgccccugaagcuggccaauggcaccaaguaccggcccccggccaagcuccugaaggagcgcggcuucuucggggcgaucgccggcuuccuggagggcgggugggaggggaugaucgccggcuggcacggcuacaccagccauggggcccacggcguggccgucgcggccgaccucaaguccacccaggaggccaucaacaagaucaccaagaaccugaacagccuguccgagcucgaggugaagaaccugcagcggcugaguggggccauggacgagcuccacaacgagauccuggagcuggacgagaagguggacgaccuccgcgccgacacgaucuccagucagaucgagcuggcgguccugcucuccaacgagggcaucaucaacagcgaggacgagcaccuccuggcccuggagcggaagcugaagaagaugcugggccccuccgccguggacaucgggaacggcuguuucgagaccaagcacaagugcaaccagaccugccucgaccgcaucgccgcggggaccuucaaugccggcgaguucagccugcccaccuucgacucccugaacaucacggccgccagccucaacgaugacgggcuggacaaccacaccauccugcuguacuacuccaccgccgcgagcucccucgccgugacccugaugcuggccaucuuuaucgucuacauggugagccgggacaacguguccugcagcaucugccucuga

SEQ ID NO: 14133 - RNA, 1758 nt, Artificial Sequence
  derived and/or modified CDS sequence (AUadapt) from InfluenzaB__AAA43697__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacgaagacccggggcaagcucugccccaagugucugaacugcaccgaccuggacguggcccucgcccgccccaagugcauggggaccaucccguccgccaaggcgagcauccugcacgaggugaagcccgucacguccggcugcuuccccaucaugcacgaccggaccaagauccgccagcugcccaaccuccugcggggcuacgagcauauccgccugucgacccacaacgugaucaacgccgagaccgcccccgggggccccuacaagguggggacguccggcagcugccccaacgucaccaacgggaacggcuucuucgccaccauggcgugggccgugcccaagaacgauaacaacaagaccgccacgaacccgcucaccguggagguccccuacaucugcaccgagggcgaggaccagaucaccguguggggguuccacuccgacucggagacgcagauggugaagcuguacggcgacuccaagccccagaaguucaccagcuccgccaauggggucaccacccacuacgugucgcagaucggcggcuuccccaaccaggccgaggacgggggccugccgcaguccgggcggaucguggucgacuacauggugcagaaguccggcaagacggggaccaucaccuaccagcgcggcauccuccugccccagaagguguggugcgcguccggccggagcaaggucaucaaggggucgcugccccucaucggcgaggccgacugucugcacgagaaguacgggggccugaacaaguccaagcccuacuacaccggggagcacgccaaggccaucggcaacugcccgaucugggugaagacgccccucaagcuggccaacggcaccaaguaccgcccgcccgcgaagcugcucaaggagcggggguucuucggcgccaucgccggguuccuggagggcgggugggagggcaugaucgccggcuggcauggguacaccucgcacggcgcccacggggucgcgguggccgccgaccugaaguccacccaggaggccaucaacaagaucacgaagaaccucaacagccuguccgagcuggaggugaagaaccuccagcgccugucgggcgccauggacgagcugcacaacgagauccucgagcuggaugagaaggucgacgaccugcgggcggacaccaucuccagccagaucgagcucgccgugcugcuguccaacgagggcaucaucaacucggaggacgagcaccuccuggcccuggagcgcaagcucaagaagaugcuggggccguccgccguggagaucggcaacgggugcuucgagaccaagcacaaguguaaccagaccugccuggaccggaucgcggccggcaccuucaacgccggggaguucagccuccccacguucgacucccugaacaucaccgccgccucgcugaacgacgauggccucgacaaccacaccauccugcuguacuacuccaccgcggccagcucccuggccgucacgcucaugaucgccaucuucaucguguacauggugucgcgcgacaacgucuccugcagcaucugccuguga

SEQ ID NO: 14134 - RNA, 1755 nt, Artificial Sequence
  derived and/or modified CDS sequence (AUadapt) from InfluenzaB__EPI271545__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacugcaccgaucuggacguggcccucgggcggcccaugugcgugggcaccacgccguccgccaaggccagcauccugcacgagguccgccccgugaccuccggcugcuuccccaucaugcacgaucggaccaagauccgccagcugcccaaccuccugcggggguacgagaacauccgccugagcacccagaacgugaucgacgcggagaaggccccgggcgggcccuaccggcucggcacguccgggagcugucccaacgccaccuccaagaucggcuucuucgccaccauggcgugggccguccccaaggacaacuacaagaacgccaccaauccgcugacgguggaggugcccuacaucugcaccgagggcgaggaccagaucaccgucuggggguuccacagcgacaacaagacccagaugaagucccuguauggcgacucgaacccccagaaguucacguccagcgccaacggggugaccacccacuaugugucccagaucggcgacuuccccgaccagaccgaggacggcgggcucccgcagagcggccgcaucgucguggacuacaugaugcagaagcccgggaagacgggcaccaucguguaccagcgcgggguccugcugccccagaagguguggugugccuccggccggagcaaggugaucaagggcagccucccccugaucggggaggcggacugccugcacgagaaguacggcgggcucaacaaguccaagccguauuacaccggcgagcacgccaaggccaucgggaacugccccaucugggucaagacgccccugaagcuggccaacggcaccaaguaccggcccccggccaagcuccugaaggagcgcggcuucuucggggcgaucgccggcuuucuggagggcgggugggaggggaugaucgccggcuggcacggcuacaccagccacggggcccacggcguggccgucgcggccgaccucaaguccacccaggaggccaucaacaagaucaccaagaaucugaacagccuguccgagcucgaggugaagaaccugcagcggcugucgggggccauggacgagcuccacaacgagauccuggagcuggacgagaagguggaugaccuccgcgccgacacgaucuccagccagaucgagcuggcgguccugcucuccaacgagggcaucaucaacagcgaggacgagcaucuccuggcccuggagcggaagcugaagaagaugcugggccccuccgccguggacaucgggaacggcugcuucgagaccaagcacaagugcaaccagaccugccucgaucgcaucgccgcggggaccuucaacgccggcgaguucagccugcccaccuucgacucccugaacaucacggccgccagucucaacgacgacgggcuggacaaccacaccauccugcuguacuacuccaccgccgcgaguucccucgccgugacccugaugcuggccaucuucaucgucuacauggugagccgggacaacguguccugcagcaucugccucuga

SEQ ID NO: 14135 - RNA, 1755 nt, Artificial Sequence
  derived and/or modified CDS sequence (AUadapt) from InfluenzaB__AGB08329__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuauuucgccaaccugaaggggacgcggacccgcggcaagcucugccccgacugccugaacugcaccgaccuggauguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguaugagaacauccgccugagcacccagaacgugaucgacgcggagaaggccccgggcgggcccuaccggcucggcacguccgggagcugccccaacgccaccuccaagaucggcuuuuucgccaccauggcgugggccguccccaaggacaacuacaagaacgccaccaacccgcugacgguggaggugcccuacaucugcaccgagggcgaggaucagaucaccgucuggggguuccacagcgacaacaagauccagaugaagucccuguacggcgacucgaauccccagaaguucaccuccagcgccaacggggugacgacccacuacgugucccagaucggcgacuuccccgaccagaccgaggauggcgggcucccgcagagcggccgcaucgucguggacuacaugaugcagaagcccgggaagaccggcacgaucguguaccagcgcgggguccugcugccccagaagguguggugcgccuccggccggagcaaggugaucaagggcagccucccccugaucggggaggcggacugucugcacgagaaguacggcgggcucaacaaguccaagccguacuacaccggcgagcacgccaaggccaucgggaacugccccaucugggucaagacgccccugaagcuggccaauggcaccaaguaccggcccccggccaagcuccugaaggagcgcggcuucuucggggcgaucgccggcuuccuggagggcgggugggaggggaugaucgccggcuggcacggcuacaccagccacggggcccauggcguggccgucgcggccgaccucaaguccacccaggaggccaucaacaagaucaccaagaaccugaacagccuguccgagcucgaggugaagaaccugcagcggcugucgggggccauggacgagcuccauaacgagauccuggagcuggacgagaagguggacgaccuccgcgccgacaccaucuccagccagaucgagcuggcgguccugcucuccaacgagggcaucaucaacagugaggacgagcaccuccuggcccuggagcggaagcugaagaagaugcugggccccuccgccguggacaucgggaacggcugcuucgagacgaagcacaagugcaaucagaccugccucgaccgcaucgccgcggggaccuucaacgccggcgaguucagccugcccaccuucgacucccugaauaucaccgccgccagccucaacgacgacgggcuggacaaccacacgauccugcuguacuauuccaccgccgcgagcucccucgccgugacccugaugcuggccaucuucaucgucuacauggugagccgggacaacguguccugcagcaucugccucuga

SEQ ID NO: 14136 - RNA, 1755 nt, Artificial Sequence
  derived and/or modified CDS sequence (AUadapt) from InfluenzaB__EPI294880__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacuguaccgaccuggacguggcccucgggcggcccaugugcgugggcaccacgccguccgccaaggccagcauccugcacgagguccgccccgugaccuccggcugcuuccccaucaugcaugaccggaccaagauccgccagcugcccaaccuccugcggggguacgagaacauccgccugagcacccagaacgugaucgacgcggagaaggccccgggcgggcccuaucggcucggcacguccgggagcugccccaacgccaccuccaagaucggcuucuucgccaccauggcgugggccguccccaaggacaacuauaagaacgccaccaacccgcugacgguggaggugcccuacaucugcaccgagggcgaggaccagaucaccgucuggggguuccacagugacgacaagacccagaugaagucccuguacggcgacagcaacccccagaaguucacguccagugccaacggggugaccacccacuacgugucccagaucggcgacuuccccgaccagaccgaggacggcgggcucccgcagaguggccgcaucgucguggacuacaugaugcagaagcccgggaagacgggcaccaucguguaccagcgcgggguccugcugccccagaagguguggugcgccuccggccggagcaaggugaucaagggcucgcucccccugaucggggaggcggacugucugcacgagaaguacggcgggcucaacaaguccaagccguacuacaccggcgagcacgccaaggccaucgggaacugucccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccagucacggggcccacggcguggccgucgcggccgaccucaaguccacccaggaggccaucaacaagaucaccaagaaccugaacagccuguccgagcucgaggugaagaaucugcagcggcugagcggggccauggacgagcuccacaacgagauccuggagcuggacgagaagguggacgaccuccgcgccgauacgaucuccagccagaucgagcuggcgguccugcucuccaacgagggcaucaucaacagcgaggacgagcaccuccuggcccuggagcggaagcugaagaagaugcugggccccuccgccguggacaucgggaauggcugcuucgagaccaagcacaagugcaaccagaccugccucgaccgcaucgccgcggggaccuuuaacgccggcgaguucagccugcccaccuucgacucccugaacaucacggccgccagccucaaugacgacgggcuggacaaccacaccauccugcuguacuacuccaccgccgcgaguucccucgccgugacccugaugcuggccaucuucaucgucuacauggugagccgggacaacguguccugcagcaucugccucuga

SEQ ID NO: 14137 - RNA, 1752 nt, Artificial Sequence
  derived and/or modified CDS sequence (AUadapt) from InfluenzaB__CY018765__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaagucccacuucgccaaccugaaggggacgaagacccggggcaagcucugccccaacugccugaacuguaccgaccuggacguggcccucgggcgccccaugugcaugggcaccaucccguccgccaaggccagcauccugcacgaggugcggcccgucacguccggcugcuuccccaucaugcaugaccgcaccaagauccggcagcugcccaaccuccugcgcggguacgagaacauccggcugagcacccacaacgugaucaaugcggagcgcgccccgggcgggcccuaccggcucggcaccuccgggagcugccccaacgugacgucccgcaacggcuucuucgccaccauggccugggcggucccccgggauaacaagaccgccaccaacccgcugacgguggaggugcccuacaucugcaccaagggcgaggaccagaucaccgucuggggguuccacagugacgacaagacccagaugaagaaccuguacggcgacuccaacccccagaaguucacgaguuccgccaacggggugaccacccacuacgugagccagaucggcgacuuccccaaccagaccgaggauggcgggcucccgcaguccggccgcaucgucguggacuacauggugcagaagcccgggaagacgggcaccaucgucuaccagcgcggggugcugcugccccagaagguguggugcgccagcggccgguccaaggucaucaagggcagccucccccugaucggggaggccgacugucugcacgagaaguacggcgggcucaacaagagcaagccguacuacaccggcgagcacgcgaaggccaucgggaauugccccaucugggugaagacgccccugaagcuggccaacggcaccaaguaccggcccccggccaagcuccugaaggagcgcggcuucuucggggccaucgcgggcuuccuggagggcgggugggaggggaugaucgccggcuggcacggcuauaccucccacggggcccacggcgucgccguggccgcggaccucaagagcacccaggaggccaucaacaagaucaccaagaaccugaacucccugagugagcucgaggugaagaaccugcagcggcuguccggggccauggacgagcuccacaacgagauccuggagcuggacgagaaggucgacgaccuccgcgccgauacgaucucgucccagaucgagcuggccgugcugcucagcaacgagggcaucaucaacuccgaggacgagcaccuccuggcgcuggagcggaagcugaagaagaugcugggccccagcgccguggauaucgggaacggcugcuucgagaccaagcacaagugcaaccagaccugccucgaucgcaucgccgccgggaccuucaacgcgggcgaguucucccugcccaccuucgacagccugaacaucacggccgccucccucaaugacgacgggcuggacaaccacaccauccugcuguacuacaguaccgccgccuccagccucgcggucacccugaugaucgccaucuucaucguguacauggugucccgggacaacgucagcugcuccaucugccuguga

SEQ ID NO: 14138 - RNA, 1755 nt, Artificial Sequence
  derived and/or modified CDS sequence (AUadapt) from InfluenzaB__ABL76276__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaagucccacuucgccaaccugaaggggacgaagacccggggcaagcucugcccgaccugccugaacugcaccgaucuggacguggcccucgggcgccccaugugcgugggcaucacgcccuccgccaaggccucgauccugcacgagguccggcccgugaccuccggcugcuuccccaucaugcacgaccgcaccaagauccggcagcugcccaaucuccugcgcggguacgagaagauccggcugagcacccagaacgugaucaacgcggagaaggccccgggcgggcccuaccgccucggcacguccgggagcugccccaaugccaccucccggagcggcuucuucgccaccauggcgugggccgucccccgcgacaacaacaagaccgccacgaacccgcugaccguggaggugccccauaucugcaccaaggaggaggaccagaucaccgucuggggcuuccacuccgacaacaagacgcagaugaagaaccuguacggggauucgaacccccagaaguucaccuccagcgccaacggcgugaccacccacuacgugucccagaucgggggcuuucccgaccagacggaggacggcgggcucccgcagagcggccggaucgucguggacuacauggugcagaagcccgggaagaccggcaccaucgucuaccagcgcgggauccugcugccccagaagguguggugcgccuccggccggaguaaggugaucaagggcucgcucccccugaucggggaggcggacugccugcacgagaaguacggcgggcucaacaaguccaagccguacuacaccggcgagcaugccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcauggcuacaccagccacggggcccacggcguggccgucgcggccgaccucaaguccacccaggaggccaucaacaagaucacgaagaaccugaauagccuguccgagcucgaggugaagaaccugcagcgccugucgggggccauggacgagcuccacaacgagauccuggagcuggacgagaagguggacgaucuccgggccgacaccaucuccagccagaucgagcuggcgguccugcucuccaacgagggcaucaucaacagcgaggacgagcaccuccuggcccuggagcgcaagcugaagaagaugcugggccccuccgccguggauaucgggaacggcugcuucgagaccaagcacaagugcaaccagaccugccucgaucggaucgccgcggggaccuucaacgccggcgaguucagccugcccacguucgacucccugaacaucaccgccgccucgcucaaugacgacgggcuggacaaccacaccauccugcuguacuacuccaccgccgcgaguucccucgccgugacgcugaugaucgccaucuucaucgucuacaugaucagccgcgacaacguguccugcagcaucugccuguga

SEQ ID NO: 14139 - RNA, 1755 nt, Artificial Sequence
  derived and/or modified CDS sequence (AUadapt) from InfluenzaB__ABL76287__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaagucccacuucgccaaccugaaggggacgaagacccggggcaagcucugcccgaccugccugaacugcaccgaccuggauguggcccucgggcgccccaugugcgugggcgucacgcccuccgccaaggccucgauccugcacgaggugcggcccgugaccuccggcugcuuccccaucaugcacgaccgcaccaagauccggcagcugcccaaccuccugcgcggguaugagaagauccggcugagcacccagaacgucaucaacgcggagaaggccccgggcgggcccuaccgccucggcacguccgggagcugccccaacgccaccucccggagcggcuuuuucgccaccauggcgugggccgugccccgcgacaacaacaagaccgccacgaacccgcugaccaucgaggugccccacaucugcaccaaggaggaggaccagaucaccgucuggggcuuucacuccgacaacaagauccagaugaagaaccuguacggggacucgaacccccagaaguuuacguccagcgccaacggcgugaccacccacuacgugucccagaucgggggcuuccccgaccagaccgaggacggcgggcucccgcagagcggccggaucgucguggauuacauggugcagaagcccgggaagacgggcaccaucgucuaccagcgcgggauccugcugccccagaagguguggugcgccuccggccggagcaaggugaucaagggcucgcucccccugaucggggaggcggacugccugcacgagaaguauggcgggcucaacaaguccaagccguacuacaccggcgagcacgccaaggccaucgggaacugccccaucugggucaagacgccccugaagcuggccaacggcaccaaguaucggcccccggccaagcuccugaaggagcgcggcuucuucggggcgaucgccggcuuccuggagggcgggugggaggggaugaucgccggcuggcacggcuacaccagccacggggcccacggcguggccgucgcggccgaucucaaguccacccaggaggccaucaacaagaucaccaagaaccugaacagccuguccgagcucgaggugaagaaccugcagcgccugucgggggccauggacgagcuccacaaugagauccuggagcuggacgagaagguggacgaccuccgggccgacacgaucuccagccagaucgagcuggcgguccugcucuccaacgagggcaucaucaacagcgaggaugagcaccuccuggcccuggagcgcaagcugaagaagaugcugggccccuccgccguggacaucgggaacggcugcuucgagaccaagcacaagugcaaccagaccugucucgaccggaucgccgcggggaccuucaacgccggcgaguucagccugcccaccuucgacucccugaacaucacggccgccagucucaacgacgacgggcuggacaaccacaccauccugcuguacuacuccaccgccgcgaguucccucgccgugacccugaugaucgccaucuucaucgucuacaugaucagccgcgacaacguguccugcagcaucugccuguga

SEQ ID NO: 14140 - RNA, 1755 nt, Artificial Sequence
  derived and/or modified CDS sequence (AUadapt) from InfluenzaB__ABL76298__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaagucccacuucgccaaccugaaggggacgaagacccggggcaagcucugcccgaccugccugaauugcaccgaccuggacguggcccucgggcgccccaugugcgugggcgucacgcccuccgccaaggccagcauccugcacgaggugcggcccgugaccuccggcugcuuucccaucaugcacgaccgcaccaagauccggcagcugcccaaccuccugcgcggguacgagaagauccggcugagcacccagaacgucaucaaugcggagaaggccccgggcgggcccuaccgccucggcacguccgggucgugccccaacgccaccucccggagcggcuucuucgccaccauggcgugggccgugccccgcgauaacaacaagaccgccacgaacccgcugaccguggaggucccccacaucugcaccaaggaggaggaccagaucaccguguggggcuuucacuccgacaacaagacgcagaugaagaaccuguacggggacagcaauccccagaaguucaccuccagcgccaacggcgugaccacccacuacgucucccagaucgggggcuuccccgaucagacggaggacggcgggcucccgcagagcggccggaucgugguggacuacaugguccagaagcccgggaagaccggcaccaucguguaccagcgcgggauccugcugccccagaagguguggugcgccuccggccggagcaaggucaucaagggcagucucccccugaucggggaggcggacugccugcacgagaaguacggcgggcucaacaaguccaagccguacuauaccggcgagcacgccaaggccaucgggaacugccccaucugggugaagacgccccugaagcuggccaacggcaccaaguaccggcccccggccaagcuccugaaggagcgcggcuucuucggggcgaucgccggcuuucuggagggcgggugggaggggaugaucgccggcuggcacggcuacaccagccacggggcccacggcgucgccguggcggccgaccucaaguccacccaggaggccaucaauaagaucacgaagaaccugaacagccuguccgagcucgaggugaagaaccugcagcgccugagcggggccauggacgagcuccacaaugagauccuggagcuggacgagaaggucgacgaccuccgggccgacaccaucuccagccagaucgagcuggcggugcugcucuccaacgagggcaucaucaauucggaggacgagcaccuccuggcccuggagcgcaagcugaagaagaugcugggccccuccgccguggacaucgggaacggcugcuucgagaccaagcauaagugcaaccagaccugccucgaccggaucgccgcggggaccuucaacgccggcgaguuuagccugcccacguucgacucccugaacaucaccgccgccagccucaacgacgaugggcuggacaaccacaccauccugcuguacuacuccaccgccgcgagcucccucgccgucacgcugaugaucgccaucuuuaucguguacauggugagccgcgacaacgucuccugcagcaucugccuguga

SEQ ID NO: 14141 - RNA, 1755 nt, Artificial Sequence
  derived and/or modified CDS sequence (AUadapt) from InfluenzaB__ABL76309__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaagucccacuucgccaaccugaaggggacgaagacccggggcaagcucugcccgaccugccugaauugcaccgaccuggacguggcccucgggcgccccaugugcgugggcgucacgcccuccgccaaggccagcauccugcacgaggugcggcccgugaccuccggcugcuuucccaucaugcacgaccgcaccaagauccggcagcugcccaaccuccugcgcggguacgagaagauccggcugagcacccagaacgucaucaaugcggagaaggccccgggcgggcccuaccgccucggcacguccgggucgugccccaacgccaccucccggagcggcuucuucgccaccauggcgugggccgugccccgcgauaacaacaagaccgccacgaacccgcugaccguggaggucccccacaucugcaccaaggaggaggaccagaucaccguguggggcuuucacuccgacaacaagacgcagaugaagaaccuguacggggacagcaauccccagaaguucaccuccagcgccaacggcgugaccacccacuacgucucccagaucgggggcuuccccgaucagacggaggacggcgggcucccgcagagcggccggaucgugguggacuacaugguccagcgccccgggaagaccggcaccaucguguaccagcgggggauccugcugccccagaagguguggugcgccuccggccgcagcaaggucaucaagggcagucucccccugaucggggaggcggacugccugcacgagaaguacggcgggcucaacaaguccaagccguacuauaccggcgagcacgccaaggccaucgggaacugccccaucugggugaagacgccccugaagcuggccaacggcaccaaguaccggcccccggccaagcuccugaaggagcgcggcuucuucggggcgaucgccggcuuucuggagggcgggugggaggggaugaucgccggcuggcacggcuacaccagccacggggcccacggcgucgccguggcggccgaccucaaguccacccaggaggccaucaauaagaucacgaagaaccugaacagccuguccgagcucgaggugaagaaccugcagcggcugagcggggccauggacgagcuccacaaugagauccuggagcuggacgagaaggucgacgaccuccgcgccgacaccaucuccagccagaucgagcuggcggugcugcucuccaacgagggcaucaucaauucggaggacgagcaccuccuggcccuggagcggaagcugaagaagaugcugggccccuccgccguggacaucgggaacggcugcuucgagaccaagcauaagugcaaccagaccugccucgaccgcaucgccgcggggaccuucaacgccgaggaguuuagccugcccacguucgacucccugaacaucaccgccgccagccucaacgacgauggccuggacaaccacaccauccugcuguacuacuccaccgccgcgagcucccucgccgucacgcugaugaucgccaucuuuaucguguacaugaucagccgggacaacguguccugcagcaucugccuguga

SEQ ID NO: 14142 - RNA, 1755 nt, Artificial Sequence
  derived and/or modified CDS sequence (AUadapt) from InfluenzaB__ABL76331__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaagucccacuucgccaaccugaaggggacgaagacccggggcaagcucugcccgaccugccugaacugcaccgaccuggauguggcccucgggcgccccaugugcgugggcaucacgcccuccgccaaggccucgauccugcacgagguccggcccgugaccuccggcugcuuccccaucaugcacgaccgcaccaagauccggcagcugcccaaccuccugcgcggguaugagaagauccggcugagcacccagaacgugaucaacgcggagaaggccccgggcgggcccuaccgccucggcacguccgggagcugccccaacgccaccucccggucgggcuuuuucgccaccauggcgugggccgucccccgcgacaacaacaagaccgccacgaacccgcugaccaucgaggugccccacaucugcaccaaggaggaggaccagaucaccguguggggcuuucacuccgacaacaagacgcagaugaagaaccuguacggggacagcaacccccagaaguuuaccuccagcgccaacggcgucaccacccacuacgugucccagaucgggggcuuccccgaccagacggaggacggcgggcucccgcagucgggccggaucguggucgauuacauggugcagaagcccgggaagaccggcaccaucguguaccagcgcgggauccugcugccccagaaggucuggugcgccuccggccggagcaaggugaucaagggcagccucccccugaucggggaggcggacugccugcacgagaaguauggcgggcucaacaaguccaagccguacuacaccggcgagcacgccaaggccaucgggaacugccccaucugggugaagacgccccugaagcuggccaacggcaccaaguaucggcccccggccaagcuccugaaggagcgcggcuucuucggggcgaucgccggcuuccuggagggcgggugggaggggaugaucgccggcuggcacggcuacaccucgcacggggcccacggcgucgccguggcggccgaucucaaguccacccaggaggccaucaacaagaucacgaagaaccugaacagccuguccgagcucgaggucaagaaccugcagcgccugagcggggccauggacgagcuccacaaugagauccuggagcuggacgagaagguggacgaccuccgggccgacaccaucuccucgcagaucgagcuggcggugcugcucuccaacgagggcaucaucaacagcgaggaugagcaccuccuggcccuggagcgcaagcugaagaagaugcugggccccuccgccgucgacaucgggaacggcugcuucgagaccaagcacaagugcaaccagaccugucucgaccggaucgccgcggggaccuucaacgccggcgaguucagccugcccacguucgacucccugaacaucaccgccgccagucucaacgacgacgggcuggacaaccacaccauccugcuguacuacuccaccgccgcgaguucccucgccgugacgcugaugaucgccaucuucaucguguacaugaucagccgcgacaacgucuccugcagcaucugccuguga

SEQ ID NO: 14143 - RNA, 1755 nt, Artificial Sequence
  derived and/or modified CDS sequence (AUadapt) from InfluenzaB__ABL76342__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaagucccacuucgccaaccugaaggggacgaagacccggggcaagcucugcccgaccugccugaacuguaccgaccuggacguggcccucgggcgccccaugugcgugggcgucacgcccuccgccaaggccagcauccugcacgaggugcggcccgugaccuccggcugcuuucccaucaugcacgaccgcaccaagauccggcagcugcccaaccuccugcgcggguacgagaagauccggcugagcacccagaacgucaucaacgcggagaaggccccgggcgggcccuaucgccucggcacguccgggucgugccccaacgccaccucccggagcggcuucuucgccaccauggcgugggccgugccccgcgauaacaacaagaccgccacgaacccgcugaccguggaggucccccacaucugcaccaaggaggaggaccagaucaccguguggggcuuccauuccgacaacaagacgcagaugaagaaccuguacggggacagcaacccccagaaguuuaccuccagcgccaacggcgugaccacccacuacgucucccagaucggggacuuccccgaucagacggaggacggcggccucccgcagagcgggcggaucgugguggacuacaugguccagaagcccggcaagaccgggaccaucguguaccagcgcggcauccugcugccccagaagguguggugcgccuccgggcggagcaaggucauccgcggcagucucccccugaucggcgaggcggacugccugcacgagaaguacgggggccucaacaaguccaagccguacuauaccggggagcacgccaaggccaucggcaacugccccaucugggugaagacgccccugaagcuggccaacgggaccaaguaccggcccccggccaagcuccugaaggagcgcggcuucuucggcgcgaucgccggguuucuggagggcgggugggagggcaugaucgccggguggcacggcuacaccagccacggcgcccacggggucgccguggcggccgaccucaaguccacccaggaggccaucaauaagaucacgaagaaccugaacagccuguccgagcucgaggugaagaaccugcagcggcugagcggcgccauggacgagcuccacaaugagauccuggagcuggacgagaaggucgacgaccuccgcgccgacaccaucuccagccagaucgagcuggcggugcugcucuccaacgaggggaucaucaacagugaggacgagcaccuccuggcccuggagcggaagcugaagaagaugcugggccccuccgccguggacaucggcaacgggugcuucgagaccaagcauaagugcaaccagaccugccucgaccgcaucgccgcgggcaccuucaacgccggggacuuuagccugcccacguucgacucccugaacaucaccgccgccagccucaacgaugacggccuggacaaccacaccauccugcuguacuacuccaccgccgcgagcucccucgccgucacgcugaugaucgccaucuuuaucguguacaugaucagccgggacaacguguccugcagcaucugccuguga

SEQ ID NO: 14144 - RNA, 1755 nt, Artificial Sequence
  derived and/or modified CDS sequence (AUadapt) from InfluenzaB__ABL76353__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaagucccacuucgccaaccugaaggggacgaagacccggggcaagcucugcccgaccugccugaauugcaccgaccuggacguggcccucgggcgccccaugugcgugggcgucacgcccuccgccaaggccagcauccugcacgaggugcggcccgugaccuccggcuguuuccccaucaugcacgaccgcaccaagauccggcagcugcccaaccuccugcgcggguacgagaagauccggcugagcacccagaaugucaucaacgcggagaaggccccgggcgggcccuaccgccucggcacguccgggagcugccccaacgccaccucccggagcggcuuuuucgccaccauggcgugggccgugccccgcgacaacaacaagaccgccacgaacccgcugaccguggaggucccccacaucuguaccaaggaggaggaccagaucaccguguggggcuuccacuccgacaacaagacgcagaugaagaaccuguacggggauucgaacccccagaaguucaccuccagcgccaacggcgugaccacccacuaugucucccagaucgggggcuuccccgaccagacggaggacggcgggcucccgcagagcggccggaucgugguggacuacaugguccagaagcccgggaagaccggcaccaucguguaucagcgcgggauccugcugccccagaagguguggugcgccuccggccggagcaaggucauccgcggcagccucccccugaucggggaggcggacugccugcacgagaaguauggcgggcucaacaaguccaagccguacuacaccggcgagcacgccaaggccaucgggaacugccccaucugggugaagacgccccugaagcuggccaauggcaccaaguaccggcccccggccaagcuccugaaggagcgcggcuucuucggggcgaucgccggcuuccuggagggcgggugggaggggaugaucgccggcuggcacggcuacaccagucacggggcccacggcgucgccguggcggccgaccucaaguccacccaggaggccaucaacaagaucacgaagaaccugaacagucuguccgagcucgaggugaagaaccugcagcggcugucgggggccauggacgagcuccacaacgagauccuggagcuggacgagaaggucgacgaucuccgcgccgacaccaucuccagccagaucgagcuggcggugcugcucuccaacgagggcaucaucaacagcgaggacgagcaucuccuggcccuggagcggaagcugaagaagaugcugggccccuccgccguggacaucgggaacggcugcuucgagaccaagcacaagugcaaucagaccugccucgaccgcaucgccgcggggaccuucaacgccggcgacuucagucugcccacguucgacucccugaacaucaccgccgccagccucaacgacgaugggcuggacaaccacaccauccugcuguacuacuccaccgccgcgagcucccucgccgucacgcugaugaucgccaucuuuaucguguacaugaucagccgggacaacguguccugcagcaucugccuguga

SEQ ID NO: 14145 - RNA, 1755 nt, Artificial Sequence
  derived and/or modified CDS sequence (AUadapt) from InfluenzaB__ABL76375__HA
augaaggccaucaucgugcugcucauggucgugaccaguaacgccgaccgcaucugcaccggcaucacguccagcaacucgccccacguggucaagaccgcgacccagggggaggugaacgugaccggcgccaucccgcugacgaccacccccaccaagucccauuucgccaaccugaaggggacgaagacccggggcaagcucugcccgaccugccugaacugcaccgaccuggacgucgcccucgggcgccccaugugugugggcaucacgcccuccgccaaggcgagcauccugcacgaggugcggcccgucaccuccggcugcuuccccaucaugcacgaccgcaccaagauccggcagcugcccaaccuccugcgcggguacgagaagauccggcugucgacccagaaugugaucaacgccgagaaggccccgggcgggcccuaccgccucggcacguccgggagcugccccaacgccaccuccaagagcggcuucuucgcgaccauggccugggccgugccccgggauaacaacaagaccgccacgaacccgcugaccgucgaggugccccacaucugcaccaaggaggaggaccagaucaccguguggggcuuccacuccgacaauaagacgcagaugaagaaccuguacggggacucgaacccccagaaguucaccuccagcgccaacggcaucaccacccauuacgucucccagaucgggggcuuccccgaccagacggaggacggcgggcucccgcagucgggccgcaucgugguggacuacaugguccagaagcccgggaagaccggcaccaucguguaccagcgggggauccugcugccccagaagguguggugcgcguccggccgcaguaaggucaucaagggcagccucccccugaucggggaggccgacugccugcacgagaaguacggcgggcucaacaaguccaagccguacuacaccggcgagcaugccaaggccaucgggaacugccccaucugggugaagacgccccugaagcuggccaacggcaccaaguaccggcccccggcgaagcuccugaaggagcgcggcuucuucggggccaucgccggcuuccuggagggcgggugggaggggaugaucgccggcuggcacggcuacaccagucacggggcccacggcguggcggucgccgccgaccucaaguccacccaggaggccaucaacaagaucacgaagaaccugaacagccuguccgagcucgaggugaagaaccugcagcggcugaguggggccauggacgagcuccacaacgagauccuggagcuggacgagaaggucgacgaccuccgcgcggacaccaucuccagccagaucgagcuggccgugcugcucuccaacgagggcaucaucaauagcgaggacgagcaccuccuggcccuggagcggaagcugaagaagaugcugggccccuccgccguggacaucgggaacggcugcuucgagaccaagcacaaguguaaccagaccugccucgaccgcaucgcggccgggaccuucaacgccggcgaguucucgcugcccacguucgacucccugaauaucaccgccgccagccucaacgacgacgggcuggacaaccacaccauccugcuguacuauuccaccgcggccucgucccucgccgucacgcugaugaucgccaucuucaucguguacaugaucagccgggacaacguguccugcagcaucugccuguga

SEQ ID NO: 14146 - RNA, 1755 nt, Artificial Sequence; identical to SEQ ID NO: 14145
  derived and/or modified CDS sequence (AUadapt) from InfluenzaB__ABL76386__HA

SEQ ID NO: 14147 - RNA, 1755 nt, Artificial Sequence
  derived and/or modified CDS sequence (AUadapt) from InfluenzaB__ABL76408__HA
augaaggccaucaucgugcugcucauggucgugaccaguaacgccgaccgcaucugcaccggcaucacguccagcaacagcccccacguggucaagaccgcgacccagggggaggugaaugugaccggcgccaucccgcugacgaccacccccaccaagucccacuucgccaaccugaaggggacgaagacccggggcaagcucugcccgaccugcuucaacugcaccgaucuggacgucgcccuggggcgccccaugugcgugggcaucacgcccuccgccaaggcgucgauccuccacgaggugcggcccgucaccuccggcugcuuccccaucaugcacgaccgcaccaagauccggcagcugcccaaucugcuccgcggguacgagaagauccggcugagcacccagaacgugaucgacgccgagaaggccccgggcgggcccuaccgccugggcacguccgggagcugccccaacgccaccuccaagaguggcuucuucgcgaccauggccugggccgugccccggggcaacaacaagaccgccacgaacccgcucaccgucgaggugccccacaucugcaccaaggaggaggaccagaucaccguguggggguuucacuccgacaacaagacgcagaugaagaaccuguacggcgacagcaacccccagaaguuuaccuccagcgccaacgggaucaccacccacuacgucucccagaucggcggcuuccccgaccagacggaggacgggggccugccgcagucggggcgcaucgugguggauuacaugguccagaagcccggcaagaccgggaccaucguguaccagcggggcauccuccugccccagaagguguggugcgcguccggccgcagcaaggucaucaaggggagccugccccucaucggcgaggccgacugccugcacgagaaguaugggggccugaacaaguccaagccguacuacaccggggagcacgccaaggccaucggcaacugccccaucugggugaagacgccccucaagcuggccaacggcaccaaguaucggcccccggcgaagcugcucaaggagcgcggguucuucggcgccaucgccggguuccuggagggcgggugggagggcaugaucgccggcuggcacggguacaccucgcacggcgcccacgggguggcggucgccgccgaucugaaguccacccaggaggccaucaacaagaucacgaagaaccucaacagccuguccgagcuggaggugaagaaccuccagcggcugagcggcgccauggacgagcugcacaaugagauccucgagcuggacgagaaggucgacgaccugcgcgcggacaccaucuccucgcagaucgagcucgccgugcugcuguccaacgagggcaucaucaacagcgaggaugagcaccuccuggcccuggagcggaagcucaagaagaugcuggggcccuccgccguggacaucggcaacgggugcuucgagaccaagcacaagugcaaccagaccugucuggaccgcaucgcggccggcaccuucaacgccggggaguucagccuccccacguucgacucccugaacaucaccgccgccagucugaacgacgacggccucgacaaccacaccauccugcuguacuacuccaccgcggccaguucccuggccgucacgcucaugaucgccaucuucaucguguacaugaucagccgggacaacguguccugcagcaucugccuguga

SEQ ID NO: 14148 - RNA, 1755 nt, Artificial Sequence
  derived and/or modified CDS sequence (AUadapt) from InfluenzaB__ABL76419__HA
augaaggccaucaucgugcugcucauggucgugaccaguaacgccgaccgcaucugcaccggcaucacguccagcaacucgccccacguggucaagaccgcgacccagggggaggugaacgugaccggcgccaucccgcugacgaccacccccaccaagucccauuucgccaaccugaaggggacgaagacccggggcaagcucugcccgaccugcuucaacugcaccgaccuggaugucgcccuggggcgccccaugugcgugggcaucacgcccuccgccaaggcgagcauccuccacgagauccggcccgugaccuccggcugcuuccccaucaugcacgaccgcaccaagauccggcagcugcccaaccugcuccgcggguacgagaagauccggcugaguacccagaacgucaucgacgccgagaaggccccgggcgggcccuaccgccugggcacguccgggucgugccccaacgccaccuccaagagcggcuucuuugcgaccauggccugggccgugccccggggcaacaacaagaccgccacgaacccgcucaccguggaggucccccacaucugcaccaaggaggaggaccagaucaccguguggggguuccacuccgacaauaagacgcagaugaagaaccuguacggcgacagcaacccccagaaguucaccuccucggccaacgggaucaccacccauuacgugucccagaucggcggcuuccccgaccagacggaggacgggggccugccgcagagcgggcgcaucgucguggacuacauggugcagaagcccggcaagaccgggaccaucgucuaccagcggggcauccuccugccccagaagguguggugcgcguccggccgcaguaaggugaucaaggggucgcugccccucaucggcgaggccgacugccugcacgagaaguacgggggccugaacaaguccaagccguacuacaccggggagcaugccaaggccaucggcaacugccccaucugggucaagacgccccucaagcuggccaacggcaccaaguaccggcccccggcgaagcugcucaaggagcgcggguucuucggcgccaucgccggguuccuggagggcgggugggagggcaugaucgccggcuggcacggguacaccagucacggcgcccacgggguggcgguggccgccgaccugaaguccacccaggaggccaucaacaagaucacgaagaaccucaacucgcuguccgagcuggaggucaagaaccuccagcggcugaguggcgccauggacgagcugcacaacgagauccucgagcuggacgagaagguggacgaccugcgcgcggacaccaucuccagccagaucgagcucgccguccugcuguccaacgagggcaucaucaauucggaggacgagcaccuccuggcccuggagcggaagcucaagaagaugcuggggcccuccgccguggacaucggcaacgggugcuucgagaccaagcacaaguguaaccagaccugccuggaccgcaucgcggccggcaccuucaacgccggggaguucagccuccccacguucgacucccugaauaucaccgccgccagccugaacgacgacggccucgacaaccacaccauccugcuguacuauuccaccgcggccucgucccuggccgugacgcucaugaucgccaucuucaucgucuacaugaucagccgggacaacguguccugcagcaucugccuguga

SEQ ID NO: 14149 - RNA, 1758 nt, Artificial Sequence
  derived and/or modified CDS sequence (AUadapt) from InfluenzaB__ABL76441__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggauguggcccucgggcgccccaagugcaccggcaacaucccguccgccaaggugucgauccugcacgagguccggcccgugacguccggcugcuuccccaucaugcacgaccgcaccaagauccggcagcugcccaaccuccugcgcggguacgagcacauccggcugucgacccacaacgugaucaacgccgagaaggcgccgggcgggcccuacaagaucggcaccuccgggagcugucccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacucggacaaugagacccagauggccaagcuguacggggacuccaagccccagaaguucacgucguccgccaacggcgugaccacccacuacgugagccagaucggcggguuccccaaccagaccgaggacggcgggcugccccaguccggccgcaucgucguggacuacauggugcagaaguccgggaagccgggcacgaucaccuaccagcggggcauccuccugccccagaaggucuggugcgccuccgggcgcucgaaggugaucaagggcucgcugccccucaucggggaggccgauugccugcacgagaaguacggcgggcugaacaaguccaagcccuacuacaccggcgagcacgcgaaggccaucggcaacugcccgaucugggugaagacgccccucaagcuggccaacgggaccaaguaccggccgcccgccaagcugcucaaggagcgcggcuucuucggggccaucgcgggcuuccuggagggcgggugggagggcaugaucgccggguggcacggcuacaccagccauggggcccacggcgucgccguggccgcggaccugaaguccacccaggaggccaucaacaagaucaccaagaaccucaacucgcuguccgagcuggaggucaagaaccuccagcggcugucgggcgccauggacgagcugcacaacgagauccucgagcuggacgagaagguggacgaccugcgcgccgacacgaucuccagccagaucgagcucgccgugcugcuguccaacgaggggaucaucaauucggaggacgagcaccuccuggcgcuggagcggaagcucaagaagaugcugggccccuccgccgucgagaucgggaacggcugcuucgagaccaagcacaagugcaaccagaccugccuggaccgcaucgccgccgggaccuucgacgcgggcgaguucucgcuccccaccuucgacucccugaauaucacggccgccagccugaacgacgacgagcucgacaaccacaccauccugcuguacuacuccaccgccgccucgucccuggcggugacccucaugaucgccaucuucguggucuacauggugucgcgggacaacguguccugcagcaucugccuguga

SEQ ID NO: 14150 - RNA, 1758 nt, Artificial Sequence
  derived and/or modified CDS sequence (AUadapt) from InfluenzaB__ABL76463__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaauaucccguccgccaaggugucgauccugcacgagguccggcccgugacguccggcugcuuccccaucaugcacgaccgcaccaagauccggcagcugcccaaccuccugcgcggguacgagcacauccggcugucgacccacaacgugaucaacgccgagaaggcgccgggcgggcccuacaagaucggcaccuccgggucgugccccaacgucacgaacggcaacggcuucuuugccaccauggccugggccgugcccaagaacgacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgucguccgccaacggcgugaccacccacuacgugagucagaucggcggguuccccaaccagaccgaggacggcgggcugccccaguccggccgcaucgucguggacuacauggugcagaaguccgggaagacgggcaccaucaccuaccagcggggcauccuccugccgcagaaggucuggugcgccuccgggcgcagcaaggugaucaagggcucgcugccccucaucggggaggccgacugccugcacgagaaguacggcgggcugaacaaguccaagcccuacuacaccggcgagcacgcgaaggccaucggcaacugccccaucugggugaagacgccgcucaagcuggccaaugggaccaaguaccggccgcccgccaagcugcucaaggagcgcggcuucuucggggccaucgcgggcuuccuggagggcgggugggagggcaugaucgccggguggcacggcuacaccucgcacggggcccacggcgucgccguggccgcggaccugaaguccacccaggaggccaucaacaagaucacgaagaaccucaacucgcuguccgagcuggaggucaagaaccuccagcggcugagcggcgccauggacgagcugcacaacgagauccucgagcuggacgagaaggugaaugaccugcgcgccgacaccaucuccucgcagaucgagcucgccgugcugcuguccaacgaggggaucaucaacucggaggacgagcaccuccuggcgcuggagcggaagcucaagaagaugcugggccccuccgccgucgagaucgggaacggcugcuucgagaccaagcacaagugcaaccagaccugccuggaccgcaucgccgccgggaccuucgacgcgggcgaguucucgcuccccacguuugacucccugaacaucaccgccgccagccugaacgacgacggccucgacaaccacaccauccugcuguacuacuccaccgccgccucgucccuggcggugacgcucaugaucgccaucuucguggucuacauggugucgcgggacaacguguccugcagcaucugccuguga

SEQ ID NO: 14151 - RNA, 1758 nt, Artificial Sequence
  derived and/or modified CDS sequence (AUadapt) from InfluenzaB__ABL76474__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaauaucccguccgccaaggugucgauccugcacgagguccggcccgugacguccggcugcuuccccaucaugcacgaccgcaccaagauccggcagcugcccaaccuccugcgcggguacgagcacauccggcugucgacccacaacgugaucaacgccgagaaggcgccgggcgggcccuacaagaucggcaccuccgggucgugccccaacgucacgaacggcaacggcuucuuugccaccauggccugggccgugcccaagaacgacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgucguccgccaacggcgugaccacccacuacgugagucagaucggcggguuccccaaccagaccgaggacggcgggcugccccaguccggccgcaucgucguggacuacauggugcagaaguccgggaagacgggcaccaucaccuaccagcggggcauccuccugccgcagaaggucuggugcgccuccgggcgcagcaaggugaucaagggcucgcugccccucaucggggaggccgacugccugcacgagaaguacggcgggcugaacaaguccaagcccuacuacaccggcgagcacgcgaaggccaucggcaacugccccaucugggugaagacgccgcucaagcuggccaaugggaccaaguaccggccgcccgccaagcugcucaaggagcgcggcuucuucggggccaucgcgggcuuccuggagggcgggugggagggcaugaucgccggguggcacggcuacaccucgcacggggcccacggcgucgccguggccgcggaccugaaguccacccaggaggccaucaacaagaucacgaagaaccucaacucgcuguccgagcuggaggucaagaaccuccagcggcugagcggcgccauggacgagcugcacaacgagauccucgagcuggacgagaagguggaugaccugcgcgccgacaccaucuccucgcagaucgagcucgccgugcugcuguccaacgaggggaucaucaacucggaggacgagcaccuccuggcgcuggagcggaagcucaagaagaugcugggccccuccgccgucgagaucgggaacggcugcuucgagaccaagcacaagugcaaccagaccugccuggaccgcaucgccgccgggaccuucgacgcgggcgaguucucgcuccccacguuugacucccugaacaucaccgccgccagccugaacgacgacgagcucgacaaccacaccauccugcuguacuacuccaccgccgccucgucccuggcggugacgcucaugaucgccaucuucguggucuacauggugucgcgggacaacguguccugcagcaucugccuguga

SEQ ID NO: 14152 - RNA, 1758 nt, Artificial Sequence
  derived and/or modified CDS sequence (AUadapt) from InfluenzaB__ABL76485__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaauaucccguccgccgaggugucgauccugcacgagguccggcccgugacguccggcugcuuccccaucaugcacgaccgcaccaagauccggcagcugcccaaccuccugcgcggguacgagcacauccggcugucgacccacaacgugaucaacgccgagaaggcgccgggcgggcccuacaagaucggcaccuccgggagcugccccaacgucacgaacggcaacggcuucuuugugaccauggccugggccgugcccaagaacgacaacaacaagaccgccaccaacucccucacgaucgaggucccguacaucugcaccgagggggaggaccagaucaccguguggggcuuccacucggacaacgagacccagauggcgaagcuguacggggacuccaagccccagaaguucacgucguccgccaacggcgugaccacccacuacgucagucagaucggcggguuccccaaccagaccgaggacggcgggcugccccaguccggccgcaucgugguggacuacaugguccagaaguccgggaagacgggcaccaucaccuaccagcggggcauccuccugccgcagaagguguggugcgccuccgggcgcucgaaggugaucaagggcucgcugccccucaucggggaggccgacugccugcacgagaaguacggcgggcugaacaaguccaagcccuacuacaccggcgagcacgccaaggcgaucggcaacugccccaucugggucaagacgccgcucaagcuggccaaugggaccaaguaccggccgcccgccaagcugcucaaggagcgcggcuucuucggggccaucgccggcuuccuggagggcgggugggagggcaugaucgcgggguggcacggcuacaccagccacggggcccacggcguggccgucgccgccgaccugaaguccacccaggaggcgaucaacaagaucacgaagaaccucaacucgcuguccgagcuggaggugaagaaccuccagcggcugucgggcgccauggacgagcugcacaacgagauccucgagcuggacgagaagguggaugaccugcgcgccgacaccaucuccagccagaucgagcucgccguccugcuguccaacgaggggaucaucaacucggagaacgagcaccuccuggcccuggagcggaagcucaagaagaugcugggccccuccgcgguggagaucgggaacggcugcuucgagaccaagcacaagugcaaccagaccugccuggaccgcaucgccgccgggaccuucgacgccggcgaguucucgcuccccacguuugacucccugaacaucaccgcggccagccugaacgacgacggccucgacaaccacaccauccugcuguacuacuccaccgccgccucgucccuggccgugacgcucaugaucgcgaucuucgucguguacauggugucgcgggacaacgucuccugcagcaucugccuguga

SEQ ID NO: 14153 - RNA, 1758 nt, Artificial Sequence
  derived and/or modified CDS sequence (AUadapt) from InfluenzaB__ABL76507__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacgaagacccggggcaagcucugccccaagugccugaacugcaccgaccuggauguggcccucgggcgccccaagugcaccggcaacaucccguccgccgaggugucgauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggucgugucccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacucggacaaugagauccagauggccaagcuguacggggacuccaagccccagaaguucaccagcuccgccaacggcgugacgacccacuacgugucgcagaucggcggguuccccaaccagaccgaggacggcgggcugccccaguccggccgcaucgucguggacuacauggugcagaaguccgggaagaccggcacgaucaccuaccagcggggcauccuccugccgcagaaggucuggugcgccuccgggcgcagcaaggugaucaagggcucgcugccccucaucggggaggccgauugccugcacgagaaguacggcgggcugaacaaguccaagcccuacuacaccggcgagcacgcgaaggccaucggcaacugccccaucugggugaagaccccgcucaagcuggccaacgggacgaaguaccggccgcccgccaagcugcucaaggagcgcggcuucuucggggccaucgcgggcuuccuggagggcgggugggagggcaugaucgccggguggcacggcuacaccucgcauggggcccacggcgucgccguggccgcggaccugaaguccacccaggaggccaucaacaagaucaccaagaaccucaacagccuguccgagcuggaggucaagaaccuccagcggcugucgggcgccauggacgagcugcacaacgagauccucgagcuggacgagaagguggacgaccugcgcgccgacacgaucuccucgcagaucgagcucgccgugcugcuguccaacgaggggaucaucaauagcgaggacgagcaccuccuggcgcuggagcggaagcucaagaagaugcugggccccuccgccgucgagaucgggaacggcugcuucgagaccaagcacaagugcaaccagaccugccuggaccgcaucgccgccgggaccuucgacgcgggcgaguucucgcuccccaccuucgacucccugaauaucacggccgccucgcugaacgacgacggccucgacaaccacaccauccugcuguacuacuccaccgccgccagcucccuggcggugacccucaugaucgccaucuucguggucuacauggugucgcgggacaacguguccugcagcaucugccuguga

SEQ ID NO: 14154 - RNA, 1758 nt, Artificial Sequence
  derived and/or modified CDS sequence (AUadapt) from InfluenzaB__ABL76518__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggauguggcccucgggcgccccaagugcaccggcaacaucccguccgccgaggugucgauccugcacgagguccggcccgugacguccggcugcuuccccaucaugcacgaccgcaccaagauccggcagcugcccaaccuccugcgcggguacgagcacauccggcugucgacccacaacgugaucaacgccgagaaggcgccgggcgggcccuacaagaucggcaccuccgggagcugucccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacucggacaaugagaaccagauggccaagcuguacggggacuccaagccccagaaguucaccucguccgccaacggcgugacgacccacuacgugagccagaucggcggguuccccaaccagaccgaggacggcgggcugccccaguccggccgcaucgucguggacuacauggugcagaaguccgggaagaccggcacgaucaccuaccagcggggcauccuccugccgcagaaggucuggugcgccuccgggcgcucgaaggugaucaagggcucgcugccccucaucggggaggccgauugccugcacgagaaguacggcgggcugaacaaguccaagcccuacuacaccggcgagcacgcgaaggccaucggcaacugccccaucugggugaagaccccgcucaagcuggccaacgggacgaaguaccggccgcccgccaagcugcucaaggagcgcggcuucuucggggccaucgcgggcuuccuggagggcgggugggagggcaugaucgccggguggcacggcuacaccagccauggggcccacggcgucgccguggccgcggaccugaaguccacccaggaggccaucaacaagaucaccaagaaccucaacucgcuguccgagcuggaggucaagaaccuccagcggcugucgggcgccauggacgagcugcacaacgagauccucgagcuggacgagaagguggacgaccugcgcgccgacacgaucuccagccagaucgagcucgccgugcugcuguccaacgaggggaucaucaauucggaggacgagcaccuccuggcgcuggagcggaagcucaagaagaugcugggccccuccgccgucgagaucgggaacggcugcuucgagaccaagcacaagugcaaccagaccugccuggaccgcaucgccgccgggaccuucgacgcgggcgaguucucgcuccccaccuucgacucccugaauaucacggccgccagccugaacgacgacggccucgacaaccacaccauccugcuguacuacuccaccgccgccucgucccuggcggugacccucaugaucgccaucuucguggucuacauggugucgcgggacaacguguccugcagcaucugccuguga

SEQ ID NO: 14155 - RNA, 1758 nt, Artificial Sequence
  derived and/or modified CDS sequence (AUadapt) from InfluenzaB__ABL76529__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacgaagacccggggcaagcucugccccaagugccugaacugcaccgaccuggauguggcccucgggcgccccaagugcaccggcaacaucccguccgccgaggugucgauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggucgugucccaacgucacgaacggcaacggcuucuucgugaccauggccugggccgugcccaagaacgacaacaacaagaccgccaccaacucccucacgaucgaggucccguacaucugcaccgagggggaggaccagaucaccguguggggcuuccacucggacaaugagacccagauggcgaagcuguacggggacuccaagccccagaaguucacgagcuccgccaacggcgugaccacccacuacgucucgcagaucggcggguuccccaaccagaccgaggacggcgggcugccccaguccggccgcaucgugguggacuacaugguccagaaguccgggaagacgggcaccaucaccuaccagcggggcauccuccugccgcagaagguguggugcgccuccgggcgcagcaaggugaucaagggcucgcugccccucaucggggaggccgauugccugcacgagaaguacggcgggcugaacaaguccaagcccuacuacaccggcgagcacgccaaggcgaucggcaacugccccaucugggucaagacgccgcucaagcuggccaacgggaccaaguaccggccgcccgccaagcugcucaaggagcgcggcuucuucggggccaucgccggcuuccuggagggcgggugggagggcaugaucgcgggguggcacggcuacaccucgcauggggcccacggcguggccgucgccgccgaccugaaguccacccaggaggcgaucaacaagaucacgaagaaccucaacagccuguccgagcuggaggugaagaaccuccagcggcugucgggcgccauggacgagcugcacaacgagauccucgagcuggacgagaagguggacgaccugcgcgccgacaccaucuccucgcagaucgagcucgccguccugcuguccaacgaggggaucaucaauagcgaggacgagcaccuccuggcccuggagcggaagcucaagaagaugcugggccccuccgcgguggagaucgggaacggcugcuucgagaccaagcacaagugcaaccagaccugccuggaccgcaucgccgccgggaccuucgacgccggcgaguucucgcuccccacguucgacucccugaauaucaccgcggccucgcugaacgacgacggccucgacaaccacaccauccugcuguacuacuccaccgccgccagcucccuggccgugacgcucaugaucgcgaucuucgucguguacauggugucgcgggacaacgucuccugcagcaucugccuguga

SEQ ID NO: 14156 - RNA, 1758 nt, Artificial Sequence
  derived and/or modified CDS sequence (AUadapt) from InfluenzaB__ABL76540__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaauaucccguccgccgaggugucgauccugcacgaggucaagcccgugacguccggcugcuuccccaucaugcacgaccggaccaagauccgccagcugcccaaccuccugcggggguacgagcacauccgccugucgacccacaacgugaucaacgccgagaaggcgccgggcgggcccuacaagaucggcaccuccgggucgugccccaacgucacgaacggcaacggcuucuuugccaccauggccugggccgugcccaagaacgacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgucguccgccaacggcgugaccacccacuacgugagucagaucggcggguuccccaaccagaccgaggacggcgggcugccccaguccggccggaucgucguggacuacauggugcagaaguccgggaagacgggcaccaucaccuaccagcgcggcauccuccugccgcagaaggucuggugcgccuccgggcggagcaaggugaucaagggcucgcugccccucaucggggaggccgacugccugcacgagaaguacggcgggcugaacaaguccaagcccuacuacaccggcgagcacgcgaaggccaucggcaacugccccaucugggugaagacgccgcucaagcuggccaaugggaccaaguaccgcccgcccgccaagcugcucaaggagcggggcuucuucggggccaucgcgggcuuccuggagggcgggugggagggcaugaucgccggguggcacggcuacaccucgcacggggcccacggcgucgccguggccgcggaccugaaguccacccaggaggccaucaacaagaucacgaagaaccucaacucgcuguccgagcuggaggucaagaaccuccagcgccugagcggcgccauggacgagcugcacaacgagauccucgagcuggacgagaagguggaugaccugcgggccgacaccaucuccucgcagaucgagcucgccgugcugcuguccaacgaggggaucaucaacucggaggacgagcaccuccuggcgcuggagcgcaagcucaagaagaugcugggccccuccgccgucgagaucgggaacggcugcuucgagaccaagcacaagugcaaccagaccugccuggaccggaucgccgccgggaccuucgacgcgggcgaguucucgcuccccacguuugacucccugaacaucaccgccgccagccugaacgacgacggccucgacaaccacaccauccugcuguacuacuccaccgccgccucgucccuggcggugacgcucaugaucgccaucuucguggucuacauggugucgcgcgacaacguguccugcagcaucugccuguga

SEQ ID NO: 14157 - RNA, 1758 nt, Artificial Sequence
  derived and/or modified CDS sequence (AUadapt) from InfluenzaB__ABL76551__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacgaagacccggggcaagcucugccccaagugccugaacuguaccgaccuggacguggcccucgggcgccccaagugcaccggcaacaucccguccgccgaggugucgauccugcacgagguccggcccgugacguccggcugcuuccccaucaugcacgaccgcaccaagauccggcagcugcccaaccuccugcgcggguacgagcacauccggcugagcacccacaaugugaucaacgccgagaaggcgccgggcgggcccuacaagaucggcaccuccgggucgugccccaacgucacgaacggcaacggcuucuucgccaccauggccugggccgugcccaagaacgacaacaacaagaccgcgaccaacucccucacgaucgaggugccguacaucuguaccgagggggaggaccagaucaccgucuggggcuuccacucggacaacgagacccagauggccaagcuguacggggacuccaagccccagaaguucacgagcuccgccaacggcgugaccacccacuacgugucgcagaucggcggguuccccaaucagaccgaggacggcgggcugccccaguccggccgcaucgucguggacuacauggugcagaaguccgggaagacgggcaccaucaccuaccagcggggcauccuccugccgcagaaggucuggugcgccuccgggcgcagcaaggugaucaagggcucgcugccccucaucggggaggccgacugccugcacgagaaguacggcgggcugaacaaguccaagcccuacuacaccggcgagcacgcgaaggccaucggcaauugccccaucugggugaagacgccgcucaagcuggccaacgggaccaaguaccggccgcccgccaagcugcucaaggagcgcggcuucuucggggccaucgcgggcuuccuggagggcgggugggagggcaugaucgccggguggcacggcuacaccucgcacggggcccacggcgucgccguggccgcggaccugaaguccacccaggaggccaucaacaagaucacgaagaaccucaacagucuguccgagcuggaggucaagaaccuccagcggcugucgggcgccauggacgagcugcacaacgagauccucgagcuggacgagaagguggacgaccugcgcgccgacaccaucuccucgcagaucgagcucgccgugcugcuguccaacgaggggaucaucaacagcgaggacgagcaccuccuggcgcuggagcggaagcucaagaagaugcugggccccuccgccgucgagaucgggaauggcugcuucgagaccaagcacaagugcaaccagaccugccuggaccgcaucgccgccgggaccuucgacgcgggcgaguucucgcuccccacguucgacucccugaacaucaccgccgccucgcugaaugacgacggccucgacaaccacaccauccugcuguacuacuccaccgccgccagcucccuggcggugacgcucaugauggccaucuucguggucuacauggugucgcgggacaacguguccugcagcaucugccuguga

SEQ ID NO: 14158 - RNA, 1758 nt, Artificial Sequence
  derived and/or modified CDS sequence (AUadapt) from InfluenzaB__ABL76562__HA
augaaggccaucaucgugcugcucauggucgugaccaguaacgccgaccgcaucugcacccggaucacguccucgaacagcccccacguggucaagaccgcgacccagggcgaggugaacgugaccggggucaucccgcugacgaccacccccaccaagucgcacuucgccaaccugaagggcacgaagacccgcgggaagcucugccccaagugccugaacugcaccgaccuggauguggcccucggccggcccaagugcaccgggaacaucccguccgccgaggugucgauccugcacgagguccgccccgugacguccggcugcuuccccaucaugcacgaccggaccaagauccgccagcugcccaaccuccugcggggcuacgagcacauccgccugagcacccacaacgugaucaacgccgagaaggcgcccgggggccccuacaagaucgggaccuccggcucgugucccaacgucacgaacgggaacggcuucuucgccaccauggccugggccgugcccaagaacgacaacaacaagaccgcgaccaacucccucacgaucgaggugccguacaucugcaccgagggcgaggaccagaucaccgucuggggguuccacucggacaaugagacccagauggccaagcuguacggcgacuccaagccccagaaguucacgagcuccgccaacggggugaccacccacuacgugucgcagaucggcggcuuccccaaccagaccgaggacgggggccugccccaguccgggcggaucgucguggacuacauggugcagaaguccggcaagacggggaccaucaccuaccagcgcggcauccuccugccgcagaaggucuggugcgccuccggccggagcaaggugaucaaggggucgcugccccucaucggcgaggccgauugccugcacgagaaguacgggggccugaacaaguccaagcccuacuacaccggggagcacgcgaaggccaucggcaacugccccaucugggugaagacgccgcucaagcuggccaacggcaccaaguaccgcccgcccgccaagcugcucaaggagcggggguucuucggcgccaucgcgggguuccuggagggcgggugggagggcaugaucgccggcuggcacggguacaccucgcauggcgcccacggggucgccguggccgcggaccugaaguccacccaggaggccaucaacaagaucacgaagaaccucaacagccuguccgagcuggaggucaagaaccuccagcgccugucgggcgccauggacgagcugcacaacgagauccucgagcuggacgagaagguggacgaccugcgggccgacaccaucuccucgcagaucgagcucgccgugcugcuguccaacgagggcaucaucaauagcgaggacgagcaccuccuggcgcuggagcgcaagcucaagaagaugcuggggcccuccgccgucgagaucggcaacgggugcuucgagaccaagcacaagugcaaccagaccugccuggaccggaucgccgccggcaccuucgacgugggggaguucucgcucccgacguucgacucccugaauaucaccgcggccucgcugaacgacgacggccucgacaaccacaccauccugcuguacuacuccaccgccgccagcucccuggccgugacgcucaugaucgcgaucuucgucguguacauggugucgcgcgacaacgucuccugcagcaucugccuguga

SEQ ID NO: 14159 - RNA, 1758 nt, Artificial Sequence
  derived and/or modified CDS sequence (AUadapt) from InfluenzaB__ABL76573__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacgaagacccggggcaagcucugccccaagugccugaacuguaccgaccuggacguggcccucgggcgccccaagugcaccggcaacaucccguccgccgaggugucgauccugcacgagguccggcccgugacguccggcugcuuccccaucaugcacgaccgcaccaagauccggcagcugcccaaccuccugcgcggguacgagcacauccggcugagcacccacaaugugaucaacgccgagaaggcgccgggcgggcccuacaagaucggcaccuccgggucgugccccaacgucacgaacggcaacggcuucuucgccaccauggccugggccgugcccaagaacgacaacaacaagaccgcgaccaacucccucacgaucgaggugccguacaucuguaccgagggggaggaccagaucaccgucuggggcuuccacucggacaacgagacccagauggccaagcuguacggggacuccaagccccagaaguucacgagcuccgccaacggcgugaccacccacuacgugucgcagaucggcggguuccccaaucagaccgaggacggcgggcugccccaguccggccgcaucgucguggacuacauggugcagaaguccgggaagacgggcaccaucaccuaccagcggggcauccuccugccgcagaaggucuggugcgccuccgggcgcagcaaggugaucaagggcucgcugccccucaucggggaggccgacugccugcacgagaaguacggcgggcugaacaaguccaagcccuacuacaccggcgagcacgcgaaggccaucggcaauugccccaucugggugaagacgccgcucaagcuggccaacgggaccaaguaccggccgcccgccaagcugcucaaggagcgcggcuucuucggggccaucgcgggcuuccuggagggcgggugggagggcaugaucgccggguggcacggcuacaccucgcacggggcccacggcgucgccguggccgcggaccugaaguccacccaggaggccaucaacaagaucacgaagaaccucaacagucuguccgagcuggaggucaagaaccuccagcggcugucgggcgccauggacgagcugcacaacgagauccucgagcuggacgagaagguggacgaccugcgcgccgacaccaucuccucgcagaucgagcucgccgugcugcuguccaacgaggggaucaucaacagcgaggacgagcaccuccuggcgcuggagcggaagcucaagaagaugcugggccccuccgccgucgagaucgggaauggcugcuucgagaccaagcacaagugcaaccagaccugccuggaccgcaucgccgccgggaccuucgacgcgggcgaguucucgcuccccacguucgacucccugaacaucaccgccgccucgcugaaugacgacggccucgacaaccacaccauccugcuguacuacuccaccgccgccagcucccuggcggugacgcucaugaucgccaucuucguggucuacauggugucgcgggacaacguguccugcagcaucugccuguga

SEQ ID NO: 14160 - RNA, 1758 nt, Artificial Sequence; identical to SEQ ID NO: 14159
  derived and/or modified CDS sequence (AUadapt) from InfluenzaB__ABL76584__HA

SEQ ID NO: 14161 - RNA, 1758 nt, Artificial Sequence; identical to SEQ ID NO: 14159
  derived and/or modified CDS sequence (AUadapt) from InfluenzaB__ABL76595__HA

SEQ ID NO: 14162 - RNA, 1758 nt, Artificial Sequence; identical to SEQ ID NO: 14159
  derived and/or modified CDS sequence (AUadapt) from InfluenzaB__ABL76606__HA

SEQ ID NO: 14163 - RNA, 1758 nt, Artificial Sequence
  derived and/or modified CDS sequence (AUadapt) from InfluenzaB__ABL76617__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugccccaagugccugaacuguaccgaccuggacguggcccucgggcgccccaagugcaccggcaacaucccguccgccaaggugucgauccugcacgagguccggcccgugacguccggcugcuuccccaucaugcacgaccgcaccaagauccggcagcugcccaaccuccugcgcggguacgagcacauccggcugagcacccacaaugugaucaacgccgagaaggcgccgggcgggcccuacaagaucggcaccuccgggucgugccccaacgucacgaacggcaacggcuucuucgccaccauggccugggccgugcccaagaacgacaacaacaagaccgcgaccaacucccucacgaucgaggugccguacaucuguaccgagggggaggaccagaucaccgucuggggcuuccacucggacaacgagacccagauggccaagcuguacggggacuccaagccccagaaguucacgagcuccgccaacggcgugaccacccacuacgugucgcagaucggcggguuccccaaucagaccgaggacggcgggcugccccaguccggccgcaucgucguggacuacauggugcagaaguccgggaagacgggcaccaucaccuaccagcggggcauccuccugccgcagaaggucuggugcgccuccgggcgcagcaaggugaucaagggcucgcugccccucaucggggaggccgacugccugcacgagaaguacggcgggcugaacaaguccaagcccuacuacaccggcgagcacgcgaaggccaucggcaauugccccaucugggugaagacgccgcucaagcuggccaacgggaccaaguaccggccgcccgccaagcugcucaaggagcgcggcuucuucggggccaucgcgggcuuccuggagggcgggugggagggcaugaucgccggguggcacggcuacaccucgcacggggcccacggcgucgccguggccgcggaccugaaguccacccaggaggccaucaacaagaucacgaagaaccucaacagucuguccgagcuggaggucaagaaccuccagcggcugucgggcgccauggacgagcugcacaacgagauccucgagcuggacgagaagguggacgaccugcgcgccgacaccaucuccucgcagaucgagcucgccgugcugcuguccaacgaggggaucaucaacagcgaggacgagcaccuccuggcgcuggagcggaagcucaagaagaugcugggccccuccgccgucgagaucgggaauggcugcuucgagaccaagcacaagugcaaccagaccugccuggaccgcaucgccgccgggaccuucgacgcgggcgaguucucgcuccccacguucgacucccugaacaucaccgccgccucgcugaaugacgacggccucgacaaccacaccauccugcuguacuacuccaccgccgccagcucccuggcggugacgcucaugaucgccaucuucguggucuacauggugucgcgggacaacguguccugcagcaucugccuguga

SEQ ID NO: 14164 - RNA, 1755 nt, Artificial Sequence
  derived and/or modified CDS sequence (AUadapt) from InfluenzaB__ABL76628__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaaguccuacuucgccaaccugaaggggacgcggacccgcggcaagcucugccccgacugccugaauugcaccgaccuggacguggcccucgggcggcccaugugcgugggcaccacgccguccgccaaggccagcauccugcacgagguccgccccgugaccuccggcuguuuccccaucaugcacgaccggaccaagauccgccagcuggcgaaccuccugcggggguacgagaacauccgccugagcacccagaaugugaucgacgccgagaaggcccccggcgggccguaccggcucggcacguccgggucgugccccaacgccaccuccaagagcggcuucuuugcgaccauggccugggccguccccaaggacaacaacaagaacgccaccaacccccugacgguggaggugccgcacaucuguaccgagggcgaggaccagaucaccgucuggggguuccacuccgacaacaagacccagaugaagaaccuguacggcgauagcaacccccagaaguucacguccagcgccaacggggugaccacccacuacgugucccagaucggcggcuuucccgaccagaccgaggacgggggccucccccagagcgggcgcaucgucguggacuacaugaugcagaagccgggcaagacggggaccaucguguaccagcggggcguccugcugccccagaagguguggugugcguccggccgcagcaaggugaucaaggggucgcucccccugaucggcgaggccgacugccugcacgagaaguacgggggccucaacaaguccaagcccuauuacaccggggagcacgccaaggccaucggcaacugcccgaucugggucaagacgccccugaagcuggccaacggcaccaaguaccggccgcccgcgaagcuccugaaggagcgcggguuuuucggcgccaucgccggguuccuggagggcgggugggagggcaugaucgccggcuggcacggguacaccagccacggcgcccacgggguggcggucgccgccgaucucaaguccacccaggaggccaucaacaagaucaccaagaaccugaacagccuguccgagcucgaggugaagaaccugcagcggcugagcggcgccauggacgagcuccauaacgagauccuggagcuggacgagaagguggacgaccuccgcgcggacacgaucuccagccagaucgagcuggccguccugcucuccaaugagggcaucaucaacucggaggacgagcaccuccuggcccuggagcggaagcugaagaagaugcuggggcccuccgccguggacaucggcaacgggugcuuugagaccaagcacaagugcaaccagaccugccucgaccgcaucgcggccggcaccuucaacgccggggaguuuagccugcccaccuucgacucccugaacaucacggccgccagccucaacgaugacggccuggacaaccacaccauccugcuguacuacuccaccgcggccagcucccucgccgugacccugaugcuggccaucuuuaucgucuacauggugagccgggacaacguguccugcagcaucugccucuga

SEQ ID NO: 14165 - RNA, 1755 nt, Artificial Sequence
  derived and/or modified CDS sequence (AUadapt) from InfluenzaB__ABL76639__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaaguccuacuucgccaaccugaaggggacgcggacccgcggcaagcucugccccgacugccugaauugcaccgaccuggacguggcccucgggcggcccaugugcgugggcaccacgccguccgccaaggccagcauccugcacgagguccgccccgugaccuccggcuguuuccccaucaugcacgaccggaccaagauccgccagcuggcgaaccuccugcggggguacgagaacauccgccugagcacccagaaugugaucgacgccgagaaggcccccggcgggccguaccggcucggcacguccgggagcugccccaacgccaccuccaagagcggcuucuuugcgaccauggccugggccguccccaaggacaacaacaagaacgccaccaacccccugacgguggaggugccguacaucuguaccgagggcgaggaccagaucaccgucuggggguuccacuccgacaacaagacccagaugaagaaccuguacggcgauucgaacccccagaaguucacguccagcgccaacggggugaccacccacuacgugucccagaucggcggcuuucccgaccagaccgaggacgggggccucccccagagcgggcgcaucgucguggacuacaugaugcagaagccgggcaaggcggggacgaucguguaccagcggggcguccugcugccccagaagguguggugugccuccggccgcagcaaggugaucaaggggagccucccccugaucggcgaggccgacugccugcacgagaaguacgggggccucaacaaguccaagcccuauuacaccggggagcacgccaaggccaucggcaacugcccgaucugggucaagacgccccugaagcuggcgaacggcaccaaguaccggccgcccgccaagcuccugaaggagcgcggguuuuucggcgccaucgccggguuccuggagggcgggugggagggcaugaucgccggcuggcacggguacaccagccacggcgcgcacgggguggccgucgccgccgaucucaaguccacccaggaggccaucaacaagaucaccaagaaccugaacagccuguccgagcucgaggugaagaaccugcagcggcugucgggcgcgauggacgagcuccauaacgagauccuggagcuggacgagaagguggacgaccuccgcgccgacaccaucuccagccagaucgagcuggccguccugcucuccaaugagggcaucaucaacagcgaggacgagcaccuccuggcccuggagcggaagcugaagaagaugcuggggcccuccgcgguggacaucggcaacgggugcuuugagacgaagcacaagugcaaccagaccugccucgaccgcaucgccgccggcaccuucaacgccggggaguuuagccugcccaccuucgacucccugaacaucaccgccgcgagccucaacgaugacggccuggacaaccacacgauccugcuguacuacuccaccgccgccagcucccucgccgugacccugaugcuggccaucuuuaucgucuacauggugagccgggacaacguguccugcagcaucugccucuga

SEQ ID NO: 14166 - RNA, 1755 nt, Artificial Sequence
  derived and/or modified CDS sequence (AUadapt) from InfluenzaB__ABL76683__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacuguaccgaccuggacguggcccucgggcggcccaugugcgugggcaccacgccguccgccaaggccagcauccugcacgagguccgccccgugaccuccggcugcuuccccaucaugcaugaccggaccaagauccgccagcuggcgaaccuccugcggggguacgagaacauccgccugagcacccagaacgugaucgacgccgagaaggcccccggcgggccguaucggcucggcacguccgggucgugccccaacgccaccuccaagagcggcuucuucgcgaccauggccugggccguccccaaggacaauaacaagaacgccaccaacccccugacgguggaggugccguacaucugcaccgagggcgaggaccagaucaccgucuggggguuccauuccgacaacaagacccagaugaagaaccuguacggcgacagcaacccccagaaguuuacguccagcgccaacggggugaccacccacuacgugucccagaucggcggcuuccccgaccagaccgaggacgggggccucccccagagugggcgcaucgucguggacuacaugaugcagaagccgggcaagacggggaccaucguguaccagcggggcguccugcugccccagaagguguggugcgcguccggccgcagcaaggugaucaaggggucgcucccccugaucggcgaggccgacugucugcacgagaaguacgggggccucaacaaguccaagcccuacuacaccggggagcacgccaaggccaucggcaacuguccgaucugggucaagacgccccugaagcuggccaacggcaccaaguaccggccgcccgcgaagcuccugaaggagcgcggguucuucggcgccaucgccggguuccuggagggcgggugggagggcaugaucgccggcuggcacggguacaccagucacggcgcccacgggguggcggucgccgccgaccucaaguccacccaggaggccaucaacaagaucaccaagaaccugaacagccuguccgagcucgaggugaagaaucugcagcggcugagcggcgccauggacgagcuccacaacgagauccuggagcuggacgagaagguggacgaccuccgcgcggauacgaucuccagccagaucgagcuggccguccugcucuccaacgagggcaucaucaacucggaggacgagcaccuccuggcccuggagcggaagcugaagaagaugcuggggcccuccgccguggacaucggcaaugggugcuucgagaccaagcacaagugcaaccagaccugccucgaccgcaucgcggccggcaccuuuaacgccggggaguucagccugcccaccuucgacucccugaacaucacggccgccagccucaaugacgacggccuggacaaccacaccauccugcuguacuacuccaccgcggccaguucccucgccgugacccugaugcuggccaucuucaucgucuacauggugagccgggacaacguguccugcagcaucugccucuga

SEQ ID NO: 14167 - RNA, 1752 nt, Artificial Sequence; identical to SEQ ID NO: 14120
  derived and/or modified CDS sequence (AUadapt) from InfluenzaB__ABL76694__HA

SEQ ID NO: 14168 - RNA, 1758 nt, Artificial Sequence
  derived and/or modified CDS sequence (AUadapt) from InfluenzaB__ABL76716__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugccccaagugucugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcauauccgccugucgacccacaacgugaucaacgccgagaacgcgccgggcgggcccuacaagaucggcaccuccgggagcugccccaacgucacgaacggcaacggcuucuucgccaccauggccugggccgugcccaagaaugacaacaacaagaccgcgaccaacucccucacgaucgaggugccguacaucugcaccgagggggaggaccagaucaccgucuggggcuuccacucggacaacgagacccagauggccaagcuguacggggacuccaagccccagaaguuuacgagcuccgccaacggcgugaccacccacuacgugucgcagaucggcggguuccccaaccagaccgaggacggcgggcugccccaguccggccggaucgucguggacuacauggugcagaaguccgggaagacgggcaccaucaccuaccagcgcggcauccuccugccgcagaaggucuggugcgccuccgggcggagcaaggugaucaagggcucgcugccccucaucggggaggccgauugccugcacgagaaguacggcgggcugaacaaguccaagcccuacuacaccggcgagcacgcgaaggccaucggcaacugccccaucugggugaagacgccgcucaagcuggucaacgggaccaaguaccgcccgcccgccaagcugcucaaggagcggggcuucuucggggccaucgccggcuuucuggagggcgggugggagggcaugaucgcgggguggcacggcuacaccucgcacggggcccacggcguggccgucgccgccgaccugaaguccacccaggaggcgaucaacaagaucacgaagaaccucaacagccuguccgagcuggaggugaagaaccuccagcgccugucgggcgccauggacgagcugcacaaugagauccucgagcuggacgagaagguggacgaccugcgggccgacaccaucuccagccagaucgagcucgccguccugcuguccaacgaggggaucaucaacucggaggacgagcaccuccuggcccuggagcgcaagcucaagaagaugcugggccccuccgcgguggagaucgggaacggcugcuucgagaccaagcauaagugcaaccagaccugccuggaccggaucgccgccgggaccuucgacgccggcgaguucagccuccccacguucgacucccugaacaucaccgcggccucgcugaacgacgauggccucgacaaccacaccauccugcuguacuacuccaccgccgccagcucccuggccgugacgcucaugaucgcgaucuucgucguguacauggugucgcgcgacaacgucuccugcagcaucugccuguga

SEQ ID NO: 14169 - RNA, 1755 nt, Artificial Sequence
  derived and/or modified CDS sequence (AUadapt) from InfluenzaB__ABL76760__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaagucccacuucgccaaccugaaggggacgaagacccggggcaagcucugcccgaccugccugaacuguaccgaccuggacguggcccucgggcgccccaugugcgugggcgucacgcccuccgccaaggccagcauccugcacgaggugcggcccgugaccuccggcugcuuccccaucaugcaugaccgcaccaagauccggcagcugcccaaccuccugcgcggguacgagaagauccggcugucgacccagaacgucaucaacgcggagaaggccccgggcgggcccuaccgccucggcacguccgggaguugccccaacgccaccucccggagcggcuucuucgccaccauggcgugggccgugccccgcgacaacaauaagaccgccacgaacccgcugaccaucgaggugccccacaucugcaccaaggaggaggaccagaucaccgucuggggcuuccacuccgacaauaagacgcagaugaagaaccuguacggggacagcaacccccagaaguucaccuccucggccaauggcgugaccacccacuacgugucccagaucgggggcuuccccgaccagacggaggacggcgggcucccgcagagcggccggaucgucguggacuauauggugcagaagcccgggaagaccggcaccaucgucuaccagcgcgggauccugcugccccagaagguguggugcgccuccggccggagcaaggugaucaagggcagccucccccugaucggggaggcggacugccugcacgagaaguauggcgggcucaacaaguccaagccguacuacaccggcgagcacgccaaggccaucgggaacugccccaucugggucaagacgccccugaagcuggccaauggcaccaaguaccggcccccggccaagcuccugaaggagcgcggcuucuucggggcgaucgccggcuuccuggagggcgggugggaggggaugaucgccggcuggcacggcuacaccagccauggggcccacggcguggccgucgcggccgaccucaaguccacccaggaggccaucaacaagaucacgaagaaccugaacucgcuguccgagcucgaggugaagaaccugcagcgccugaguggggccauggacgagcuccacaacgagauccuggagcuggacgagaagguggacgaccuccgggccgacaccaucuccagucagaucgagcuggcgguccugcucuccaacgagggcaucaucaacagcgaggacgagcaccuccuggcccuggagcgcaagcugaagaagaugcugggccccuccgccguggacaucgggaacggcuguuucgagaccaagcacaagugcaaccagaccugccucgaccggaucgccgcggggaccuucgaugccggcgaguucucgcugcccacguucgacucccugaacaucaccgccgccagccucaacgaugacgggcuggacaaccacaccauccugcuguacuacuccaccgccgcgagcucccucgccgugacgcugaugaucgccaucuuuaucgucuacaugaucagccgcgacaacguguccugcagcaucugccuguga

SEQ ID NO: 14170 - RNA, 1755 nt, Artificial Sequence
  derived and/or modified CDS sequence (AUadapt) from InfluenzaB__ABL76771__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaagucccacuucgccaaccugaaggggacgaagacccggggcaagcucugcccgaccugccugaauugcaccgaccuggacguggcccucgggcgccccaugugcgugggcgucacgcccuccgccaaggccagcauccugcacgaggugcggcccgugaccuccggcugcuuucccaucaugcacgaccgcaccaagauccggcagcugcccaaccuccugcgcggguacgagaagauccggcugagcacccagaacgucaucaaugcggagaaggccccgggcgggcccuaccgccucggcacguccgggucgugccccaacgccaccucccggagcggcuucuucgccaccauggcgugggccgugccccgcgauaacaacaagaccgccacgaacccgcugaccaucgaggugccccacaucugcaccaaggaggaggaccagaucaccgucuggggcuuucacuccgacgacaagacgcagaugaagaaccuguacggggacagcaauccccagaaguucaccuccagcgccaacggcgugaccacccacuacgugucccagaucgggggcuuccccgaucagacggaggacggcgggcucccgcagagcggccggaucgucguggacuacauggugcagaagcccgggaagaccggcaccaucgucuaccagcgcgggauccugcugccccagaagguguggugcgccuccggccggagcaaggugaucaagggcagucucccccugaucggggaggcggacugccugcacgagaaguacggcgggcucaacaaguccaagccguacuauaccggcgagcacgccaaggccaucgggaacugccccaucugggucaagacgccccugaagcuggccaacggcaccaaguaccggcccccggccaagcuccugaaggagcgcggcuucuucggggcgaucgccggcuuucuggagggcgggugggaggggaugaucgccggcuggcacggcuacaccagccacggggcccacggcguggccgucgcggccgaccucaaguccacccaggaggccaucaauaagaucacgaagaaccugaacagccuguccgagcucgaggugaagaaccugcagcgccugagcggggccauggacgagcuccacaaugagauccuggagcuggacgagaagguggacgaccuccgggccgacaccaucuccagccagaucgagcuggcgguccugcucuccaacgagggcaucaucaauucggaggacgagcaccuccuggcccuggagcgcaagcugaagaagauccugggccccuccgccguggacaucgggaacggcugcuucgagaccaagcauaagugcaaccagaccugccucgaccggaucgccgcggggaccuucgacgccggcgaguuuagccugcccacguucgacucccugaacaucaccgccgccagccucaacgacgaugggcuggacaaccacaccauccugcuguacuacuccaccgccgcgagcucccucgccgugacgcugaugaucgccaucuuuaucgucuacaugaucagccgcgacaacguguccugcagcaucugccuguga

SEQ ID NO: 14171 - RNA, 1755 nt, Artificial Sequence
  derived and/or modified CDS sequence (AUadapt) from InfluenzaB__ABL76782__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaagucccauuucgccaaccugaaggggacgaagacccggggcaagcucugcccgaccugccugaacugcaccgaccuggacguggcccucgggucccccaugugcgugggcaucacgcccagugccaaggccuccauccugcacgagguccgccccgugaccagcggcugcuuccccaucaugcacgaccggaccaagauccgccagcugcccaaccuccugcggggguacgagaagauccgccuguccacccagaaugugaucaacaucgagaaggcgccgggcgggcccuaccggcucggcacgagcggguccugccccaacgccaccucgcgcuccggcuucuucgccaccauggccugggcggucccccgggacaauaacaagaccgccacgaacccgcugaccguggaggugccccacaucugcaccaaggaggaggaccagaucaccgucuggggcuuccacagcgauaacaaggcccagaugaagaaccuguacggggacuccaacccccagaaguucacgagcuccgccaacggcgugaccacccacuaugugucgcagaucgggggcuuccccgaccagaccgaggacggcgggcucccgcaguccggccgcaucgucguggacuacauggugcagaagcccgggaagacgggcaccaucgucuaccagcgggggauccugcugccccagaagguguggugcgccaguggccgcagcaaggugaucaagggcucccucccccugaucggggaggcggacugccugcacgagaaguacggcgggcucaacaagagcaagccguacuacaccggcgagcaugccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuauaccucccacggggcccacggcguggccgucgcggccgaccucaagucgacccaggaggccaucaacaagaucaccaagaaccugaacucccugagcgagcucgaggugaagaaccugcagcggcuguccggggccauggaugagcuccacaacgagauccuggagcuggacgagaagguggacgaccuccgcgccgacacgaucagcucccagaucgagcuggcgguccugcucucgaaugagggcaucaucaacuccgaggacgagcaccuccuggcccuggagcggaagcugaagaagaugcugggccccagcgccguggacaucgggaacggcugcuucgagaccaagcacaaguguaaccagaccugccucgaccgcaucgccgcggggaccuucaacgccggcgaguucucccugcccaccuucgacagucugaacaucacggccgccucccucaacgacgacgggcuggacaaccacaccauccugcuguacuacaguaccgccgcguccagccucgccgugacccugaugaucgccaucuucaucgucuacaugaucucccgggacaacgugagcugcagcaucugccuguga

SEQ ID NO: 14172 - RNA, 1755 nt, Artificial Sequence; identical to SEQ ID NO: 14145
  derived and/or modified CDS sequence (AUadapt) from InfluenzaB__ABL76793__HA

SEQ ID NO: 14173 - RNA, 1755 nt, Artificial Sequence; identical to SEQ ID NO: 14145
  derived and/or modified CDS sequence (AUadapt) from InfluenzaB__ABL76815__HA

SEQ ID NO: 14174 - RNA, 1758 nt, Artificial Sequence
  derived and/or modified CDS sequence (AUadapt) from InfluenzaB__ABL76826__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacgaagacccggggcaagcucugccccgagugccugaacuguaccgaccuggacguggcccucgggcgccccaagugcaccggcaacaucccguccgccaaggugucgauccugcacgagguccggcccgugacguccggcugcuuccccaucaugcacgaccgcaccaagauccggcagcugcccaaccuccugcgcggguacgagcacauccggcugagcacccacaaugugaucaacgccgagaaggcgccgggcgggcccuacaagaucggcaccuccgggucgugccccaacgucacgaacggcaacggcuucuucgccaccauggccugggccgugcccaagaacgacaacaacaagaccgcgaccaacucccucacgaucgaggugccguacaucuguaccgagggggaggaccagaucaccgucuggggcuuccacucggacaacgagacccagauggccaagcuguacggggacuccaagccccagaaguucacgagcuccgccaacggcgugaccacccacuacgugucgcagaucggcggguuccccaaucagaccgaggacggcgggcugccccaguccggccgcaucgucguggacuacauggugcagaaguccgggaagacgggcaccaucaccuaccagcggggcauccuccugccgcagaaggucuggugcgccuccgggcgcagcaaggugaucaagggcucgcugccccucaucggggaggccgacugccugcacgagaaguacggcgggcugaacaaguccaagcccuacuacaccggcgagcacgcgaaggccaucggcaauugccccaucugggugaagacgccgcucaagcuggccaacgggaccaaguaccggccgcccgccaagcugcucaaggagcgcggcuucuucggggccaucgcgggcuuccuggagggcgggugggagggcaugaucgccggguggcacggcuacaccucgcacggggcccacggcgucgccguggccgcggaccugaaguccacccaggaggccaucaacaagaucacgaagaaccucaacagucuguccgagcuggaggucaagaaccuccagcggcugucgggcgccauggacgagcugcacaacgagauccucgagcuggacgagaagguggacgaccugcgcgccgacaccaucuccucgcagaucgagcucgccgugcugcuguccaacgaggggaucaucaacagcgaggacgagcaccuccuggcgcuggagcggaagcucaagaagaugcugggccccuccgccgucgagaucgggaauggcugcuucgagaccaagcacaagugcaaccagaccugccuggaccgcaucgccgccgggaccuucgacgcgggcgaguucucgcuccccacguucgacucccugaacaucaccgccgccucgcugaaugacgacggccucgacaaccacaccauccugcuguacuacuccaccgccgccagcucccuggcggugacgcucaugaucgccaucuucguggucuacauggugucgcgggacaacguguccugcagcaucugccuguga

SEQ ID NO: 14175 - RNA, 1758 nt, Artificial Sequence
  derived and/or modified CDS sequence (AUadapt) from InfluenzaB__ABL76837__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccacuuugccaaccugaaggggacgaagacccggggcaagcucugccccaagugccugaacugcaccgaccuggacguggcccucgggcgccccaagugcaccggcaacaucccguccgccgaggugagcauccugcaugagguccggcccgugacguccggcugcuuccccaucaugcacgaccgcaccaaggugcggcagcugcccaaccuccugcgcggguacgagcacauccggcugucgacccacaacgucaucaaugccgagaaggcgccgggcgggcccuacaagaucggcaccuccgggagcugccccaacgugacgaacggcaacggcuucuucgccaccauggccugggccgugcccaagaacgacaauaacaagaccgcgaccaacucccucacggucgaggugccguacaucugcaccgagggggaggaccagaucaccguguggggcuuccacucggacuccgagacccagauggccaagcuguacggggauagcaagccccagaaguucacguccagcuccaacggcgucaccacccacuacgugucgcagaucggcggguuccccaaccagaccgaggacggcgggcugccccaguccggccgcaucguggucgauuacauggugcagaaguccgggaagacgggcaccaucaccuaccagcggggcauccuccugccgcagaagguguggugcgccagcgggcgcuccaaggucaucaagggcucgcugccccucaucggggaggccgacugccugcacgagcgguacggcgggcugaacaaguccaagcccuacuauaccggcgagcacgccaaggcgaucggcaacugccccaucugggugaagacgccgcucaagcuggccaacgggaccaaguaccgcccgcccgccaagcugcucaaggagcggggcuucuucggggccaucgccggcuuccuggagggcgggugggagggcaugaucgcgggguggcacggcuacaccagucacggggcccacggcgucgccguggccgccgaccugaaguccacccaggaggcgaucaacaagaucacgaagaaccucaacagccuguccgagcuggaggugaagaaccuccagcgccugucgggcgccauggacgagcugcauaacgagauccucgagcuggacgagaaggucgacgaccugcgggccgacaccaucuccagccagaucgagcucgccgugcugcuguccaacgaggggaucaucaacucggaggacgagcaucuccuggcccuggagcgcaagcucaagaagaugcugggccccuccgcgguggagaucgggaacggcugcuucgagaccaagcacaagugcaaccagaccugccuggaccggaucgccgccgggaccuucgacgccggcgaguuuagccuccccacguucgacucccugaacaucaccgcggccagccugaacgacgacggccucgacaaccauaccauccugcuguacuacuccaccgccgccucgucccuggccgucacgcucaugaucgcgaucuucgugguguacauggucagccgcgacaacgugagcugcuccaucugccuguga

SEQ ID NO: 14176 - RNA, 1755 nt, Artificial Sequence
  derived and/or modified CDS sequence (AUadapt) from InfluenzaB__ABL76848__HA
augaaggccaucaucgugcugcucauggucgugaccaguaacgccgaccgcaucugcaccggcaucacguccagcaacuccucgcacguggucaagaccgcgacccagggggaggugaacgugaccggcgccaucccccugacgaccaccccgaccaagucccauuucgccaaccugaaggggacgaagacccggggcaagcucugcccgaccugccugaacugcaccgaccuggacgucgcccucgggcgccccaugugugugggcaucacgccgcccgccaaggcgagcauccugcacgaggugcggcccgucaccuccggcugcuuccccaucaugcacgaccgcaccaagauccggcagcugcccaaccuccugcgcggguacgagaagauccggcugucgacccagaaugugaucaacgccgagaaggcccccggcgggcccuaccgccucggcacguccgggagcugccccaacgccaccuccaagagcggcuucuucgcgaccauggccugggccgugccccgggauaacaacaagaccgccacgaacccgcugaccgucgaggugccccacaucugcaccaaggaggaggaccagaucaccguguggggcuuccacuccgacaauaagacgcagaugaagaaccuguacggggacucgaacccccagaaguucaccuccagcgccaacggcaucaccacccauuacgucucccagaucgggggcuuccccgaccagacggaggacggcgggcucccgcagucgggccgcaucgugguggacuacaugguccagaagcccgggaagaccggcaccaucguguaccagcgggggauccugcugccccagaagguguggugcgcguccggccgcaguaaggucaucaagggcagccucccccugaucggggaggccgacugccugcacgagaaguacggcgggcucaacaaguccaagccguacuacaccggcgagcaugccaaggccaucgggaacugccccaucugggugaagacgccccugaagcuggccaacggcaccaaguaccggcccccggcgaagcuccugaaggagcgcggcuucuucggggccaucgccggcuuccuggagggcgggugggaggggaugaucgccggcuggcacggcuacaccagucacggggcccacggcguggcggucgccgccgaccucaaguccacccaggaggccaucaacaagaucacgaagaaccugaacagccuguccgagcucgaggugaagaaccugcagcggcugaguggggccauggacgagcuccacaacgagauccuggagcuggacgagaaggucgacgaccuccgcgcggacaccaucuccagccagaucgagcuggccgugcugcucuccaacgagggcaucaucaauagcgaggacgagcaccuccuggcccuggagcggaagcugaagaagaugcugggccccuccgccguggacaucgggaacggcugcuucgagaccaagcacaaguguaaccagaccugccucgaccgcaucgcggccgggaccuucaacgccggcgaguucucgcugcccacguucgacucccugaauaucaccgccgccagccucaacgacgacgggcuggacaaccacaccauccugcuguacuauuccaccgcggccucgucccucgccgucacgcugaugaucgccaucuucaucguguacaugaucagccgggacaacguguccugcagcaucugccuguga

SEQ ID NO: 14177 - RNA, 1755 nt, Artificial Sequence; identical to SEQ ID NO: 14145
  derived and/or modified CDS sequence (AUadapt) from InfluenzaB__ABL76859__HA

SEQ ID NO: 14178 - RNA, 1755 nt, Artificial Sequence
  derived and/or modified CDS sequence (AUadapt) from InfluenzaB__ABL76881__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaagucccacuucgccaaccugaaggggacgcggacccgcggcaagcucugccccgacugccugaauugcaccgaccuggacguggcccucgggcggcccaugugcgugggcaccacgccguccgccaaggccagcauccugcacgagguccgccccgugaccuccggcugcuuucccaucaugcacgaccggaccaagauccgccagcugcccaaccuccugcggggguacgagaacauccgccugagcacccagaaugugaucgacgcggagaaggccuccggcgggccguaccggcucggcacgucgggguccugccccaacgccaccagcaaguccggcuucuuugccaccauggcgugggccguccccaaggacaacaacaagaacgccaccaacccccugacgguggaggugccguacaucugcaccgagggcgaggaucagaucaccgucuggggguuccacagcgacaacgagacccagaugaagaaccuguauggcgacuccaacccccagaaguucacgagcuccgccaacggggugaccacccacuacgugagucagaucggcggcuuccccgaccagaaggaggacgggggccucccccaguccgggcgcaucgucguggacuacauggugcagaagccgggcaagaccgggacgaucgucuaccagcggggcgugcugcugccccagaagguguggugcgccaguggccgcucgaaggucaucaaggggucccucccccugaucggcgaggcggacugccugcacgagaaguacgggggccucaacaagaguaagcccuacuacaccggggagcacgccaaggccaucggcaacugcccgaucugggugaagacgccccugaagcuggccaacggcaccaaguaccggccgcccgccaagcuccugaaggagcgcggguuuuucggcgcgaucgccggguuccuggagggcgggugggagggcaugaucgccggcuggcacggguacaccucccacggcgcccacggggucgccguggcggccgaccucaagaguacccaggaggccaucaacaagaucaccaagaaccugaacucccugagcgagcucgaggugaagaaccugcagcggcuguccggcgccauggacgagcuccauaacgagauccuggagcuggacgagaaggucgacgaccuccgcgccgacaccaucagcucccagaucgagcuggcggugcugcucagcaaugagggcaucaucaacuccgaggacgagcaccuccuggcccuggagcggaagcugaagaagaugcuggggcccucggccguggacaucggcaacgggugcuuugagacgaagcacaagugcaaccagaccugccucgaccgcaucgccgcgggcaccuucaaugccggggaguucucccugcccaccuucgacagccugaacaucaccgccgccucccucaacgacgauggccuggacaaccacacgauccugcuguacuacagcaccgccgcguccagccucgccgucacccugaugcuggccaucuuuaucguguacauggugucccgggacaacgucagcugcagcaucugccucuga

SEQ ID NO: 14179 - RNA, 1755 nt, Artificial Sequence
  derived and/or modified CDS sequence (AUadapt) from InfluenzaB__ABL76892__HA
augaaggccaucaucgugcugcucauggucgugaccaguaacgccgaccgcaucugcaccggcaucacguccagcaacaguccccacguggucaagaccgcgacccagggggaggugaacgugaccggcgucaucccgcugacgaccacccccaccaagucccacuucgccaaccugaaggggacgcggacccgcggcaagcucugccccgauugccugaacugcaccgaccuggacguggcccucgggcggcccaugugcgugggcaccacgccguccgccaaggccaguauccugcacgagguccgccccgugaccuccggcugcuuccccaucaugcacgaccggaccaagauccgccagcugcccaaccuccugcggggguaugagaacauccgccugagcacccagaacgugaucgacgcggagaaggccccgggcgggcccuaccggcucggcacguccgggagcugucccaacgccaccuccaagagcggcuucuucgccaccauggcgugggccguccccaaggacaacaauaagaacgccaccaacccgcugacgguggaggugcccuacgucugcaccgagggcgaggaccagaucaccguguggggguuccauuccgacaacaagacccagaugaagaaccuguacggcgacagcaauccccagaaguucacguccagcgccaacggggugaccacccacuacgucucccagaucggcggcuuccccgaucagaccgaggacgggggccucccgcagagcgggcgcaucgugguggacuacaugguccagaagcccggcaagacggggaccaucguguaccagcggggcgugcugcugccccagaaggucuggugcgccuccggccgcaguaaggugaucaaggggucgcucccccugaucggcgaggcggacugccugcacgagaaguacgggggccucaauaaguccaagccguacuacaccggggagcacgccaaggccaucggcaacugccccaucugggucaagacgccccugaagcuggccaacggcaccaaguaucggcccccggccaagcuccugaaggagcgcggguucuucggcgcgaucgccggguuccuggagggcgggugggagggcaugaucgccggcuggcacggguacaccagccauggcgcccacgggguggccguggcggccgaccucaaguccacccaggaggccaucaacaagaucaccaagaaccugaacagccuguccgagcucgaggucaagaaucugcagcggcugagcggcgccauggacgagcuccacaacgagauccuggagcuggacgagaagguggacgaucuccgcgccgacacgaucuccagccagaucgagcuggcggugcugcucuccaacgagggcaucaucaacagcgaggacgagcaucuccuggcccuggagcggaagcugaagaagaugcuggggcccuccgccgucgacaucggcaacgggugcuucgagaccaagcacaagugcaaucagaccugccucgaccgcaucgccgcgggcaccuucaacgccggggaguucagccugcccaccuuugacucccugaacaucacggccgccagccucaacgacgacggccuggauaaccacaccauccugcuguacuacuccaccgccgcgagcucccucgccgugacccugaugcuggccaucuucaucguguauauggucagccgggacaacguguccugcagcaucugccucuga

SEQ ID NO: 14180 - RNA, 1755 nt, Artificial Sequence
  derived and/or modified CDS sequence (AUadapt) from InfluenzaB__ABL76903__HA
augaaggccaucaucgugcugcucauggucgugaccaguaacgccgaccgcaucugcaccggcaucacguccagcaacaguccccacguggucaagaccgcgacccagggggaggugaacgugaccggcgucaucccgcugacgaccacccccaccaaguccuacuucgccaaccugaaggggacgcggacccgcggcaagcucugccccgauugccugaacugcaccgaccuggacguggcccucgggcggcccaugugcgugggcaccacgccguccgccaaggccaguauccugcacgagguccgccccgugaccuccggcugcuuccccaucaugcacgaccggaccaagauccgccagcugcccaaccuccugcggggguaugagaacauccgccugagcacccaguccgugaucgacgcggagaaggccccgggcgggcccuaccggcucggcacgagcggguccugccccaaugccaccagcaaguccggcuucuucgccaccauggcgugggccguccccaaggacaacaacaagaaugccaccaacccgcugacgguggaggugcccuacaucugcaccgagggcgaggaccagaucaccgucuggggguuccacagugacgacaagacccagaugaagaaccuguacggcgacuccaauccccagaaguucacgagcuccgccaacggggugaccacccacuacgugagccagaucggcggcuuucccgaccagaccgaggacgggggccucccgcaguccgggcgcaucgucguggacuacaugauccagaagcccggcaagacggggaccaucguguaccagcggggcguccugcugccccagaagguguggugcgccaguggccgcagcaaggugaucaaggggucccucccccugaucggcgaggcggacugccugcacgagaaguacgggggccucaacaagaguaagccguacuacaccggggagcacgccaaggccaucggcaacugccccaucugggucaagacgccccugaagcuggccaacggcaccaaguaucggcccccggccaagcuccugaaggagcgcggguucuucggcgcgaucgccggguuccuggagggcgggugggagggcaugaucgccggcuggcacggguacaccucccacggcgcccaugggguggccgucgcggccgaccucaagagcacccaggaggccaucaacaagaucaccaagaaccugaacucccugagcgagcucgaggugaagaaucugcagcggcuguccggcgccauggacgagcuccacaacgagauccuggagcuggacgagaagguggacgaucuccgcgccgacacgaucagcgcgcagaucgagcuggccguccugcucuccaacgagggcaucaucaacagcgaggacgagcaucuccuggcccuggagcggaagcugaagaagaugcuggggcccuccgccguggacaucggcaacgggugcuucgagaccaagcacaagugcaaucagaccugccucgaccgcaucgcggccggcaccuucaacgccggggaguucagccugcccaccuuugacucccugaacaucacggccgccagccucaacgacgacggccuggauaaccacaccauccugcuguacuacuccaccgcggccagcucccucgccgugacccugaugcuggccaucuucaucgucuauauggugagccgggacaacguguccugcagcaucugccucuga

SEQ ID NO: 14181 - RNA, 1758 nt, Artificial Sequence
  derived and/or modified CDS sequence (AUadapt) from InfluenzaB__ABL76914__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacgaagacccggggcaagcucugucccaagugccugaacugcaccgaccuggacguggcccucgggcgccccaagugcaccggcaacaucccguccgccgaggugagcauccugcacgagguccggcccgugacguccggcugcuuccccaucaugcacgaucgcaccaagauccggcagcugcccaaccuccugcgcggguacgagcacauccggcugucgacccacaacgugaucaacgccgagaaggcgccgggcgggcccuacaagaucggcaccuccgggagcugccccaacgucacgaacggcaauggcuucuucgccaccauggccugggccgugcccaagaacgacaacaacaagaccgcgaccaacucccucacgaucgaggugccguacaucugcaccgagggggaggaccagaucaccgucuggggcuuccacucggauaacgaggcccagauggccaagcuguacggggacuccaagccccagaaguucaccagcuccucgaacggcgugacgacccacuacgugucccagaucggcggguuccccaaccagaccgaggacggcgggcugccccagaguggccgcaucgucguggacuacauggugcagaaguccgggaagaccggcacgaucaccuaccagcggggcauccuccugccgcagaaggucuggugcgccucggggcgcagcaaggugaucaagggcucccugccccucaucggggaggccgacugccugcacgagcgguacggcgggcugaacaagucgaagcccuauuacaccggcgagcacgcgaaggccaucggcaacugccccaucugggugaagaccccgcucaagcuggccaacgggacgaaguaccgcccgcccgccaagcugcucaaggagcggggcuucuucggggccaucgcgggcuuccuggagggcgggugggagggcaugaucgccggguggcacggcuacaccucccacggggcccauggcgucgccguggccgcggaccugaaguccacccaggaggccaucaacaagaucaccaagaaccucaacucccugagcgagcuggaggucaagaaccuccagcgccuguccggcgccauggacgagcugcacaacgagauccucgagcuggacgagaagguggacgaccugcgggccgacacgaucaguucccagaucgagcucgccgugcugcugagcaacgaggggaucaucaacuccgaggacgagcaccuccuggcgcuggagcgcaagcucaagaagaugcugggccccucggccgucgagaucgggaacggcugcuucgagaccaagcacaagugcaaccagaccugucuggaccggaucgccgccgggaccuucgacgcgggcgaguucucccuccccaccuucgacagccugaacaucacggccgccucccugaacgacgacggccucgacaaucacaccauccugcuguacuacucgaccgccgccuccagccuggcggugacccucaugaucgccaucuucguggucuacauggugucccgcgacaacgugucgugcagcaucugccuguga

SEQ ID NO: 14182 - RNA, 1755 nt, Artificial Sequence
  derived and/or modified CDS sequence (AUadapt) from InfluenzaB__ABL76936__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaagucccacuucgccaaccugaaggggacgaagacccggggcaagcucugcccgaccugccugaauugcaccgaccuggacguggcccucgggcgccccaugugcgugggcacgacccccuccgccaaggccagcauccugcacgagguccggcccgugaccuccggcuguuuccccaucaugcacgaccgcaccaagauccggcagcugcccaaccuccugcgcggguacgagaagauccggcugagcacgcagaaugugaucaacgcggagaaggccccgggcgggcccuaccgccucggcaccuccgggagcugccccaacgccaccucccggagcggcuuuuucgccaccauggcgugggccgucccccgcgacaacaacaagacggccaccaacccgcugaccguggaggugcccuacaucuguaccaaggaggaggaccagaucacggucuggggcuuccacuccgacgacaagacccagaugaagaaccuguauggggacucgaacccccagaaguucaccuccagcgccaacggcgugaccacgcauuacgugucccagaucgggggcuuccccgaccagaccgaggacggcgggcucccgcagagcggccggaucgucguggacuauauggugcagaagcccgggaagaccggcaccaucgucuaccagcgcggggugcugcugccccagaagguguggugcgccuccggccggagcaaggucaucaagggcagccucccccugaucggggaggcggacugccugcacgagaaguauggcgggcucaacaaguccaagccguacuacacgggcgagcacgccaaggccaucgggaacugccccaucugggugaagacgccccugaagcuggccaauggcaccaaguaccggcccccggccaagcuccugaaggagcgcggcuucuucggggcgaucgccggcuuccuggagggcgggugggaggggaugaucgccggcuggcacggcuacaccagucacggggcccacggcgucgccguggcggccgaccucaaguccacccaggaggccaucaacaagaucaccaagaaccugaacagucuguccgagcucgaggugaagaaccugcagcgccugucgggggccauggacgagcuccacaacgagauccuggagcuggacgagaaggucgaugaccuccgggccgacaccaucuccagccagaucgagcuggcggugcugcucuccaacgagggcaucaucaacagcgaggaugagcaccuccuggcccuggagcgcaagcugaagaagaugcugggccccuccgccguggacaucgggaacggcugcuucgagaccaagcacaaguguaaccagaccugccucgaccggaucgccgcggggacguucaacgccggcgaguucagucugcccaccuucgacucccugaacaucaccgccgccagccucaacgacgaugggcuggacaaccacaccauccugcuguacuacuccacggccgcgagcucccucgccgucacccugaugaucgccaucuuuaucguguacauggugagccgcgacaacgucuccugcagcaucugccuguga

SEQ ID NO: 14183 - RNA, 1755 nt, Artificial Sequence
  derived and/or modified CDS sequence (AUadapt) from InfluenzaB__ABL76947__HA
augaaggccaucaucgugcugcucauggucgugaccaguaacgccgaccgcaucugcaccggcaucacguccagcaacagcccccacguggucaagaccgcgacccagggggaggugaaugugaccggcgccaucccgcugacgaccacccccaccaagucccacuucgccaaccugaaggggacgaagacccggggcaagcucugcccgaccugccugaacugcaccgaucuggacgucgcccucgggcgccccaugugcgugggcaucacgcccuccgccaaggcgucgauccugcacgaggugcggcccgucaccuccggcugcuuccccaucaugcacgaccgcaccaagauccggcagcugcccaaucuccugcgcggguacgagaagauccggcugagcacccagaacgugaucaacgccgagaaggccccgggcgggcccuaccgccucggcacguccgggagcugccccaaugccaccucccggucgggcuucuucgcgaccauggccugggccgugccccgcgacaacaacaagaccgccacgaacccgcugaccgucgaggugccccauaucugcaccaaggaggaggaccagaucaccguguggggcuuccacuccgacgacaagacgcagaugaagaaccuguacggggauagcaacccccagaaguucaccuccagcaccaacggcaucaccacgcacuacgucucccagaucgggggcuuucccgaccagaccgaggacggcgggcucccgcagucgggccggaucgugguggacuacaugguccagaagcccgggaagaccggcaccaucguguaccagcgcgggauccugcugccccagaagguguggugcgccuccggccggaguaaggucaucaagggcagccucccccugaucggggaggcggacugccugcacgagaaguacggcgggcucaacaaguccaagccguacuacacgggcgagcaugccaaggccaucgggaacugccccaucugggugaagacgccccugaagcuggccaacggcaccaaguaccggcccccggccaagcuccugaaggagcgcggcuucuucggggcgaucgccggcuuccuggagggcgggugggaggggaugaucgccggcuggcauggcuacaccucgcacggggcccacggcguggccgucgcggccgaccucaaguccacccaggaggccaucaacaagaucaccaagaaccugaauagccuguccgagcucgaggugaagaaccugcagcgccugagcggggccauggacgagcuccacaacgagauccuggagcuggacgagaaggucgacgaucuccgggccgacaccaucuccucgcagaucgagcuggcggugcugcucuccaacgagggcaucaucaacagcgaggacgagcaccuccuggcccuggagcgcaagcugaagaagaugcugggccccuccgccguggauaucgggaacggcugcuucgagaccaagcacaagugcaaccagaccugccucgaucggaucgccgcggggacguucaacgccggcgaguucagccugcccaccuucgacucccugaacaucaccgccgccucgcucaaugacgacgggcuggacaaccacaccauccugcuguacuacuccacggccgcgaguucccucgccgucacccugaugaucgccaucuucaucguguacaugaucagccgcgacaacguguccugcagcaucugccuguga

SEQ ID NO: 14184 - RNA, 1758 nt, Artificial Sequence
  derived and/or modified CDS sequence (AUadapt) from InfluenzaB__ABL76958__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaauaucccguccgccaaggugucgauccugcacgagguccggcccgugacguccggcugcuuccccaucaugcacgaccgcaccaagauccggcagcugcccaaccuccugcgcggguacgagcacauccggcugucgacccacaacgugaucaacgccgagaaggcgccgggcgggcccuacaagaucggcaccuccgggucgugccccaacgucacgaacggcaacggcuucuuugccaccauggccugggccgugcccaagaacgacaacaacaagaccgcgaccaacucccucacgaucgaggugccguacaucugcaccgagggggaggaccagaucaccgucuggggcuuccacagcgacaacgaggcccagauggccaagcuguacggggacuccaagccccagaaguucaccucguccgccaacggcgugacgacccacuacgugagucagaucggcggguuccccaaccagaccgaggacggcgggcugccccaguccggccgcaucgucguggacuacauggugcagaaguccgggaagaccggcacgaucaccuaccagcggggcauccuccugccgcagaaggucuggugcgccuccgggcgcagcaaggugaucaagggcucgcugccccucaucggggaggcggacugccugcacgagaaguacggcgggcugaacaaguccaagcccuacuacaccggcgagcacgccaaggccaucggcaacugccccaucugggugaagaccccgcucaagcuggccaaugggacgaaguaccggccgcccgccaagcugcucaaggagcgcggcuucuucggggcgaucgccggcuuccuggagggcgggugggagggcaugaucgccggguggcacggcuacaccucgcacggggcccacggcgucgccguggcggccgaccugaaguccacccaggaggccaucaacaagaucaccaagaaccucaacucgcuguccgagcuggaggucaagaaccuccagcggcugagcggcgccauggacgagcugcacaacgagauccucgagcuggacgagaagguggaugaccugcgcgccgacacgaucuccucgcagaucgagcucgcggugcugcuguccaacgaggggaucaucaacucggaggacgagcaccuccuggcccuggagcggaagcucaagaagaugcugggccccuccgccgucgagaucgggaacggcugcuucgagaccaagcacaagugcaaccagaccugccuggaccgcaucgccgcggggaccuucaacgccggcgaguucucgcuccccaccuuugacucccugaacaucacggccgccagccugaacgacgacggccucgacaaccacaccauccugcuguacuacuccaccgccgcgucgucccuggccgugacccucaugaucgccaucuucguggucuacauggugucgcgggacaacaucuccugcagcaucugccuguga

SEQ ID NO: 14185 - RNA, 1758 nt, Artificial Sequence
  derived and/or modified CDS sequence (AUadapt) from InfluenzaB__ABL76969__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacgcggacccgcggcaagcucugccccaagugucugaacugcaccgaccuggacguggcccucgggcggcccaagugcaccggcaacaucccguccgccaaggugagcauccugcacgagguccgccccgugacguccggcugcuuccccaucaugcacgaccggaccaagauccgccagcugcccaaccuccugcggggguacgagcauauccgccugucgauccacaacgugaucaacgccgagaaggcgccgggcgggcccuacaagaucggcaccuccgggagcugccccaacgucaccaacggcaacggcuucuucgccacgauggccugggccgugcccaagaacgauaacaacaagaccgcgaccaacucccucaccaucgaggugccguacaucugcacggagggggaggaccagaucaccgucuggggcuuccacucggacaacgaggcccagauggccaagcuguacggggacuccaagccccagaaguucaccaguuccgccaacggcgugaccacgcacuacgugucgcagaucggcggguuccccaaccagaccgaggacggcgggcugccccaguccggccggaucgucguggacuacauggugcagaaguccgggaagaccggcaccaucacguaccagcgcggcauccuccugccgcagaaggucuggugcgccuccgggcggagcaaggugaucaagggcucgcugccccucaucggggaggcggauugccugcacgagaaguacggcgggcugaacaaguccaagcccuacuacaccggcgagcacgccaaggccaucggcaacugccccaucugggugaagaccccgcucaagcuggccaacgggaccaaguaccgcccgcccgccaagcugcucaaggagcggggcuucuucggggcgaucgccggcuuccuggagggcgggugggagggcaugaucgccggguggcauggcuacacgucgcacggggcccacggcgucgccguggcggccgaccugaaguccacccaggaggccaucaacaagaucaccaagaaccucaacagccuguccgagcuggaggucaagaaccuccagcgccugucgggcgccauggacgagcugcacaaugagauccucgagcuggacgagaagguggacgaccugcgggccgacaccaucuccagccagaucgagcucgcggugcugcuguccaacgaggggaucaucaacucggaggacgagcaccuccuggcccuggagcgcaagcucaagaagaugcugggccccuccgccgucgagaucgggaacggcugcuucgagacgaagcacaaguguaaccagaccugccuggaccggaucgccgcggggaccuucgacgccggcgaguucagccuccccaccuucgacucccugaacaucaccgccgccucgcugaacgacgauggccucgacaaccacacgauccugcuguacuacuccaccgccgcgagcucccuggccgugacccucaugaucgccaucuucguggucuacauggugucgcgcgacaacguguccugcagcaucugccuguga

SEQ ID NO: 14186 - RNA, 1755 nt, Artificial Sequence
  derived and/or modified CDS sequence (AUadapt) from InfluenzaB__ABL76980__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaagucccauuucgccaaccugaaggggacgaagacccggggcaagcucugcccgaccugccugaacugcaccgaccuggacguggcccucgggcgccccaugugugugggcaucacgcccuccgccaaggccucgauccugcacgagguccggcccgugaccuccggcugcuuccccaucaugcacgaccgcaccaagauccggcagcugcccaaccuccugcgcggguacgagaagauccggcugagcacccagaaugugaucaacgcggagaaggccccgggcgggcccuaccgccucggcacguccgggagcugccccaacgccaccuccaagucgggcuucuucgccaccauggcgugggccgucccccgggauaacaacaagaccgccacgaacccgcugaccguggaggugcccuacaucugcaccaaggaggaggaccagaucaccgucuggggcuuccacuccgacaauaagacgcagaugaagaaccuguacggggacagcgacccccagaaguucaccuccagcgccaacggcgugaccacccauuacgugucccagaucgggggcuuccccgaccagacggaggacggcgggcucccgcagucgggccgcaucgucguggacuacauggugcagaagcccgggaagaccggcaccaucgucuaccagcgggggauccugcugccccagaagguguggugcgccuccggccgcaguaaggugaucaagggcagccucccccugaucggggaggcggacugccugcacgagaaguacggcgggcucaacaaguccaagccguacuacaccggcgagcaugccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccagucacggggcccacggcguggccgucgcggccgaccucaaguccacccaggaggccaucaacaagaucacgaagaaccugaacagccuguccgagcucgaggugaagaaccugcagcggcugaguggggccauggacgagcuccacaacgagauccuggagcuggacgagaagguggacgaccuccgcgccgacaccaucuccucgcagaucgagcuggcgguccugcucuccaacgagggcaucaucaauagcgaggacgagcaccuccuggcccuggagcggaagcugaagaagaugcugggccccuccgccguggacaucgggaacggcugcuucgagaccaagcacaaguguaaccagaccugccucgaccgcaucgccgcggggaccuucaacgccggcgaguucagccugcccacguucgacucccugaauaucaccgccgccucgcucaacgacgacgggcuggacaaccacaccauccugcuguacuauuccaccgccgcgagcucccucgccgugacgcugaugaucgccaucuucaucgucuacaugaucagccgggacaacguguccugcagcaucugccuguga

SEQ ID NO: 14187 - RNA, 1752 nt, Artificial Sequence
  derived and/or modified CDS sequence (AUadapt) from InfluenzaB__ABL76991__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaagucccauuucgccaaccugaaggggacgaagacccggggcaagcucugccccaacugccugaacugcaccgaccuggauguggcccucgggcgccccaugugcaucggcaucaccccguccgccaaggccagcauccugcacgaggugcggcccgucacguccggcugcuuccccaucaugcacgaccgcaccaagauccggcagcugcccaaccuccugcgcggguaugagcacauccggcugagcacccacaacgugaucaacgcggagcgcgccccgggcgggcccuaccggcucggcaccuccgggucgugccccaaugugacgucccgcagcggcuucuucgccaccauggccugggcggucccccgggacaacaagaccgccaccaacccgcugacgguggaggugcccuacaucugcaccaagggcgaggaucagaucaccgucuggggguuccacuccgacaacaagauccagaugaagaaccuguacggcgacagcaauccccagaaguucaccuccagcgccaacgggaucacgacccacuacgugucccagaucggcggcuuccccaaccagaccgaggacgggggccucccgcagagugggcgcaucguggucgacuacauggugcagaagcccggcaagaccgggacgaucguguaccagcggggcguccugcugccccagaagguguggugcgccuccggccgcagcaaggugaucaaggggucgcucccccugaucggcgaggccgacugccugcaugagaaguacgggggccucaacaaguccaagccguacuacaccggggagcacgcgaaggccaucggcaacugccccaucugggucaagacgccccugaagcuggccaacggcaccaaguaucggcccccggccaagcuccugaaggagaagggguucuucggcgccaucgcgggguuccuggagggcgggugggagggcaugaucgccggcuggcacggguacaccagccacggcgcccacgggguggccgucgccgcggaucucaaguccacccaggaggccaucaacaagaucaccaagaaccugaacagccuguccgagcucgaggugaagaaccugcagcgccugagcggcgccauggacgagcuccacaaugagauccuggagcuggacgagaagguggacgaccuccgggccgacaccaucuccagccagaucgagcuggccguccugcucuccaacgagggcaucaucaacucggaggaugagcaccuccuggcgcuggagcgcaagcugaagaagaugcuggggcccuccgccguggacaucggcaacgggugcuucgagacgaagcacaagugcaaccagaccugucucgaccggaucgccgccggcaccuucaacgcgggggaguucagccugcccaccuucgacucccugaacaucaccgccgccagucucaacgacgacggccuggacaaccacacgauccugcuguacuacuccaccgccgccaguucccucgcggugacccugaugaucgccaucuucaucgucuacauggugagccgcgacaacguguccugcagcaucugccuguga

SEQ ID NO: 14188 - RNA, 1755 nt, Artificial Sequence
  derived and/or modified CDS sequence (AUadapt) from InfluenzaB__ABL77002__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaagucccacuucgccaaccugaaggggacgaagacccggggcaagcucugcccgaccugccugaacuguaccgaccuggacguggcccucgggcgccccaugugcgugggcgucacgcccuccgccaaggccagcauccugcacgaggugcggcccgugaccuccggcugcuuccccaucaugcaugaccgcaccaagauccggcagcugcccaaccuccugcgcggguacgagaagauccggcugucgacccagaacgucaucaacgcggagaaggccccgggcgggcccuaccgccucggcacguccgggaguugccccaacgccaccucccggagcggcuucuucgccaccauggcgugggccgugccccgcgacaacaauaagaccgccacgaacccgcugaccaucgaggugccccacaucugcaccaaggaggaggaccagaucaccaucuggggcuuccacuccgacgauaagacgcagaugaagaaccuguacggggacagcaacccccagaaguucaccuccucggccaauggcgucaccacccacuacgugucccagaucgggggcuuccccgaccagacggaggacggcgggcucccgcagagcggccggaucguggucgacuauauggugcagaagcccgggaagaccggcaccaucguguaccagcgcgggauccugcugccccagaaggucuggugcgccuccggccggagcaaggugaucaagggcagccucccccugaucggggaggcggacugccugcacgagaaguauggcgggcucaacaaguccaagccguacuacaccggcgagcacgccaaggccaucgggaacugccccaucugggugaagacgccccugaagcuggccaauggcaccaaguaccggcccccggccaagcuccugaaggagcgcggcuucuucggggcgaucgccggcuuccuggagggcgggugggaggggaugaucgccggcuggcacggcuacaccagccauggggcccacggcgucgccguggcggccgaccucaaguccacccaggaggccaucaacaagaucacgaagaaccugaacucgcuguccgagcucgaggucaagaaccugcagcgccugaguggggccauggacgagcuccacaacgagauccuggagcuggacgagaagguggacgaccuccgggccgacaccaucuccagucagaucgagcuggcggugcugcucuccaacgagggcaucaucaacagcgaggacgagcaccuccuggcccuggagcgcaagcugaagaagaugcugggccccuccgccgucgacaucgggaacggcuguuucgagaccaagcacaagugcaaccagaccugccucgaccggaucgccgcggggaccuucgaugccggcgaguucucgcugcccacguucgacucccugaacaucaccgccgccagccucaacgaugacgggcuggacaaccacaccauccugcuguacuacuccaccgccgcgagcucccucgccgugacgcugaugaucgccaucuuuaucguguacaugaucagccgcgacaacgucuccugcagcaucugccuguga

SEQ ID NO: 14189 - RNA, 1755 nt, Artificial Sequence
  derived and/or modified CDS sequence (AUadapt) from InfluenzaB__ABL77013__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaaguccuacuucgccaaucugaaggggacgaagacccggggcaagcucugcccgaccugccugaacugcaccgaccuggacguggcccucgggcgccccaugugcgugggcaucacgcccuccgccaaggccagcauccugcacgagguccggcccgugaccuccggcugcuuucccaucaugcacgaccgcaccaagauccggcagcugcccaaccuccugcgcggguacgagaagauccggcugagcacccagaacgugaucaacgcggagaaggccccgggcgggcccuaccgccucggcacguccgggucgugccccaaugccaccuccaagagcggcuucuucgccaccauggcgugggccgucccccgggacaacaacaagaccgccacgaacccgcugaccguggaggugcccuacaucugcaccaaggaggaggaccagaucaccgucuggggcuuucacuccgacaacaagaaccagaugaagaaccuguacggggacagcgacccccagaaguucacguccagugccaacggcgugaccacccacuacgugucccagaucgggggcuuccccgaccagaccgaggacggcgggcucccgcagagcggccgcaucgucguggacuacauggugcagaagcccgggaagacgggcaccaucgucuaccagcgggggauccugcugccccagaagguguggugugccuccggccgcagcaaggugaucaagggcucgcucccccugaucggggaggcggacugccugcacgagaaguacggcgggcucaacaaguccaagccguacuacaccggcgagcacgccaaggccaucgggaauugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccagccacggggcccauggcguggccgucgcggccgaccucaaguccacccaggaggccaucaacaagaucaccaagaaccugaacucgcuguccgagcucgaggugaagaaccugcagcggcugagcggggccauggacgagcuccacaacgagauccuggagcuggaugagaagguggacgaccuccgcgccgacacgaucuccagccagaucgagcuggcgguccugcucuccaacgagggcaucaucaacucggaggacgagcaccuccuggcccuggagcggaagcugaagaagaugcugggccccuccgccguggacaucgggaauggcugcuucgagaccaagcacaagugcaaccagaccugccucgaccgcaucgccgcggggaccuucaacgccggcgaguucagucugcccaccuucgacucccugaacaucacggccgccagccucaacgacgacgggcuggacaaccacaccauccugcuguauuacuccaccgccgcgucgucccucgccgugacccugaugaucgccaucuucaucgucuacaugaucagccgggacaacguguccugcagcaucugccuguga

SEQ ID NO: 14190 - RNA, 1755 nt, Artificial Sequence
  derived and/or modified CDS sequence (AUadapt) from InfluenzaB__ABL77024__HA
augaaggccaucaucgugcugcucauggucgugaccaguaacgccgaccgcaucugcaccggcaucacguccagcaacucgccccacguggucaagaccgcgacccagggggaggugaaugugaccggcgccaucccgcugacgaccacccccaccaagucccacuucgccaaccugaaggggacgaagacccggggcaagcucugcccgaccugccugaacugcaccgaccuggaugucgcccucgggcgccccaugugcgugggcaucacgcccuccgccaaggcgagcauccugcacgaggugcggcccgucaccuccggcugcuuccccaucaugcacgaccgcaccaagauccggcagcugcccaaccuccugcgcggguaugagaagauccggcugagcacccagaacgugaucaacgccgagaaggccccgggcgggcccuaccgccucggcacguccgggucgugccccaacgccaccuccaagagcggcuuuuucgcgaccauggccugggccgugccccgggacaacaacaagaccgccacgaacccgcugaccgucgaggugccccacaucugcaccaaggaggaggaccagaucaccguguggggcuuucacuccgacgacaagacgcagaugaagaaccuguacggggacagcaacccccagaaguuuaccuccucggccaacggcaucaccacccacuacgucucccagaucgggggcuuccccgaccagacggaggacggcgggcucccgcagagcggccgcaucgugguggauuacaugguccagaagcccgggaagaccggcaccaucguguaccagcgggggauccugcugccccagaagguguggugcgcguccggccgcagcaaggucaucaagggcucgcucccccugaucggggaggccgacugccugcacgagaaguauggcgggcucaacaaguccaagccguacuacaccggcgagcacgccaaggccaucgggaacugccccaucugggugaagacgccccugaagcuggccaacggcaccaaguaucggcccccggcgaagcuccugaaggagcgcggcuucuucggggccaucgccggcuuccuggagggcgggugggaggggaugaucgccggcuggcacggcuacaccagccacggggcccacggcguggcggucgccgccgaucucaaguccacccaggaggccaucaacaagaucacgaagaaccugaacucgcuguccgagcucgaggugaagaaccugcagcggcugagcggggccauggacgagcuccacaaugagauccuggagcuggacgagaaggucgacgaccuccgcgcggacaccaucuccagccagaucgagcuggccgugcugcucuccaacgagggcaucaucaacucggaggaugagcaccuccuggcccuggagcggaagcugaagaagaugcugggccccuccgccguggacaucgggaacggcugcuucgagaccaagcacaagugcaaccagaccugucucgaccgcaucgcggccgggaccuucaacgccggcgaguucagccugcccacguucgacucccugaacaucaccgccgccagucucaacgacgacgggcuggacaaccacaccauccugcuguacuacuccaccgcggccaguucccucgccgucacgcugaugaucgccaucuucaucguguacaugaucagccgggacaacguguccugcagcaucugccuguga

SEQ ID NO: 14191 - RNA, 1755 nt, Artificial Sequence
  derived and/or modified CDS sequence (AUadapt) from InfluenzaB__ABL77035__HA
augaaggccaucaucgugcugcucauggucgugaccaguaacgccgaccgcaucugcaccggcaucacguccagcaacagcccccauguggucaagaccgcgacccagggggaggugaacgugaccggcgccaucccgcugacgaccacccccaccaagucccacuucgccaaccugaaggggacgaagacccggggcaagcucugcccgaccugccugaauugcaccgaccuggacgucgcccucgggcgccccaugugcgugggcaucacgcccuccgccaaggcgagcauccugcacgaggugcggcccgucaccuccggcugcuuucccaucaugcacgaccgcaccaagauccggcagcugcccaaccuccugcgcggguacgagaagauccggcugucgacccagaacgugaucaaugccgagaaggccccgggcgggcccuaccgccucggcacguccgggagcugccccaacgccaccucccggagcggcuucuucgcgaccauggccugggccgugccccgcgauaacaacaagaccgccacgaacccgcugaccgucgaggugccccacaucugcaccaaggaggaggaccagaucaccguguggggcuuucacuccgacgacaagacgcagaugaagaaccuguacggggacagcaauccccagaaguucaccuccucggccaacggcgucaccacccacuacgugucccagaucgggggcuuccccgaucagacggaggacggcgggcucccgcagagcggccggaucguggucgacuacauggugcagaagcccgggaagaccggcaccaucguguaccagcgcgggauccugcugccccagaaggucuggugcgcguccggccggagcaaggugaucaagggcagucucccccugaucggggaggccgacugccugcacgagaaguacggcgggcucaacaaguccaagccguacuauaccggcgagcacgccaaggccaucgggaacugccccaucugggugaagacgccccugaagcuggccaacggcaccaaguaccggcccccggcgaagcuccugaaggagcgcggcuucuucggggccaucgccggcuuucuggagggcgggugggaggggaugaucgccggcuggcacggcuacaccagccacggggcccacggcgucgcgguggccgccgaccucaaguccacccaggaggccaucaauaagaucacgaagaaccugaacucgcuguccgagcucgaggucaagaaccugcagcgccugagcggggccauggacgagcuccacaaugagauccuggagcuggacgagaagguggacgaccuccgggcggacaccaucuccagccagaucgagcuggccgugcugcucuccaacgagggcaucaucaauagcgaggacgagcaccuccuggcccuggagcgcaagcugaagaagaugcugggccccuccgccgucgacaucgggaacggcugcuucgagaccaagcauaagugcaaccagaccugccucgaccggaucgcggccgggaccuucaacgccggcgaguuuucgcugcccacguucgacucccugaacaucaccgccgccagccucaacgacgaugggcuggacaaccacaccauccugcuguacuacuccaccgcggccagcucccucgccgugacgcugaugaucgccaucuuuaucguguacaugaucagccgcgacaacgucuccugcagcaucugccuguga

SEQ ID NO: 14192 - RNA, 1755 nt, Artificial Sequence
  derived and/or modified CDS sequence (AUadapt) from InfluenzaB__ABL77046__HA
augaaggccaucaucgugcugcucauggucgugaccaguaacgccgaccgcaucugcaccggcaucacguccagcaacucgccccacguggucaagaccgcgacccagggggaggugaacgugaccggcgccaucccgcugacgaccacccccaccaagucccauuucgccaaccugaaggggacgaagacccggggcaagcucugcccgaccugccugaacugcaccgaccuggacgucgcccucgggcgccccaugugugugggcaucacgcccuccgccaaggcgagcauccugcacgaggugcggcccgucaccuccggcugcuuccccaucaugcacgaccgcaccaagauccggcagcugcccaaccuccugcgcggguacgagaagauccggcugucgacccagaaugugaucaacgccgagaaggccccgggcgggcccuaccgccucggcacguccgggagcugccccaacgccaccuccaagagcggcuucuucgcgaccauggccugggccgugccccgggauaacaacaagaccgccacgaacccgcugaccgucgaggugccccacaucugcaccaaggaggaggaccagaucaccguguggggcuuccacuccgacgauaagacgcagaugaagaaccuguacggggacucgaacccccagaaguucaccuccagcgccaacggcaucaccacccauuacgucucccagaucgggggcuuccccgaccagacggaggacggcgggcucccgcagucgggccgcaucgugguggacuacaugguccagaagcccgggaagaccggcaccaucguguaccagcgggggauccugcugccccagaagguguggugcgcguccggccgcaguaaggucaucaagggcagccucccccugaucggggaggccgacugccugcacgagaaguacggcgggcucaacaaguccaagccguacuacaccggcgagcaugccaaggccaucgggaacugccccaucugggugaagacgccccugaagcuggccaacggcaccaaguaccggcccccggcgaagcuccugaaggagcgcggcuucuucggggccaucgccggcuuccuggagggcgggugggaggggaugaucgccggcuggcacggcuacaccagucacggggcccacggcguggcggucgccgccgaccucaaguccacccaggaggccaucaacaagaucacgaagaaccugaacagccuguccgagcucgaggugaagaaccugcagcggcugaguggggccauggacgagcuccacaacgagauccuggagcuggacgagaaggucgacgaccuccgcgcggacaccaucuccagccagaucgagcuggccgugcugcucuccaacgagggcaucaucaauagcgaggacgagcaccuccuggcccuggagcggaagcugaagaagaugcugggccccuccgccaucgacaucgggaacggcugcuucgagaccaagcacaaguguaaccagaccugccucgaccgcaucgcggccgggaccuucaacgccggcgaguucucgcugcccacguucgacucccugaauaucaccgccgccagccucaacgacgacgggcuggacaaccacaccauccugcuguacuauuccaccgcggccucgucccucgccgugacgcugaugaucgccaucuucaucgucuacaugaucagccgggacaacguguccugcagcaucugccuguga

SEQ ID NO: 14193 - RNA, 1755 nt, Artificial Sequence
  derived and/or modified CDS sequence (AUadapt) from InfluenzaB__ABL77057__HA
augaaggccaucaucgugcugcucauggucgugaccaguaaggccgaccgcaucugcaccggcaucacguccagcaacucgccccacguggucaagaccgcgacccagggggaggugaacgugaccggcgccaucccgcugacgaccacccccaccaagucccacuucgccaaucugaaggggacgaagacccggggcaagcucugcccgaccugccugaacugcaccgaccuggacgucgcccucgggcgccccaugugcgugggcaucacgcccuccgccaaggcgagcauccugcacgaggugaagcccgucaccuccggcuguuuccccaucaugcacgaccggaccaagauccgccagcugcccaaccuccugcggggguacgagaagauccgccugucgacccagaacgugaucaacgccgagaaggccccgggcgggcccuaccggcucggcacguccgggaguugccccaacgccaccuccaagucgggcuucuucgcgaccauggccugggccgugccccgcgacaacaacaagaccgccacgaacccgcugaccgucgaggugccccauaucugcaccaaggaggaggaccagaucaccguguggggcuuccacuccgacaacaagccccagaugaagaaccuguacggggacaguaacccccagaaguucacguccucggccaacggcaucaccacccacuacgucucccagaucgggggcuucccggagcagaccgaggacggcgggcucccccagagcggccggaucgugguggauuacaugguccagaagcccgggaagacgggcaccaucguguaccagcgcgggauccugcugccccagaagguguggugcgcguccggccggagcaaggucaucaagggcucgcucccgcugaucggggaggccgacugccugcacgagaaguacggcgggcucaauaaguccaagcccuacuacaccggcgagcacgccaaggccaucgggaacugccccaucugggugaagacgccccugaagcuggccaacggcaccaaguaccgcccgcccgcgaagcuccugaaggagcggggcuucuucggggccaucgccggcuuucuggagggcgggugggaggggaugaucgccggcuggcacggcuacaccagccacggggcccacggcguggcggucgccgccgaccucaaguccacccaggaggccaucaacaagaucaccaagaaccugaacagucuguccgagcucgaggugaagaaccugcagcgccugagcggggccauggacgagcuccacaacgagauccuggagcuggacgagaaggucgacgaccuccgggcggacacgaucuccagucagaucgagcuggccgugcugcucuccaacgagggcaucaucaacagcgaggacgagcaccuccuggcccuggagcgcaagcugaagaagaugcugggccccuccgccguggacaucgggaacggcugcuucgagaccaagcauaagugcaaccagaccugccucgaccggaucgcggccgggaccuucaacgccggcgaguucucgcugcccaccuucgauucccugaacaucacggccgccagccucaacgacgacgggcuggacaaccacaccauccugcuguacuauuccaccgcggccucgucccucgccgucacccugaugaucgccaucuucaucguguacaugaucagccgcgacaacguguccugcagcaucugccuguga

SEQ ID NO: 14194 - RNA, 1758 nt, Artificial Sequence
  derived and/or modified CDS sequence (AUadapt) from InfluenzaB__ABL77068__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagucgcacuucgccaaccugaaggggacgaagacccggggcaagcucugccccaagugccugaacugcaccgaccuggacguggcccucgggcgccccaagugcaccggcaacaucccguccgccaaggugagcauccugcacgagguccggcccgugacguccggcugcuuucccaucaugcacgaccgcaccaagauccggcagcugcccaaccuccugcgcggguacgagcggauccgccugucgaaccacaacgugaucaacgccgagaaggcgccgggcgggcccuacaagaucggcaccuccgggucgugccccaacgucaccaacggcaacggcuucuucgccacgauggccugggccgugcccaagaacgagaacaacaagaccgcgaccaacucccucaccaucgaggugccguacaucugcacggagggggaggaucagaucaccgucuggggcuuccacucggacaacgagaaccagauggccaagcuguacggggacuccaagccccagaaguucaccagcuccgccaacggcgugaccacgcacuacgugucgcagaucggcggguuccccaaccagaccgaggacggcgggcugccccaguccggccggaucgucguggacuacauggugcagaaguccgggaagaccggcaccaucacguaccagcgcggcauccuccugccgcagaaggucuggugcgccuccgggcggucgaaggugaucaagggcucgcugccccucaucggggaggccgauugccugcacgagaaguacggcgggcugaacaaguccaagcccuacuacaccggcgagcacgcgaaggccaucggcaacugccccaucugggugaagaccccgcucaagcuggccaacgggaccaaguaccgcccgcccgccaagcugcucaaggagcggggcuucuucggggccaucgcgggcuuccuggagggcgggugggagggcaugaucgccggguggcacggcuacacgucgcacggggcccacggcgucgccguggccgcggaccugaaguccacccaggaggccaucaacaagaucaccaagaaccucaacagucuguccgagcuggaggucaagaaccuccagcgccugucgggcgccauggacgagcugcacaacgagauccucgagcuggacgagaagguggacgaccugcgggccgacaccaucuccucgcagaucgagcucgccgugcugcuguccaacgaggggaucaucaacucggaggacgagcaccuccuggcgcuggagcgcaagcucaagaagaugcugggccccuccgccgucgagaucgggaacggcugcuucgagacgaagcacaagugcaaccagaccugccuggaccggaucgccgccgggaccuuuaacgcgggcgaguucagccuccccaccuucgacucccugaacaucaccgccgccucgcugaacgacgacggccucgacaaccacacgauccugcuguacuacuccaccgccgccucgucccuggcggugacccucaugaucgccaucuucguggucuacauggugucgcgcgacaacguguccugcagcaucugccuguga

SEQ ID NO: 14195 - RNA, 1758 nt, Artificial Sequence
  derived and/or modified CDS sequence (AUadapt) from InfluenzaB__ABL77090__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccugaccaagucgcacuucgccaaccucaaggggacgaagacccggggcaagcugugccccaagugccugaacugcaccgaccucgacguggcccuggggcgccccaagugcaccggcaacauccccuccgccaaggugagcauccugcacgagguccggccggugacguccggcugcuuccccaucaugcacgaccgcaccaagauccggcagcuccccaaccugcugcgcggguacgagcggauccgccucucgaaccacaacgugaucaacgccgagaaggcgcccggcgggccguacaagaucggcaccuccgggucgugccccaacgucaccaacggcaacggcuucuucgccacgauggccugggccgugcccaagaacgagaacaacaagaccgcgaccaacucccugaccaucgaggugcccuacaucugcacggagggggaggaccagaucaccgucuggggcuuccacucggacaacgagauccagauggugaagcuguacggggacuccaagccgcagaaguucaccagcuccgccaacggcgugaccacgcacuacgucucgcagaucggcggguuccccaaccagaucgaggacggcgggcucccccaguccggccggaucgugguggacuacaugguccagaaguccgggaagaccggcaccaucaccuaccagcgcggcauccugcugccccagaagguguggugcgccuccgggcggucgaagaucaucaagggcucgcucccgcugaucggggaggccgacugucugcacgagaaguacggcgggcucaacaaguccaagcccuacuacacgggcgagcacgccaaggcgaucggcaacugccccaucugggugaagacgccccugaagcuggccaacgggaccaaguaccgcccgcccgccaagcuccugaaggagcggggcuucuucggggccaucgccggcuuccuggagggcgggugggagggcaugaucgcgggguggcacggcuacaccucgcacggggcccacggcgucgccguggccgccgaccucaaguccacccaggaggcgaucaacaagaucaccaagaaccugaacagccuguccgagcucgaggucaagaaccugcagcgccugucgggcgccauggacgagcuccacaacgagauccuggagcuggacgagaagguggacgaccuccgggccgacaccaucuccucgcagaucgagcuggccgugcugcucuccaacgaggggaucaucaacucggaggacgagcaccuccuggcccuggagcgcaagcugaagaagaugcugggccccuccgcggucgagaucgggaacggcugcuucgagaccaagcacaagugcaaccagacgugccucgaccggaucgccgccgggaccuucaacgccggcgaguucagccugcccaccuucgacucccugaacaucaccgcggccucgcucaacgacgacggccuggacaaccacaccauccugcuguacuacuccacggccgccucgucccucgccgugacccugaugaucgcgaucuucguggucuacauggugucgcgcgacaacguguccugcagcaucugccuguga

SEQ ID NO: 14196 - RNA, 1755 nt, Artificial Sequence
  derived and/or modified CDS sequence (AUadapt) from InfluenzaB__ABL77101__HA
augaaggccaucaucgugcugcucauggucgugaccaguaaggccgaccgcaucugcaccggcaucacguccagcaacucgccccacguggucaagaccgcgacccagggggaggugaacgugaccggcgccaucccgcugacgaccacccccaccaagucccacuucgccaaucugaaggggacgaagacccggggcaagcucugcccgaccugccugaacugcaccgaccuggacgucgcccucgggcgccccaugugcgugggcaucacgcccuccgccaaggcgagcauccugcacgaggugaagcccgucaccuccggcuguuuccccaucaugcacgaccggaccaagauccgccagcugcccaaccuccugcggggguacgagaagauccgccugucgacccagaacgugaucaacgccgagaaggccccgggcgggcccuaccggcucggcacguccgggaguugccccaacgccaccuccaagucgggcuucuucgcgaccauggccugggccgugccccgcgacaacaacaagaccgccacgaacccgcugaccgucgaggugccccauaucugcaccaaggaggaggaccagaucaccguguggggcuuccacuccgacgacaagacgcagaugaagaaccuguacggggacaguaacccccagaaguucaccuccucggccaacggcaucaccacccacuacgucucccagaucgggggcuuccccgagcagacggaggacggcgggcucccgcagagcggccggaucgugguggauuacaugguccagaagcccgggaagaccggcaccaucguguaccagcgcgggauccugcugccccagaagguguggugcgcguccggccggagcaaggucaucaagggcucgcucccccugaucggggaggccgacugccugcacgagaaguacggcgggcucaauaaguccaagccguacuacaccggcgagcacgccaaggccaucgggaacugccccaucugggugaagacgccccugaagcuggccaacggcaccaaguaccggcccccggcgaagcuccugaaggagcgcggcuucuucggggccaucgccggcuuucuggagggcgggugggaggggaugaucgccggcuggcacggcuacaccagccacggggcccacggcguggcggucgccgccgaccucaaguccacccaggaggccaucaacaagaucacgaagaaccugaacagucuguccgagcucgaggugaagaaccugcagcgccugagcggggccauggacgagcuccacaacgagauccuggagcuggacgagaaggucgacgaccuccgggcggacaccaucuccagucagaucgagcuggccgugcugcucuccaacgagggcaucaucaacagcgaggacgagcaccuccuggcccuggagcgcaagcugaagaagaugcugggccccuccgccguggacaucgggaacggcugcuucgagaccaagcauaagugcaaccagaccugccucgaccggaucgcggccgggaccuucaacgccggcgaguucucgcugcccacguucgauucccugaacaucaccgccgccagccucaacgacgacgggcuggacaaccacaccauccugcuguacuauuccaccgcggccucgucccucgccgucacgcugaugaucgccaucuucaucguguacaugaucagccgcgacaacguguccugcagcaucugccuguga

SEQ ID NO: 14197 - RNA, 1758 nt, Artificial Sequence
  derived and/or modified CDS sequence (AUadapt) from InfluenzaB__ABL77134__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacgaagacccggggcaagcucugccccaagugccugaauugcaccgaccuggacguggcccucgggcgccccaagugcaccggcaacaucccguccgccaaggugucgauccugcacgagguccggcccgugacguccggcugcuuccccaucaugcacgaccgcaccaagauccggcagcugcccaaccuccugcgcggguacgagcggauccgccugagcaaccauaacgugaucaacgccgagaaggcgccgggcgggcccuacaagaucggcaccuccgggucgugccccaacgucaccaacggcaacggcuucuucgccacgauggccugggccgugcccaagaacgagaacaacaagaccgcgaccaacucccucaccaucgaggugccguacaucuguacggagggggaggaccagaucaccgucuggggcuuccacucggacaacgaggcccagauggccaagcuguacggggacuccaagccccagaaguucaccagcuccgccaacggcgugaccacgcacuacgugucgcagaucggcggguuccccaaucagaccgaggacggcgggcugccccaguccggccggaucgucguggacuacauggugcagaaguccgggaagaccggcaccaucacguaccagcgcggcauccuccugccgcagaaggucuggugcgccuccgggcggucgaaggugaucaagggcagccugccccucaucggggaggcggacugccugcacgagaaguacggcgggcugaacaaguccaagcccuacuacaccggcgagcacgccaaggccaucggcaauugccccaucugggugaagaccccgcucaagcuggccaacgggaccaaguaccgcccgcccgccaagcugcucaaggagcggggcuucuucggggcgaucgccggcuuccuggagggcgggugggagggcaugaucgccggguggcacggcuacacgucgcacggggcccacggcgucgccguggcggccgaccugaaguccacccaggaggccaucaacaagaucaccaagaaccucaacagucuguccgagcuggaggucaagaaccuccagcgccugagcggcgccauggacgagcugcacaacgagauccucgagcuggacgagaagguggacgaccugcgggccgacaccaucuccucgcagaucgagcucgcggugcugcuguccaacgaggggaucaucaacucggaggacgagcaccuccuggcccuggagcgcaagcucaagaagaugcugggccccuccgccgucgagaucgggaauggcugcuucgagacgaagcacaagugcaaccagaccugccuggaccggaucgccgcggggaccuucaacgccggcgaguucagccuccccaccuucgacucccugaacaucaccgccgccucgcugaaugacgacggccucgacaaccacacgauccugcuguacuacgccaccgcggccuccucgcuggccgugacccucaugaucgccaucuucguggucuacauggugucccgcgacaacgugagcugcuccaucugccuguga

SEQ ID NO: 14198 - RNA, 1758 nt, Artificial Sequence
  derived and/or modified CDS sequence (AUadapt) from InfluenzaB__ABL77145__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacgaagacccggggcaagcucugccccaagugccugaacuguaccgaccuggacguggcccucgggcgccccaagugcaccggcaacaucccguccgccaaggugucgauccugcacgagguccggcccgugacguccggcugcuuccccaucaugcacgaccgcaccaagauccggcagcugcccaaccuccugcgcggguacgagcggauccgccugagcaaccacaaugugaucaacgccgaggaggcgccgggcgggcccuacaagaucggcaccuccgggucgugccccaacgucaccaacggcaacggcuucuucgccacgauggccugggccgugcccaagaacgagaacaacaagaccgcgaccaacucccucaccaucgaggugccguacaucugcacggagggggaggaucagaucaccgucuggggcuuccacagcgacuccgagacccagauggccaagcuguacggggacucgaagccccagaaguucaccuccucggccaacggcgugacgacccacuacgugucccagaucggcggguuccccaaccagaccgaggacggcgggcugccccagaguggccggaucgucguggacuacauggugcagaaguccgggaagaccggcacgaucaccuaccagcgcggcauccuccugccgcagaaggucuggugcgccucggggcggagcaaggugaucaagggcucccugccccucaucggggaggccgacugccugcacgagaaguacggcgggcugaacaagucgaagcccuacuacaccggcgagcacgcgaaggccaucggcaauugccccaucugggugaagaccccgcucaagcuggccaacgggacgaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucaccaagaaccucaacucccugucggagcuggaggucaagaaucuccagcgccuguccggcgccauggacgagcugcacaacgagauccucgagcuggacgagaagguggacgaccugcgggccgacacgaucagcucccagaucgagcucgccgugcugcugucgaacgaggggaucaucaacuccgaggacgagcaccuccuggcgcuggagcgcaagcucaagaagaugcugggccccagcgccgucgagaucgggaacggcuguuucgagaccaagcacaagugcaaccagaccugccuggaccggaucgccgccgggaccuucaacgcgggcgaguucucccuccccaccuucgacucgcugaacaucacggccgccucccugaacgacgauggccucgacaaccacaccauccugcuguacuacucgaccgccgccuccagccuggcggugacccucaugaucgccaucuucguggucuacauggugucccgcgacaacgugucgugcagcaucugccuguga

SEQ ID NO: 14199 - RNA, 1755 nt, Artificial Sequence
  derived and/or modified CDS sequence (AUadapt) from InfluenzaB__ABL77156__HA
augaaggccaucaucgugcugcucauggucgugaccaguaacgccgaccgcaucugcaccggcaucacguccagcaacaguccccacguggucaagaccgcgacccagggggaggugaacgugaccggcgucaucccgcugacgaccacccccaccaaguccuacuucgccaaccugaaggggacgcggacccgcggcaagcucugccccgauugccugaacugcaccgaccuggacguggcccucgggcggcccaugugcgugggcaccacgccguccgccaaggccaguauccugcacgagguccgccccgugaccuccggcugcuuccccaucaugcacgaccggaccaagauccgccagcugcccaaccuccugcggggguaugagaacauccgccugagcacccagaacgugaucgacgcggagaaggccccgggcgggcccuaccggcucggcacguccgggagcugucccaacgccaccuccaagagcggcuucuucgccaccauggcgugggccguccccaaggacaacaauaagaacgccaccaacccgcugacgguggaggugcccuacgucugcaccgagggcgaggaccagaucaccguguggggguuccauuccgacgacaagacccagaugaagaaccuguacggcgacagcaauccccagaaguucacguccagcgccaacggggugaccacccacuacgucucccagaucggcggcuuccccgaucagaccgaggacgggggccucccgcagagcgggcgcaucgugguggacuacaugguccagaagcccggcaagacggggaccaucguguaccagcggggcgugcugcugccccagaaggucuggugcgccuccggccgcaguaaggugaucaaggggagccucccccugaucggcgaggcggacugccugcacgagaaguacgggggccucaauaaguccaagccguacuacaccggggagcacgccaaggccaucggcaacugccccaucugggucaagacgccccugaagcuggccaacggcaccaaguaucggcccccggccaagcuccugaaggagcgcggguucuucggcgcgaucgccggguuccuggagggcgggugggagggcaugaucgccggcuggcacggguacaccagccauggcgcccacgggguggccguggcggccgaccucaaguccacccaggaggccaucaacaagaucaccaagaaccugaacagccuguccgagcucgaggucaagaaucugcagcggcugagcggcgccauggacgagcuccacaacgagauccuggagcuggacgagaagguggacgaucuccgcgccgacacgaucuccagccagaucgagcuggcggugcugcucuccaacgagggcaucaucaacagcgaggacgagcaucuccuggcccuggagcggaagcugaagaagaugcuggggcccuccgccgucgacaucggcaacgggugcuucgagaccaagcacaagugcaaucagaccugccucgaccgcaucgccgcgggcaccuucaacgccggggaguucagccugcccaccuuugacucccugaacaucacggccgccagccucaacgacgacggccuggauaaccacaccauccugcuguacuacuccaccgccgcgagcucccucgccgugacccugaugcuggccaucuucaucguguauauggucagccgggacaacguguccugcagcaucugccucuga

SEQ ID NO: 14200 - RNA, 1758 nt, Artificial Sequence
  derived and/or modified CDS sequence (AUadapt) from InfluenzaB__ABL77178__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacgaagacccggggcaagcucugccccaagugccugaacugcaccgaccuggauguggcccucgggcgccccaagugcaccggcaacaucccguccgccaaggugucgauccugcacgagguccggcccgugacguccggcugcuuccccaucaugcacgaccgcaccaagauccggcagcugcccaaccuccugcgcggguacgagcggauccgccugagcaaccacaacgugaucaacgccgagaaggcgccgggcgggcccuacaagaucggcaccuccgggucgugucccaacgucaccaacggcaacggcuucuucgccacgauggccugggccgugcccaagaacgagaacaacaagaccgcgaccaacucccucaccaucgaggugccguacaucugcacggagggggaggaccagaucaccgucuggggcuuccacucggacuccgagacccagauggccaagcuguacggggauagcaagccccagaaguucaccuccucggccaacggcgugacgacccacuacgugucccagaucggcggguuccccaaccagaccgaggacggcgggcugccccagucgggccggaucgucguggacuacauggugcagaaguccgggaagaccggcacgaucaccuaccagcgcggcauccuccugccgcagaaggucuggugcgccagcgggcggucgaaggugaucaagggcucccugccccucaucggggaggccgacugucugcacgagaaguacggcgggcugaacaagucgaagcccuacuacaccggcgagcacgcgaaggccaucggcaacugccccaucugggugaagaccccgcucaagcuggccaacgggacgaaguaccgcccgcccgccaagcugcucaaggagcggggcuucuucggggccaucgcgggcuuccuggagggcgggugggagggcaugaucgccggguggcacggcuacaccucccacggggcccauggcgucgccguggccgcggaccugaaguccacccaggaggccaucaacaagaucaccaagaaccucaacucccugagcgagcuggaggucaagaaccuccagcgccuguccggcgccauggacgagcugcacaacgagauccucgagcuggacgagaagguggacgaccugcgggccgacacgaucucgucccagaucgagcucgccgugcugcugucgaacgaggggaucaucaacuccgaggaugagcaccuccuggcgcuggagcgcaagcucaagaagaugcugggccccagcgccgucgagaucgggaacggcugcuucgagaccaagcacaagugcaaccagaccugccuggaccggaucgccgccgggaccuucaacgcgggcgaguucucccuccccaccuucgacucgcugaacaucacggccgccucccugaaugacgacggccucgacaaccacaccauccugcuguacuacucgaccgccgccuccagccuggcggugacccucaugaucgccaucuucguggucuacauggugucccgcgacaacgugucgugcagcaucugccuguga

SEQ ID NO: 14201 - RNA, 1755 nt, Artificial Sequence
  derived and/or modified CDS sequence (AUadapt) from InfluenzaB__ABL77189__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacugcaccgaucuggacguggcccucgggauccccaugugcgugggcaccacgccguccgccaaggccagcauccugcacgagguccggcccgugaccuccggcugcuuccccaucaugcacgaucgcaccaagauccggcagcugcccaaccuccugcgcggguacgagaacauccggcugagcacccagaacgugaucgacgcggagaaggccccgggcgggcccuaccgccucggcacguccgggagcugucccaacgccaccuccaagagcggcuucuucgccaccauggcgugggccguccccaaggacaacaacaagaaugccaccaacccgcugacgguggaggugcccuacgucugcaccgagggcgaggaccagaucaccguguggggguuccacuccgacaacaagauccagaugaagaaucuguacggcgacucgaacccccagaaguucaccuccagcgccaacggggugacgacccauuacgucucccagaucggcggcuuccccgaccagaccgaggacgggggccucccgcagagcgggcggaucgugguggacuacaugguccagaagcccggcaagaccgggacgaucguguaccagcgcggcgugcugcugccccagaaggucuggugugccuccggccggagcaaggugaucaaggggagccucccccugaucggcgaggcggacugccugcacgagaaguacgggggccucaacaaguccaagccguauuacaccggggagcacgccaaggccaucggcaacugccccaucugggucaagacgccccugaagcuggccaacggcaccaaguaccggcccccggccaagcuccugaaggagcgcggguucuucggcgcgaucgccggguuucuggagggcgggugggagggcaugaucgccggcuggcacggguacaccagccacggcgcccacgggguggccguggcggccgaccucaaguccacccaggaggccaucaacaagaucaccaagaaucugaacagccuguccgagcucgaggucaagaaccugcagcgccugucgggcgccauggacgagcuccacaacgagauccuggagcuggacgagaagguggaugaccuccgggccgacaccaucuccagccagaucgagcuggcggugcugcucuccaacgagggcaucaucaacagcgaggacgagcaucuccuggcccuggagcgcaagcugaagaagaugcuggggcccuccgccgucgacaucggcaacgggugcuucgagacgaagcacaagugcaaccagaccugccucgaucggaucgccgcgggcaccuucaacgccggggaguucagccugcccaccuucgacucccugaacaucaccgccgccagucucaacgacgacggccuggacaaccacacgauccugcuguacuacuccaccgccgcgaguucccucgccgugacccugaugcuggccaucuucaucguguacauggucagccgcgacaacguguccugcagcaucugccucuga

SEQ ID NO: 14202 - RNA, 1758 nt, Artificial Sequence
  derived and/or modified CDS sequence (AUadapt) from InfluenzaB__ABL77200__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacgaagacccggggcaagcucugccccaagugccugaacuguaccgaccuggacguggcccucgggcgccccaagugcaugggcaacaucccguccgccaaggugagcauccugcacgagguccggcccgugaccuccggcugcuuccccaucaugcacgaccgcacgaagauccggcagcugcccaaccuccugcgcggguacgagcacauccggcugucgacccacaaugugaucaacgccgagaaggcgccgggcgggcccuacaagaucggcaccuccgggucgugccccaacgucaccaacggcaacggcuucuucgccacgauggccugggccgugcccaagaacgacaacaacaagaccgcgaccaacucccucaccaucgaggugccguacaucuguacggagggggaggaccagaucaccgucuggggcuuccacagcgacaacgagacccagauggccaagcuguacggggacuccaagccccagaaguucaccucguccgccaacggcgugacgacccacuacgugagccagaucggcggguuccccaaucagaccgaggacggcgggcugccccaguccggccgcaucgucguggacuacauggugcagaaguccgggaaggccggcaccaucacguaccagcggggcauccuccugccgcagaaggucuggugcgccuccgggcgcucgaaggugaucaagggcucgcugccccucaucggggaggcggacugccugcacgagaaguacggcgggcugaacaaguccaagcccuacuacaccggcgagcacgccaaggccaucggcaauugccccaucugggugaagaccccgcucaagcuggccaacgggaccaaguaccggccgcccgccaagcugcucaaggagcgcggcuucuucggggcgaucgccggcuuccuggagggcgggugggagggcaugaucgccggguggcacggcuacacgagccacggggcccacggcgucgccguggcggccgaccugaaguccacccaggaggccaucaacaagaucaccaagaaccucaacagucuguccgagcuggaggucaagaaccuccagcggcugagcggcgccauggacgagcugcacaacgagauccucgagcuggacgggaagguggacgaccugcgcgccgacaccaucuccucgcagaucgagcucgcggugcugcuguccaacgagggcaucaucaacucggaggacgagcaccuccuggcccuggagcggaagcucaagaagaugcuggggcccuccgccgucgagaucggcaaugggugcuucgagacgaagcacaagugcaaccagaccugccuggaccgcaucgccgcgggcaccuucgacgccggcgaguucagccuccccaccuucgacucccugaacaucaccgccgccucgcugaaugacgacgggcucgacaaccacacgauccugcuguacuacuccaccgccgcgagcucccuggccgugacccucaugaucgccaucuucguggucuacauggugucgcgggacaacguguccugcagcaucugccuguga

SEQ ID NO: 14203 - RNA, 1755 nt, Artificial Sequence
  derived and/or modified CDS sequence (AUadapt) from InfluenzaB__ABL77222__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaaguccuacuucgccaaccugaaggggacgcggacccgcggcaagcucugccccgacugccugaauugcaccgaccuggacguggcccucgggcggcccaugugcgugggcaccacgccguccgccaaggccagcauccugcacgagguccgccccgugaccuccggcuguuuccccaucaugcacgaccggaccaagauccgccagcuggcgaaccuccugcggggguacgagaacauccgccugagcacccagaaugugaucgacgccgagaaggcccccggcgggccguaccggcucggcacguccgggagcugccccaacgccaccuccaagagcggcuucuuugcgaccauggccugggccguccccaaggacaacaacaagaacgccaccaacccccugacgguggaggugccguacaucuguaccgagggcgaggaccagaucaccgucuggggguuccacuccgacucgaagacccagaugaagaaccuguacggcgauuccaacccccagaaguucacgagcuccgccaacggggugaccacccacuacgugagccagaucggcggcuuucccgaccagaccgaggacgggggccucccccaguccgggcgcaucgucguggacuacaugaugcagaagccgggcaagacggggaccaucguguaccagcggggcguccugcugccccagaagguguggugcgcgaguggccgcagcaaggugaucaaggggucccucccccugaucggcgaggccgacugccugcacgagaaguacgggggccucaacaagagcaagcccuauuacaccggggagcacgccaaggccaucggcaacugcccgaucugggucaagacgccccugaagcuggccaacggcaccaaguaccggccgcccgcgaagcuccugaaggagcgcggguuuuucggcgccaucgccggguuccuggagggcgggugggagggcaugaucgccggcuggcacggguacaccucccacggcgcccacgggguggcggucgccgccgaccucaagaguacccaggaggccaucaacaagaucaccaagaaccugaacucccugagcgagcucgaggugaagaaccugcagcggcuguccggcgccauggacgagcuccacaaugagauccuggagcuggacgagaagguggacgaccuccgcgcggacacgaucucgucccagaucgagcuggccguccugcucagcaaugagggcaucaucaacuccgaggacgagcaccuccuggcccuggagcggaagcugaagaagaugcuggggcccagcgccguggacaucggcaacgggugcuuugagaccaagcacaagugcaaccagaccugccucgaccgcaucgcggccggcaccuucaacgccggggaguuuucccugcccaccuucgacagccugaacaucacggccgccucccucaacgacgauggccuggacaaccacaccauccugcuguacuacagcaccgcggccuccagccucgccgugacccugaugcuggccaucuuuaucgucuacauggugucccgggacaacgugagcugcagcaucugccucuga

SEQ ID NO: 14204 - RNA, 1758 nt, Artificial Sequence
  derived and/or modified CDS sequence (AUadapt) from InfluenzaB__ABL77233__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacgaagacccggggcaagcucugccccaagugccugaacuguaccgaccuggacguggcccucgggcgccccaagugcaccggcaacaucccguccgccgaggugucgauccugcacgagguccggcccgugacguccggcugcuuccccaucaugcacgaccgcaccaagauccggcagcugcccaaccuccugcgcggguacgagcacauccggcugagcacccacaaugugaucaacgccgagaaggcgccgggcgggcccuacaagaucggcaccuccgggucgugccccaacgucacgaacggcaacggcuucuucgccaccauggccugggccgugcccaagaacgacaacaacaagaccgcgaccaacucccucacgaucgaggugccguacaucuguaccgagggggaggaccagaucaccaucuggggcuuccacucggacaacgaggcccagauggccaagcuguacggggacuccaagccccagaaguucaccagcuccgccaacggcgucacgacccacuacgugucgcagaucggcggguuccccaaucagaccgaggacggcgggcugccccaguccggccgcaucguggucgacuacauggugcagaagucccggaagaccgggacgaucaccuaccagcgcggcauccuccugccgcagaagguguggugcgccuccggccggagcaaggucaucaaggggucgcugccccucaucggcgaggcggacugccugcacgagaaguacgggggccugaacaaguccaagcccuacuacaccggggagcacgccaaggccaucggcaauugccccaucugggugaagaccccgcucaagcuggccaacggcacgaaguaccgcccgcccgccaagcugcucaaggagcggggguucuucggcgcgaucgccggguuccuggagggcgggugggagggcaugaucgccggcuggcacggguacaccucgcacggcgcccacgggguggccgucgcggccgaccugaaguccacccaggaggccaucaacaagaucaccaagaaccucaacagucuguccgagcuggaggugaagaaccuccagcgccugucgggcgccauggacgagcugcacaacgagauccucgagcuggacgagaaggucgacgaccugcgggccgacacgaucuccucgcagaucgagcucgcggugcugcuguccaacgagggcaucaucaacagcgaggacgagcaccuccuggcccuggagcgcaagcucaagaagaugcuggggcccuccgccguggagaucggcaaugggugcuucgagaccaagcacaagugcaaccagaccugccuggaccggaucgccgcgggcaccuucgacgccggggaguucucgcuccccaccuucgacucccugaacaucacggccgccucgcugaaugacgacggccucgacaaccacaccauccugcuguacuacuccaccgccgcgagcucccuggccgucacccucaugaucgccaucuucgugguguacauggucucgcgcgacaacguguccugcagcaucugccuguga

SEQ ID NO: 14205 - RNA, 1758 nt, Artificial Sequence
  derived and/or modified CDS sequence (AUadapt) from InfluenzaB__ABL77244__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaucuggacguggcccucgggcgccccaagugcaccggcacgaucccguccgccaaggccucgauccugcacgaggugaagcccgucaccuccggcugcuuccccaucaugcacgaccggaccaagauccgccagcugcccaaccuccugcggggguacgagcacauccgccugucgacccacaacgugaucaacgcggagacggccccgggcgggcccuacaaggugggcaccuccgggagcugucccaacgucaccaacggcaacggcuucuucgccaccauggccugggcggugcccaagaacgacaacaacaagacggccaccaacccgcucaccguggagguccccuacaucugcaccgagggggaggaccagaucacgguguggggcuuccacuccgacaacgaggcccagauggugaagcuguauggggacucgaagccccagaaguucaccuccucggccaacggcgucaccacccacuacgugucccagaucggcggguuccccaaccaggccgaggacggcgggcugccgcagucgggccggaucguggucgacuacauggugcagaaguccgggaagacgggcaccaucaccuaccagcgcggcauccuccugccccagaagguguggugcgcgagcgggcgguccaaggucaucaagggcucgcugccccucaucggggaggccgauugccugcacgagaaguacggcgggcugaacaagucgaagcccuacuacaccggcgagcacgccaaggccaucggcaacugcccgaucugggugaagacgccccucaagcuggccaacgggaccaaguaccgcccgcccgcgaagcugcucaaggagaagggcuucuucggggccaucgccggcuuccuggagggcgggugggagggcaugaucgccggguggcacggcuacaccucccauggggcccacggcgucgcgguggccgccgaccugaaguccacccaggaggccaucaacaagaucacgaagaaccucaacucccugagcgagcuggaggugaagaaccuccagcggcuguccggcgccauggacgagcugcacaacaagauccucgagcuggacgagaaggucgacgaccugcgcgcggacaccaucucgucccagaucgagcucgccgugcugcugucgaacgaggggaucaucaauuccgaggacgagcaccuccuggcccuggagcggaagcucaagaagaugcugggccccucggccguggagaucgggaacggcugcuucgagaccaagcacaagugcaaccagaccugccuggaccgcaucgcggccgggaccuucaacgccggcgaguucucccuccccacguucgacagccugaauaucaccgccgccucccugaacgacgacggccucgacaaccacaccauccugcuguacuacucgaccgcggccuccucgcuggccgucacgcucaugaucgccaucuucaucguguacauggugucccgggacaacgucagcugcuccaucugccuguga

SEQ ID NO: 14206 - RNA, 1752 nt, Artificial Sequence; identical to SEQ ID NO: 14137
  derived and/or modified CDS sequence (AUadapt) from InfluenzaB__ABL77255__HA

SEQ ID NO: 14207 - RNA, 1752 nt, Artificial Sequence
  derived and/or modified CDS sequence (AUadapt) from InfluenzaB__ABL77266__HA
augaaggccaucaucgugcugcucauggucgugaccaguaacgccgaccgcaucugcaccggcaucacguccagcaacaguccccacguggucaagaccgcgacccagggggaggugaacgugaccggcgucaucccgcugacgaccacccccaccaagucccacuucgccaaccugaaggggacgaagacccggggcaagcucugccccaauugccugaacugcaccgaccuggacguggcccucgggcgccccaugugugugggcaccacgccguccgccaaggccagcauccugcacgagguccggcccgugaccuccggcugcuuccccaucaugcacgaccgcaccaagauccggcagcugcccaaucuccugcgcggguacgagaacauccggcugagcacccagaacgugaucaacgcggagcgcgccccgggcgggcccuaucggcucggcacguccgggagcugccccaacgucaccucccgcgacggcuucuucgccaccauggccugggcggugccccgggauaacaagaccgccacgaacccgcugaccguggagguccccuacaucugcaccaagggcgaggaccagaucaccguguggggguuucacagcgacuccaagacgcagaugaagaaccuguacggcgacaguaacccccagaaguucaccuccagcgccaacggggugaccacccacuaugucucccagaucggcggcuuccccaaccagacggaggacgggggccucccgcagagcgggcgcaucgugguggacuacaugguccagaagcccggcaagaccgggaccaucguguaucagcggggcgugcugcugccccagaaggucuggugcgccuccggccgcagcaaggugaucaaggggagccucccccugaucggcgaggccgacugccugcaugagaaguacgggggccucaacaaguccaagccguacuacaccggggagcacgcgaaggccaucggcaacugucccaucugggucaagacgccccugaagcuggccaacggcaccaaguaccggcccccggccaagcuccugaaggagcgcggguucuucggcgccaucgcgggguuccuggagggcgggugggagggcaugaucgccggcuggcauggguacaccagccacggcgcccacgggguggccguggccgcggaccucaaguccacccaggaggccaucaacaagaucacgaagaaucugaacagccuguccgagcucgaggucaagaaccugcagcggcugagcggcgccauggacgagcuccauaacgagauccuggagcuggacgagaagguggacgaccuccgcgccgacaccaucuccagccagaucgagcuggccgugcugcucuccaaugagggcaucaucaacagcgaggacgagcaccuccuggcgcuggagcggaagcugaagaagaugcuggggcccuccgccgucgacaucggcaaugggugcuucgagaccaagcacaagugcaaccagaccugccucgaucgcaucgccgccggcaccuucaacgcgggggaguucagccugcccacguucgauucccugaacaucaccgccgccagccucaacgacgacggccuggacaaucacaccauccugcuguacuacuccaccgccgccagcucccucgcggugacgcugaugaucgccaucuucaucguguauauggucagccgggacaacguguccugcagcaucugccuguga

SEQ ID NO: 14208 - RNA, 1752 nt, Artificial Sequence
  derived and/or modified CDS sequence (AUadapt) from InfluenzaB__ABL77277__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaagucccacuucgccaaccugaaggggacgaagacccggggcaagcucugccccaacugccugaacuguaccgaccuggacguggcccucgggcgccccaugugcgugggcaacaccccguccgccaaggccagcauccugcacgagguccggcccgugacguccggcugcuuucccaucaugcacgaccgcaccaagauccggcagcugcccaaccuccugcgcggguacgagaacauccggcugagcacccagaacgugaucaaugcggagcgcgccccgggcgggcccuaccggcucggcaccuccgggucgugccccaacgucacgaaccgcgacggcuucuuugccaccauggccugggcggugccccgggacaacaagaccgccaccaacccgcugacgguggagguccccuacaucugcaccaagggcgaggaccagaucaccguguggggguuccauuccgacaacaagauccagaugaagaaccuguacggcgacagcaacccccagaaguuuaccuccagcgccaacggggugacgacccacuacgucucccagaucggcggcuuccccaaccagaccgaggacgggggccucccgcagagugggcgcaucgugguggacuacaugguccagaagcccggcaagaccgggacgaucguguaccagcggggcgugcugcugccccagaaggucuggugcgccuccggccgcagcaaggugaucaaggggucccucccccugaucggcgaggccgacugccugcaugagaaguacgggggccucaacaagucgaagccguacuacaccggggagcacgcgaaggccaucggcaacugucccaucugggucaagacgccccugaagcuggccaacggcaccaaguaccggcccccggccaagcuccugaaggagcgcggguucuucggcgccaucgcgggguuccuggagggcgggugggagggcaugaucgccggcuggcacggguacaccagucacggcgcccacgggguggccguggccgcggaccucaaguccacccaggaggccaucaacaagaucaccaagaaccugaacagccuguccgagcucgaggucaagaaucugcagcggcugagcggcgccauggacgagcuccacaacgagauccuggagcuggacgagaagguggacgaccuccgcgccgauaccaucuccagccagaucgagcuggccgugcugcucuccaacgagggcaucaucaacucggaggacgagcaccuccuggcgcuggagcggaagcugaagaagaugcuggggcccuccgccgucgacaucggcaaugggugcuucgagacgaagcacaagugcaaccagaccugccucgaccgcaucgccgccggcaccuuuaacgcgggggaguucagccugcccaccuucgacucccugaacaucaccgccgccagccucaaugacgacggccuggacaaccacacgauccugcuguacuacuccaccgccgccaguucccucgcggugacccugaugaucgccaucuucaucguguacauggucagccgggacaacguguccugcagcaucugccuguga

SEQ ID NO: 14209 - RNA, 1752 nt, Artificial Sequence
  derived and/or modified CDS sequence (AUadapt) from InfluenzaB__ABL77288__HA
augaaggccaucaucgugcugcucauggucgugaccaguaacgccgaccgcaucugcaccggcaucacguccagcaacaguccccacguggucaagaccgcgacccagggggaggugaacgugaccggcgucaucccgcugacgaccacccccaccaagucccacuucgccaaccugaaggggacgaagacccggggcaagcucugccccaauugccugaacugcaccgaccuggacguggcccucgggcgccccaugugcgugggcaccacgccguccgccaaggccaguauccugcacgagguccggcccgugaccuccggcugcuuccccaucaugcacgaccgcaccaagauccggcagcugcccaaccuccugcgcggguaugagcacauccggcugagcacccagaacgugaucaacgcggagaaggccccgggcgggcccuacaagcucggcacguccgggaguugccccaacgccaccucccgcagcggcuucuucgccaccauggcgugggccgucccccgggacaauaagaccgccacgaacccgcugaccguggaggugcccuacaucugcaccaagggcgaggaccagaucaccgucuggggguuccacuccgauacgaagacccagaugaagaaccuguacggcgacagcaacccccagaaguucaccuccagugccaacggggugaccacgcacuacgugucccagaucggcggcuuccccgaccagaccgaggaugggggccucccgcagagcgggcgcaucgucguggacuacauggugcagaagcccggcaagaccgggaccaucgucuaccagcggggcgugcugcugccccagaagguguggugcgccuccggccgcagcaaggucaucaaggggagucucccccugaucggcgaggcggacugccugcacgagaaguacgggggccucaacaaguccaagccguacuauacgggggagcacgccaaggccaucggcaacugccccaucugggugaagacgccccugaagcuggccaacggcaccaaguaccggcccccggccaagcuccugaaggagcgcggguucuuuggcgcgaucgccggguuccuggagggcgggugggagggcaugaucgccggcuggcacggguacaccagccacggcgcccauggggucgccguggcggccgaccucaaguccacccaggaggccaucaacaagaucaccaagaaccugaacagccuguccgagcucgaggugaagaaccugcagcggcugaguggcgccauggacgagcuccacaacgagauccuggagcuggacgagaaggucgacgaccuccgcgccgauaccaucuccagccagaucgagcuggcggugcugcucuccaacgagggcaucaucaacagcgaggacgagcaccuccuggcccuggagcggaagcugaagaagaugcuggggcccuccgccguggauaucggcaacgggugcuucgagaccaagcacaagugcaaucagaccugccucgaccgcaucgccgcgggcacguucaacgccggggaguucagccugcccaccuuugacucccugaacaucaccgccgccagccucaacgacgacggccuggauaaccacaccauccugcuguacuacuccacggccgcgagcucccucgccgucacccugaugaucgccaucuucaucguguauauggugagccgggacaacgucuccugcagcaucugccuguga

SEQ ID NO: 14210 - RNA, 1752 nt, Artificial Sequence
  derived and/or modified CDS sequence (AUadapt) from InfluenzaB__ABL77299__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaagucccacuucgccaaccugaaggggacgaagacccggggcaagcucugccccaacugccugaauugcaccgaccuggacguggcccucgggcgccccaugugcaucggcaacaucccguccgccaaggccagcauccugcaugaggugcggcccgucaccuccggcugcuuccccaucaugcacgaccgcacgaagauccggcagcugcccaaccuccugcgcggguacgagcacauccggcugaguacccacaacgugaucaacgcggagcgcgccccgggcgggcccuaccggcucggcaccuccgggagcugccccaacgugaccucccgcaguggcuucuucgccacgauggccugggcggucccccgggacaacaagaccgccaccaacccgcugaccguggaggugcccuacaucuguacgaagggcgaggaccagaucaccgucuggggguuccacuccgacaacgagacccagaugaagaaccuguacggcgauagcaacccccagaaguucaccuccagcgccaacgggaucacgacccacuacgugucccagaucggcggcuuucccaaccagaccgaggacgggggccucccgcagagcgggcgcaucguggucgacuacauggugcagaagcccggcaagaccgggacgaucguguaccagcggggcguccugcugccccagaagguguggugugccuccggccgcagcaaggugaucaaggggucgcucccccugaucggcgaggccgacugccugcacgagaaguacgggggccucaacaaguccaagccguauuacaccggggagcacgcgaaggccaucggcaacugccccaucugggucaagacgccccugaagcuggccaacggcaccaaguaccggcccccggccaagcuccugaaggagcgcggguuuuucggcgccaucgcgggguuccuggagggcgggugggagggcaugaucgccggcuggcacggguacaccagccacggcgcccacgggguggccgucgccgcggaucucaaguccacccaggaggccaucaacaagaucaccaagaaccugaacagccuguccgagcucgaggugaagaaccugcagcggcugagcggcgccauggacgagcuccauaacgagauccuggagcuggacgagaagguggacgaccuccgcgccgacaccaucuccagccagaucgagcuggccguccugcucuccaaugagggcaucaucaacagcgaggacgagcaccuccuggcgcuggagcggaagcugaagaagaugcuggggcccuccgccguggacaucggcaacgggugcuuugagacgaagcacaagugcaaccagaccugccucgaccgcaucgccgccggcaccuucaacgcgggggaguuuagccugcccaccuucgacucccugaacaucaccgccgccagccucaacgaugacggccuggacaaccacacgauccugcuguacuacuccaccgccgccagcucccucgcggugacccugaugaucgccaucuuuaucgucuacauggugagccgggacaacguguccugcagcaucugccuguga

SEQ ID NO: 14211 - RNA, 1752 nt, Artificial Sequence
  derived and/or modified CDS sequence (AUadapt) from InfluenzaB__ABL77310__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaagucccacuucgccaaccugaaggggacgaagacccggggcaagcucugccccaacugccugaacuguaccgaccuggacguggcccucgggcgccccaugugcaucggcaccaucccguccgccaaggccagcauccugcacgaggugcggcccgucacguccggcugcuuccccaucaugcaugaccgcaccaagauccggcagcugcccaaccuccugcgcggguacgagcacauccggcugagcacccacaacgugaucaaugcggagcgcgccccgggcgggcccuaccggcucggcaccuccgggagcugccccaacgugacgucccgcagcggcuucuucgccaccauggccugggcggucccccgggauaacaagaccgccaccaacccgcugacgguggaggugcccuacaucugcaccaagggcgaggaccagaucaccgucuggggguuccacuccgauaacaagaaccagaugaagaaccuguacggcgacagcaacccccagaaguuuaccuccagcgccaacggggugacgacccacuacgugucccagaucggcggcuuccccaaccagaccgaggacgggggccucccgcagagugggcgcaucgucguggacuacauggugcagaagcccggcaagaccgggacgaucgucuaccagcggggcgugcugcugccccagaagguguggugcgucuccggccgcagcaaggugaucaaggggucgcucccccugaucggcgaggccgacugucugcacgagaaguacgggggccucaacaaguccaagccguacuacaccggggagcacgccaaggcgaucggcaacugucccaucugggucaagacgccccugaagcuggccaacggcaccaaguaccggcccccggccaagcuccugaaggagcgcggguucuucggcgccaucgccggguuccuggagggcgggugggagggcaugaucgcgggcuggcacggguacaccagucacggcgcccacgggguggccguggccgccgaccucaaguccacccaggaggcgaucaacaagaucaccaagaaccugaacagccuguccgagcucgaggucaagaaucugcagcggcugagcggcgccauggacgagcuccacaacgagauccuggagcuggacgagaagguggacgaccuccgcgccgauaccaucuccagccagaucgagcuggccgugcugcucuccaacgagggcaucaucaacagcgaggacgagcaccuccuggcccuggagcggaagcugaagaagaugcuggggcccuccgcggucgacaucggcaaugggugcuucgagacgaagcacaagugcaaccagaccugccucgaccgcaucgccgccggcaccuuuaacgccggggaguucagccugcccaccuucgacucccugaacaucaccgcggccagccucaaugacgacggccuggacaaccacacgauccugcuguacuacuccaccgccgccaguucccucgccgugacccugaugaucgcgaucuucaucguguacauggucagccgggacaacguguccugcagcaucugccuguga

SEQ ID NO: 14212 - RNA, 1758 nt, Artificial Sequence
  derived and/or modified CDS sequence (AUadapt) from InfluenzaB__ABL77321__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagucgcacuucgccaaccugaaggggacgaagacccggggcaagcucugccccaagugccugaacugcaccgaccuggacguggcccucgggcgccccaagugcaccggcacgaucccguccgccaaggugagcauccugcacgaggucaagcccgugaccuccggcugcuuccccaucaugcaugaccggaccaagauccgccagcugcccaaccuccugcggggguacgagcacauccgccugucgacccacaacgugaucaacgccgagaaggcgccgggcgggcccuacaagaucggcacguccgggucgugccccaacaucaccaacggcaacggcuucuucgccaccauggccugggccguccccaagaacgacaacaacaagaccgcgacgaacucccucaccguggaggugccguacaucugcaccgagggggaggaucagaucaccgucuggggcuuccacucggacaacgagacgcagauggccaagcuguacggggacuccaagccccagaaguucaccagcuccgccaacggcgugaccacccacuacgugucgcagaucggcggguuccccaaccaggccgaggacggcgggcugccccaguccggccggaucgucguggacuacauggugcagaaguccgggaagacgggcaccaucaccuaccagcgcggcauccuccugccgcagaaggucuggugcgccuccgggcggucgaaggugaucaagggcucgcugccccucaucggggaggcggacugucugcacgagaaguacggcgggcugaacaaguccaagcccuacuacaccggcgagcacgccaaggccaucggcaacugccccaucugggugaagacgccgcucaaccuggccaacgggaccaaguaccgcccgcccgccaagcugcucaaggagcggggcuucuucggggcgaucgccggcuuccuggagggcgggugggagggcaugaucgccggguggcacggcuacaccucgcacggggcccacggcgucgccguggcggccgaccugaaguccacccaggaggccaucaacaagaucacgaagaaccucaacagucuguccgagcuggaggucaagaaccuccagcgccugucgggcgccauggacgagcugcacaacgagauccucgagcuggacgagaagguggacgaccugcgggccgacaccaucuccucgcagaucgagcucgcggugcugcuguccaacgaggggaucaucaacucggaggacgagcaccuccuggcccuggagcgcaagcucaagaagaugcugggccccuccgccgucgagaucgggaacggcugcuucgagaccaagcacaagugcaaccagaccugccuggaccggaucgccgcggggaccuuuaacgccggcgaguucagccuccccacguucgacucccugaacaucaccgccgccucgcugaacgacgacggccucgacaaccacaccauccugcuguacuacuccaccgccgcgucgucccuggccgugacgcucaugaucgccaucuucaucguguacauggucucgcgcgacaacguguccugcagcaucugccuguga

SEQ ID NO: 14213 - RNA, 1755 nt, Artificial Sequence
  derived and/or modified CDS sequence (AUadapt) from InfluenzaB__ABL77332__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaagucccacuucgccaaccugaaggggacgaagacccggggcaagcucugccccaacugccugaauugcaccgaccuggacguggcccucgggcgccccaugugcgugggcaccacgccguccgccaaggccagcauccugcacgagguccggcccgugaccuccggcuguuuccccaucaugcacgaccgcaccaagauccggcagcugcccaaccuccugcgcggguacgagaacauccggcugagcacccagaaugugaucaacgcggagaaggccccgggcgggcccuacaagcucggcacguccgggucgugccccaacgccaccucccgcagcggcuuuuucgccaccauggcgugggccgucccccgggacaacaacaagaccgccacgaacccgcugaccguggaggugcccuacaucugcaccaagggcgaggaucagaucaccgucuggggguuccacuccgacgacaagacgcagaugaagaaccuguacggcgacaguaacccccagaaguucaccuccagcgccaacggggugaccacccacuacgugucccagaucggcggcuuucccgaccagacggaggacgggggccucccgcagagcgggcgcaucgucguggacuacauggugcagaagcccggcaagaccgggaccaucgucuaccagcggggcgugcugcugccccagaagguguggugcgccuccggccgcaguaaggucaucaaggggucgcucccccugaucggcgaggcggacugccugcacgagaaguacgggggccucaacaaguccaagccguauuacaccggggagcacgccaaggccaucggcaacugccccaucugggugaagacgccccugaagcuggccaacggcaccaaguaccggcccccggccaagcuccugaaggagcgcggguucuuuggcgcgaucgccggguuccuggagggcgggugggagggcaugaucgccggcuggcacggguacaccagccacggcgcccacggggucgccguggcggccgaucucaaguccacccaggaggccaucaacaagaucacgaagaaccugaacagccuguccgagcucgaggugaagaaccugcagcggcugagcggcgccauggacgagcuccauaacgagauccuggagcuggacgagaaggucgacgaccuccgcgccgacaccaucuccagccagaucgagcuggcggugcugcucuccaacgagggcaucaucaauucggaggacgagcaccuccuggcccuggagcggaagcugaagaagaugcuggggcccuccgccguggacaucggcaacgggugcuuugagaccaagcacaagugcaaccagaccugccucgaccgcaucgccgcgggcaccuucaacgccggggaguuuagccugcccacguucgacucccugaacaucaccgccgccagccucaacgaugacggccuggacaaccacgccauccugcuguacuacuccaccgcggccagcucccucgccgucacccugaugaucgccaucuuuaucguguacauggugagccgggacaacgucuccugcagcaucugccuguga

SEQ ID NO: 14214 - RNA, 1755 nt, Artificial Sequence
  derived and/or modified CDS sequence (AUadapt) from InfluenzaB__ABL77343__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaagucccacuucgccaaccugaaggggacgaagacccggggcaagcucugccccaacugccugaauugcaccgaccuggacguggcccucgggcgccccaugugcgugggcaccacgccguccgccaaggccagcauccugcacgagguccggcccgugaccuccggcuguuuccccaucaugcacgaccgcaccaagauccggcagcugcccaaccuccugcgcggguacgagaacauccggcugagcacccagaaugugaucaacgcggagaaggccccgggcgggcccuaccgccucggcacguccgggagcugccccaacgccaccucccggagcggcuuuuucgccaccauggcgugggccgucccccgcgacaacaacaagaccgccacgaacccgcugaccguggaggugcccuacaucugcaccaagggcgaggaucagaucaccgucuggggguuccacuccgacaacaagauccagaugaagaaccuguacggcgacaguaacccccagaaguucacguccagcgccaacggggugaccacccacuacgugucccagaucggcggcuuucccgaccagaccgaggacgggggccucccgcagagcgggcggaucgucguggacuacauggugcagaagcccggcaagacggggaccaucgucuaccagcgcggcgugcugcugccccagaagguguggugcgccuccggccggaguaaggucgugaaggggagccucccccugaucggcgaggcggacugccugcacgagaaguacgggggccucaacaaguccaagccguauuacaccggggagcacgccaaggccaucggcaacugccccaucugggucaagacgccccugaagcuggccaacggcaccaaguaccggcccccggccaagcuccugaaggagcgcggguucuuuggcgcgaucgccggguuccuggagggcgggugggagggcaugaucgccggcuggcacggguacaccagccacggcgcccacgggguggccguggcggccgaucucaaguccacccaggaggccaucaacaagaucaccaagaaccugaacagccuguccgagcucgaggucaagaaccugcagcgccugucgggcgccauggacgagcuccauaacgagauccuggagcuggacgagaagguggacgaccuccgggccgacacgaucuccagccagaucgagcuggcggugcugcucuccaacgagggcaucaucaauagcgaggacgagcaccuccuggcccuggagcgcaagcugaagaagaugcuggggcccuccgccgucgacaucggcaacgggugcuuugagaccaagcacaagugcaaccagaccugccucgaccggaucgccgcgggcaccuucaacgccggggaguuuagccugcccaccuucgacucccugaacaucacggccgccagccucaacgaugacggccuggacaaccacaccauccugcuguacuacuccaccgccgcgagcucccucgccgugacccugaugaucgccaucuuuaucguguacauggucagccgcgacaacguguccugcagcaucugccuguga

SEQ ID NO: 14215 - RNA, 1755 nt, Artificial Sequence
  derived and/or modified CDS sequence (AUadapt) from InfluenzaB__ABL77365__HA
augaaggccaucaucgugcugcucauggucgugaccaguaacgccgaccgcaucugcaccggcaucacguccagcaacaguccccacguggucaagaccgcgacccagggggaggugaacgugaccggcgucaucccgcugacgaccacccccaccaagucccacuucgccaaccugaaggggacgaagacccggggcaagcucugccccaauugccugaacugcaccgaccuggacguggcccucgggcgccccaugugugugggcaccacgccguccgccaaggccagcauccugcacgagguccggcccgugaccuccggcugcuuccccaucaugcacgaccgcaccaagauccggcagcugcccaaucuccugcgcggguacgagaacauccggcugagcacccagaacgugaucaacgcggagaaggccccgggcgggcccuaucgccucggcacguccgggagcugccccaacgccaccucccggagcggcuucuucgccaccauggcgugggccgucccccgcgauaacaacaagaccgccacgaacccgcugaccguggaggugcccuacgucugcaccgagggcgaggaucagaucaccguguggggguuccacuccgacaacaagacgcagaugaagaaccuguacggcgauagcaacccccagaaguucaccuccagcgccaacggggugaccacccauuacgucucccagaucggcggcuuccccgaccaggccgaggacgggggccucccgcagagcgggcggaucgugguggacuauaugguccagaagcccggcaagacggggaccaucguguaccagcgcggcgugcugcugccccagaaggucuggugcgcguccggccggagcaaggugaucaaggggagccucccccugaucggcgaggccgacugccugcaugagaaguacgggggccucaacaaguccaagccguacuacaccggggagcacgccaaggccaucggcaauugccccaucugggucaagacgccccugaagcuggccaacggcaccaaguaccggcccccggcgaagcuccugaaggagcgcggguucuucggcgccaucgccggguuccuggagggcgggugggagggcaugaucgccggcuggcauggguacaccagccacggcgcccacgggguggcgguggccgccgaccucaaguccacccaggaggccaucaauaagaucaccaagaaccugaacagccuguccgagcucgaggucaagaaccugcagcgccugagcggcgccauggacgagcuccauaacgagauccuggagcuggacgagaagguggacgaccuccgggcggacacgaucuccagucagaucgagcuggccgugcugcucuccaacgagggcaucaucaacagcgaggacgagcaccuccuggcccuggagcgcaagcugaagaagaugcuggggcccuccgccgucgacaucggcaaugggugcuucgagaccaagcacaagugcaaccagaccugucucgaccggaucgcggccggcaccuucaacgccggggaguucagccugcccaccuucgauucccugaacaucacggccgccagccucaacgacgacggccuggauaaccacaccauccugcuguacuacuccaccgcggccagcucccucgccgugacccugaugaucgccaucuucaucguguauauggucagccgcgacaacguguccugcagcaucugccuguga

SEQ ID NO: 14216 - RNA, 1755 nt, Artificial Sequence
  derived and/or modified CDS sequence (AUadapt) from InfluenzaB__ABL84340__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagucccauuucgccaaccugaaggggacgaagacccggggcaagcucugcccgaccugccugaacugcaccgaccuggacguggcccucgggcgccccaugugugugggcaucacgcccuccgccaaggccagcauccugcacgagguccggcccgugaccuccggcugcuuccccaucaugcacgaccgcaccaagauccggcagcugcccaaccuccugcgcggguacgagaagauccggcugagcacccagaaugugaucaacgcggagaaggccccgggcgggcccuaccgccucggcacguccgggucgugccccaacaccaccuccaagagcggcuucuucgccaccauggccugggcggucccccgggauaacaacaagacggccaccaacccgcugaccguggaggugccccacaucugcaccaaggaggaggaccagaucacggucuggggcuuccacuccgacaauaagacccagaugaagaaccuguacggggacagcaacccccagaaguucaccuccucggccaacggcgugaccacgcauuacgugucccagaucgggggcuuccccgaccagaccgaggacggcgggcucccgcagagcggccgcaucgucguggacuacauggugcagaagcccgggaagaccggcaccaucgucuaccagcgggggauccugcugccccagaagguguggugugccuccggccgcagcaaggugaucaagggcucgcucccccugaucggggaggccgacugccugcacgagaaguacggcgggcucaacaaguccaagccguacuacacgggcgagcaugcgaaggccaucgggaacugccccaucugggucaagacgccccugaagcuggccaacggcaccaaguaccggcccccggccaagcuccugaaggagcgcggcuucuucggggccaucgcgggcuuccuggagggcgggugggaggggaugaucgccggcuggcacggcuauaccagccacggggcccacggcguggccgucgccgcggaccucaaguccacccaggaggccaucaacaagaucaccaagaaccugaacucgcuguccgagcucgaggugaagaaccugcagcggcugaguggggccauggacgagcuccacaacgagauccuggagcuggacgagaagguggacgaccuccgcgccgacaccaucuccagccagaucgagcuggccguccugcucuccaaugagggcaucaucaacucggaggacgagcaccuccuggcgcuggagcggaagcugaagaagaugcugggccccuccgccguggacaucgggaacggcugcuucgagaccaagcauaagugcaaccagaccugccucgaccgcaucgccgccgggacguucaacgcgggcgaguucagccugcccaccuucgauucccugaacaucaccgccgccagccucaacggggacggccuggacaaccacaccauccugcuguacuauuccacggccgccucgucccucgcggugacccugaugaucgccaucuucaucgucuacaugaucagccgggacaacguguccugcagcaucugccuguga

SEQ ID NO: 14217 - RNA, 1755 nt, Artificial Sequence; identical to SEQ ID NO: 14138
  derived and/or modified CDS sequence (AUadapt) from InfluenzaB__ABN50382__HA

SEQ ID NO: 14218 - RNA, 1755 nt, Artificial Sequence; identical to SEQ ID NO: 14138
  derived and/or modified CDS sequence (AUadapt) from InfluenzaB__ABN50393__HA

SEQ ID NO: 14219 - RNA, 1755 nt, Artificial Sequence
  derived and/or modified CDS sequence (AUadapt) from InfluenzaB__ABN50404__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaagucccacuucgccaaccugaaggggacgaagacccggggcaagcucugcccgaccugccugaacuguaccgaccuggacguggcccucgggcgccccaugugcgugggcgucacgcccuccgccaaggccagcauccugcacgaggugcggcccgugaccuccggcugcuuccccaucaugcaugaccgcaccaagauccggcagcugcccaaccuccugcgcggguacgagaagauccggcugucgacccagaacgucaucaacgcggagaaggccccgggcgggcccuaccgccucggcacguccgggaguugccccaacgccaccucccggagcggcuucuucgccaccauggcgugggccgugccccgcgacaacaauaagaccgccacgaacccgcugaccguggaggucccccacaucugcaccaaggaggaggaccagaucaccguguggggcuuccacuccgacaauaagacgcagaugaagaaccuguacggggacagcaacccccagaaguucaccuccucggccaauggcgugaccacccacuacgucucccagaucgggggcuuccccgaccagacggaggacggcgggcucccgcagagcggccggaucgugguggacuauaugguccagaagcccgggaagaccggcaccaucguguaccagcgcgggauccugcugccccagaagguguggugcgccuccggccggagcaaggucaucaagggcagccucccccugaucggggaggcggacugccugcacgagaaguauggcgggcucaacaaguccaagccguacuacaccggcgagcacgccaaggccaucgggaacugccccaucugggugaagacgccccugaagcuggccaauggcaccaaguaccggcccccggccaagcuccugaaggagcgcggcuucuucggggcgaucgccggcuuccuggagggcgggugggaggggaugaucgccggcuggcacggcuacaccagccauggggcccacggcgucgccguggcggccgaccucaaguccacccaggaggccaucaacaagaucacgaagaaccugaacucgcuguccgagcucgaggugaagaaccugcagcgccugaguggggccauggacgagcuccacaacgagauccuggagcuggacgagaaggucgacgaccuccgggccgacaccaucuccagucagaucgagcuggcggugcugcucuccaacgagggcaucaucaacagcgaggacgagcaccuccuggcccuggagcgcaagcugaagaagaugcugggccccuccgccguggacaucgggaacggcuguuucgagaccaagcacaagugcaaccagaccugccucgaccggaucgccgcggggaccuucaaugccggcgaguucucgcugcccacguucgacucccugaacaucaccgccgccagccucaacgaugacgggcuggacaaccacaccauccugcuguacuacuccaccgccgcgagcucccucgccgucacgcugaugaucgccaucuuuaucguguacaugaucagccgcgacaacguguccugcagcaucugccuguga

SEQ ID NO: 14220 - RNA, 1755 nt, Artificial Sequence; identical to SEQ ID NO: 14147
  derived and/or modified CDS sequence (AUadapt) from InfluenzaB__ABN50415__HA

SEQ ID NO: 14221 - RNA, 1755 nt, Artificial Sequence; identical to SEQ ID NO: 14147
  derived and/or modified CDS sequence (AUadapt) from InfluenzaB__ABN50426__HA

SEQ ID NO: 14222 - RNA, 1755 nt, Artificial Sequence
  derived and/or modified CDS sequence (AUadapt) from InfluenzaB__ABN50437__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacuguaccgaccuggacguggcccucgggcggcccaugugcgugggcaccacgccguccgccaaggccagcauccugcacgagguccgccccgugaccuccggcugcuuccccaucaugcacgaucggaccaagauccgccagcugcccaaccuccugcggggguacgagaacauccgccugucgacccagaacgugaucgacgcggagaaggccccgggcgggcccuaccggcucggcacguccgggaguugccccaacgccaccuccaagagcggcuucuucgccaccauggcgugggccguccccaaggacaacaacaagaaugccaccaacccgcugacgguggaggugcccuacaucugcaccgagggcgaggaccagaucaccgucuggggguuccacuccgacaauaagacccagaugaagaaccuguacggcgaccccaacccccagaaguucacgagcuccgccaacggggugaccacccacuaugugucgcagaucggcggcuucccggaccagaccgaggacgggggccucccccaguccgggcgcaucgucguggacuacaugaugcagaagcccggcaagacggggaccaucguguaccagcggggcguccugcugccccagaagguguggugugccagcggcaaguccaaggugaucaaggggagccucccgcugaucggcgaggcggacugccugcacgagaaguacgggggccucaacaagagcaagcccuauuacaccggggagcacgccaaggccaucggcaacugccccaucugggucaagacgccccugaagcuggccaacggcaccaaguaccgcccgcccgccaagcuccugaaggagcggggguucuuuggcgcgaucgccggguuccuggagggcgggugggagggcaugaucgccggcuggcacggguacaccucccacggcgcccacgggguggccgucgcggccgaccucaagucgacccaggaggccaucaacaagaucaccaagaaucugaacucccugagcgagcucgaggugaagaaccugcagcgccuguccggcgccauggacgagcuccacaacgagauccuggagcuggacgagaagguggaugaccuccgggccgacacgaucagcucccagaucgagcuggcgguccugcucagcaacgagggcaucaucaacuccgaggacgagcaccuccuggcccuggagcgcaagcugaagaagaugcuggggcccagugccguggacaucggcaacgggugcuucgagaccaagcacaagugcaaccagaccugucucgaccggaucgccgcgggcaccuucaacgccggggaguucucccugcccaccuucgacagccugaacaucacggccgccucccucaaugacgacggccuggacaaccacaccauccugcuguacuacaguaccgccgcguccagccucgccgugacccugaugcuggccaucuucaucgucuacauggugucccgcgacaacgugagcugcuccaucugccucuga

SEQ ID NO: 14223 - RNA, 1758 nt, Artificial Sequence
  derived and/or modified CDS sequence (AUadapt) from InfluenzaB__ABN50459__HA
augaaggcccugaucgugcuccugauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccucaaggggacgaagacccggggcaagcugugccccaagugccugaacugcaccgaccucgauguggcccuggggcgccccaagugcaccggcaacaucccguccgccgaggugucgauccugcacgagguccggcccgugacguccggcugcuuccccaucaugcacgaccgcaccaagauccggcagcuccccaaccugcugcgcggguacgagcacauccggcucagcacccacaacgugaucaacgccgagaaggcgccgggcgggcccuacaagaucggcaccuccgggucgugucccaacgucacgaacggcaacggcuucuucgccaccauggccugggccgugcccaagaacgacaacaacaagaccgcgaccaacucccugacgaucgaggugccguacaucugcaccgagggggaggaccagaucaccaucuggggcuuccacucggacaaugagauccagauggccaagcuguacggggacuccaagccccagaaguucaccagcuccgccaacggcgucacgacccacuacgugucgcagaucggcggguuccccaaccagaccgaggacggcgggcucccccaguccggccgcaucguggucgacuacauggugcagaaguccgggaagaccggcacgaucaccuaccagcggggcauccugcugccgcagaagguguggugcgccuccgggcgcagcaaggucaucaagggcucgcucccccugaucggggaggccgauugccugcacgagaaguacggcgggcucaacaaguccaagcccuacuacaccggcgagcacgcgaaggccaucggcaacugccccaucugggugaagaccccgcugaagcuggccaacgggacgaaguaccggccgcccgccaagcuccugaaggagcgcggcuucuucggggccaucgcgggcuuccuggagggcgggugggagggcaugaucgccggguggcacggcuacaccucgcauggggcccacggcguggccgucgccgcggaccucaaguccacccaggaggccaucaacaagaucaccaagaaccugaacagccuguccgagcucgaggugaagaaccugcagcggcugucgggcgccauggacgagcuccacaacgagauccuggagcuggacgagaaggucgacgaccuccgcgccgacacgaucuccucgcagaucgagcuggccgugcugcucuccaacgaggggaucaucaauagcgaggacgagcaccuccuggcgcuggagcggaagcugaagaagaugcugggccccuccgccguggagaucgggaacggcugcuucgagaccaagcacaagugcaaccagaccugccucgaccgcaucgccgccgggaccuucgacgcgggcgaguucucgcugcccaccuucgacucccugaauaucacggccgccucgcucaacgacgacggccuggacaaccacaccauccugcuguacuacuccaccgccgccagcucccucgcggucacccugaugaucgccaucuucgugguguacauggucucgcgggacaacguguccugcagcaucugccuguga

SEQ ID NO: 14224 - RNA, 1758 nt, Artificial Sequence
  derived and/or modified CDS sequence (AUadapt) from InfluenzaB__ABN50470__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccaaggugucgauccugcacgagguccggcccgugacguccggcugcuuucccaucaugcacgaccgcaccaagauccggcagcugcccaaccuccugcgcggguacgagcggauccgccugucgaaccacaacgugaucaacgccgagaaggcgccgggcgggcccuacaagaucggcaccuccgggucgugccccaacgucaccaacggcaacggcuucuucgccacgauggccugggccgugcccaagaacgagaacaacaagaccgcgaccaacucccucaccaucgaggugccguacaucugcacggagggggaggaucagaucaccgucuggggcuuccacagcgacaacgagauccagauggccaagcuguacggggacuccaagccccagaaguucaccucguccgccaacggcgugaccacgcacuacgugucgcagaucggcggguuccccaaccagaccgaggacggcgggcugccccaguccggccggaucgucguggacuacauggugcagaaguccgggaagaccggcaccaucacguaccagcgcggcauccuccugccgcagaaggucuggugcgccuccgggcggagcaaggugaucaagggcucgcugccccucaucggggaggccgacugucugcacgagaaguacggcgggcugaacaaguccaagcccuacuacaccggcgagcacgcgaaggccaucggcaacugccccaucugggugaagaccccgcucaagcuggccaacgggaccaaguaccgcccgcccgccaagcugcucaaggagcggggcuucuucggggccaucgcgggcuuccuggagggcgggugggagggcaugaucgccggguggcacggcuacacgucgcacggggcccacggcgucgccguggccgcggaccugaaguccacccaggaggccaucaacaagaucaccaagaaccucaacucgcuguccgagcuggaggucaagaaucuccagcgccugagcggcgccauggacgagcugcacaacgagauccucgagcuggacgagaagguggacgaccugcgggccgacaccaucuccucgcagaucgagcucgccgugcugcuguccaacgaggggaucaucaacucggaggacgagcaccuccuggcgcuggagcgcaagcucaagaagaugcugggccccuccgccgucgagaucgggaacggcugcuucgagacgaagcacaagugcaaccagaccugccuggaccggaucgccgccgggaccuucaaugcgggcgaguucucgcuccccaccuucgacucccugaacaucaccgccgccagccugaacgacgacggccucgacaaccacacgauccugcuguacuacuccaccgccgccucgucccuggcggugacccucaugaucgccaucuucguggucuacauggugucgcgcgacaacguguccugcagcaucugccuguga

SEQ ID NO: 14225 - RNA, 1755 nt, Artificial Sequence
  derived and/or modified CDS sequence (AUadapt) from InfluenzaB__ABN50481__HA
augaaggccaucaucgugcugcuccuggucgugaccaguaacgccgaccgcaucugcaccggcaucacguccagcaacagcccccacguggucaagaccgcgacccagggggaggugaaugugaccggcgccaucccgcugacgaccacccccaccaagucccacuucgccaaccucaaggggacgaagacccggggcaagcugugcccgaccugcuucaacugcaccgaucuggacgucgcccucgggcgccccaugugcgugggcaucacgcccuccgccaaggcgucgauccugcacgaggugcggcccgucaccuccggcugcuuccccaucaugcacgaccgcaccaagauccggcagcugcccaaucuccugcgcggguacgagaagauccggcugagcacccagaacgugaucgacgccgagaaggccccgggcgggcccuaccgccucggcacguccgggagcugccccaacgccaccuccaagaguggcuucuucgcgaccauggccugggccgugccccgggacaacaacaagaccgccacgaacccgcugaccgucgaggugccccacaucugcaccaaggaggaggaucagaucaccguguggggcuuccacuccgacaacaagacgcagaugaagaaccuguacggggacagcaauccccagaaguucaccuccagcgccaacggcaucaccacccacuacgucucccagaucgggggcuuccccgaccagacggaggacggcgggcucccgcagaguggccgcaucgugguggacuacaugguccagaagcccgggaagaccggcaccaucguguaccagcgggggauccugcugccccagaagguguggugcgcguccggccgcagcaaggucaucaagggcagccucccccugaucggggaggccgacugccugcaugagaaguacggcgggcucaacaaguccaagccguacuacaccggcgagcacgccaaggccaucgggaacugccccaucugggugaagacgccccugaagcuggccaacggcaccaaguaucggcccccggcgaagcuccugaaggagcgcggcuucuucggggccaucgccggcuuccuggagggcgggugggaggggaugaucgccggcuggcacggcuacaccucgcacggggcccacggcguggcggucgccgccgaucucaaguccacccaggaggccaucaacaagaucacgaagaaccugaacagccuguccgagcucgaggugaagaaccugcagcggcugagcggggccauggacgagcuccacaaugagauccuggagcuggacgagaaggucgacgaccuccgcgcggacaccaucuccucgcagaucgagcuggccgugcugcucuccaacgagggcaucaucaacagcgaggaugagcaccuccuggcccuggagcggaagcugaagaagaugcugggccccuccgccguggacaucgggaacggcugcuucgagaccaagcacaagugcaaccagaccugucucgaccgcaucgcggccgggaccuucaacgccggcgaguucagccugcccacguucgacucccugaacaucaccgccgccagucucaacgacgacgggcuggacaaccacaccauccugcuguacuacuccaccgcggccaguucccucgccgucacgcugaugaucgccaucuucaucguguacaugaucagccgggacaacguguccugcagcaucugccuguga

SEQ ID NO: 14226 - RNA, 1755 nt, Artificial Sequence
  derived and/or modified CDS sequence (AUadapt) from InfluenzaB__ABN50503__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaagucccacuucgccaaccugaaggggacgaagacccggggcaagcucugcccgaccugccugaacugcaccgaucuggacguggcccucgggcgccccaugugcgugggcgucacgcccuccgccaaggccucgauccugcacgaggugcggcccgugaccuccggcugcuuccccaucaugcacgaccgcaccaagauccggcagcugcccaaucuccugcgcggguacgagaagauccggcugagcacccagaacgucaucaacgcggagaaggccccgggcgggcccuaccgccucggcacguccgggagcugccccaaugccaccucccggagcggcuucuucgccaccauggcgugggccgugcccaaggacaacaacaagaccgccacgaacccgcugaccguggaggucccccauaucugcaccaaggaggaggaccagaucaccguguggggcuuccacuccgacgacaagacgcagaugaagaaccuguacggggauucgaacccccagaaguucaccuccagcgccaacggcgugaccacccacuacgucucccagaucgggggcuuucccgaccagacggaggacggcgggcucccgcagagcggccgcaucgugguggacuacaugguccagaagcccgggaagaccggcaccaucguguaccagcgggggauccugcugccccagaagguguggugcgccuccggccgcaguaaggucaucaagggcucgcucccccugaucggggaggcggacugccugcacgagaaguacggcgggcucaacaaguccaagccguacuacaccggcgagcaugccaaggccaucgggaacugccccaucugggugaagacgccccugaagcuggccaacggcaccaaguaccggcccccggccaagcuccugaaggagcgcggcuucuucggggcgaucgccggcuuccuggagggcgggugggaggggaugaucgccggcuggcauggcuacaccagccacggggcccacggcgucgccguggcggccgaccucaaguccacccaggaggccaucaacaagaucacgaagaaccugaauagccuguccgagcucgaggugaagaaccugcagcggcugucgggggccauggacgagcuccacaacgagauccuggagcuggacgagaaggucgacgaucuccgcgccgacaccaucuccagccagaucgagcuggcggugcugcucuccaacgagggcaucaucaacagcgaggacgagcaccuccuggcccuggagcggaagcugaagaagaugcugggccccuccgccguggauaucgggaacggcugcuucgagaccaagcacaagugcaaccagaccugccucgaucgcaucgccgcggggaccuucaacgccggcgaguucagccugcccacguucgacucccugaacaucaccgccgccucgcucaaugacgacgggcuggacaaccacaccauccugcuguacuacuccaccgccgcgaguucccucgccgucacgcugaugaucgccaucuucaucguguacaugaucagccgggacaacguguccugcagcaucugccuguga

SEQ ID NO: 14227 - RNA, 1755 nt, Artificial Sequence
  derived and/or modified CDS sequence (AUadapt) from InfluenzaB__ABN50514__HA
augaaggccaucaucgugcugcucauggucgccaccaguaacgcggaccgcaucugcaccggcaucacguccagcaacaguccccacguggugaagaccgccacccagggggaggucaacgugaccggcgugaucccgcugacgaccacccccaccaaguccuacuucgccaaccugaaggggacgcggacccgcggcaagcucugucccgacugccugaacugcaccgaccuggaugucgcccucgggcggcccaugugcgugggcaccacgccguccgccaaggcgagcauccugcacgaggugcgccccgucaccuccggcugcuuccccaucaugcacgaucggaccaagauccgccagcugcccaaccuccugcggggguacgagaacauccgccugagcacccagaacgugaucgaugccgagaaggccccgggcgggcccuaccggcucggcacguccgggagcugccccaacgccaccuccaagagcggcuuuuucgcgaccauggccugggccgugcccaaggacaacaacaagaacgccaccaacccgcugacggucgaggugcccuaugugugcaccgagggcgaggaccagaucaccgucuggggguuccacuccgacaauaagccccagaugaagaaccuguacggcgacagcaacccccagaaguuuaccuccagcgccaacggggugacgacccacuacgugucccagaucggcggcuucccggaccagaccgaggaugggggccucccccagagcgggcgcaucgucguggacuacauggugcagaagcccggcaagaccgggacgaucgucuaccagcggggcgugcugcugccccagaagguguggugcgcguccggccgcaguaaggucaucaaggggagccucccgcugaucggcgaggccgacugccugcacgagaaguacgggggccucaauaaguccaagcccuacuacaccggggagcacgccaaggccaucggcaacugccccaucugggugaagacgccccugaagcuggccaauggcaccaaguaccggccgcccgcgaagcuccugaaggagcgcggguucuucggcgccaucgccggguuccuggagggcgggugggagggcaugaucgccggcuggcacggguacaccagucacggcgcccacggggucgcgguggccgccgaccucaaguccacccaggaggccaucaacaagaucaccaagaaccugaauagccuguccgagcucgaggugaagaaccugcagcggcugagcggcgccauggacgagcuccacgaugagauccuggagcuggacgagaaggucgacgaccuccgcgcggacaccaucuccagccagaucgagcuggccgugcugcucuccaacgagggcaucaucaauagcgaggacgagcaccuccuggcccuggagcggaagcugaagaagaugcuggggcccuccgccguggacaucggcaacggguguuucgagacgaagcacaagugcaaccagaccugccucgaucgcaucgcggccggcaccuucaacgccggggaguucagccugcccaccuucgacucccugaauaucaccgccgccagccucaacgacgacggccuggacaaucacacgauccugcuguacuacuccaccgcggccagcucccucgccgucacccugaugcuggccaucuucaucguguauauggugagccgggacaacgucuccugcagcaucugccucuga

SEQ ID NO: 14228 - RNA, 1755 nt, Artificial Sequence
  derived and/or modified CDS sequence (AUadapt) from InfluenzaB__ABN50525__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaaguccuacuucgccaaccugaaggggacgcggacccgcggcaagcucugccccgacugccugaauugcaccgaccuggacguggcccucgggcggcccaugugcgugggcaccacgccguccgccaaggccagcauccugcacgagguccgccccgugaccuccggcugcuuucccaucaugcacgaccggaccaagauccgccagcugcccaaccuccugcggggguacgagaacauccgccugagcacccagaaugugaucgacgcggagaaggccccgggcgggcccuaccggcucggcacguccgggagcugccccaacgccaccuccaagagcggcuucuuuuccaccauggccugggcgguccccaaggacaacaacaagaacgccaccaacccgcugacgguggaggugcccuacgucugcaccgagggcgaggaucagaucaccguguggggguuccacucggacaacaagacccagaugaagaaccuguauggcgacuccaacccccagaaguucacgagcuccgccaacggggugaccacccacuacgucagucagaucggcggcuuccccgaccagaccgaggacgggggccucccgcaguccgggcgcaucgugguggacuacaugguccagaagcccggcaagacggggaccaucguguaccagcggggcgugcugcugccccagaaggucuggugcgccaguggccgcagcaaggugaucaaggggucccucccccugaucggcgaggccgacugccugcacgagaaguacgggggccucaacaagaguaagccguacuacaccggggagcacgcgaaggccaucggcaacugccccaucugggucaagacgccccugaagcuggccaacggcaccaaguaccggcccccggccaagcuccugaaggagcgcggguuuuucggcgccaucgcgggguuccuggagggcgggugggagggcaugaucgccggcuggcacggguacaccucccacggcgcccacgggguggccguggccgcggaccucaagaguacccaggaggccaucaacaagaucaccaagaaccugaacucccugagcgagcucgaggucaagaaccugcagcggcuguccggcgccauggacgagcuccauaacgagauccuggagcuggacgagaagguggacgaccuccgcgccgacacgaucucgucccagaucgagcuggccgugcugcucagcaaugagggcaucaucaacuccgaggacgagcaccuccuggcgcuggagcggaagcugaagaagaugcuggggcccagcgccgucgacaucggcaacgggugcuuugagaccaagcacaagugcaaccagaccugccucgaccgcaucgccgccggcaccuucaaugcgggggaguucucccugcccaccuucgacagccugaacaucacggccgccucccucaacgacgauggccuggacaaccacaccauccugcuguacuacagcaccgccgccuccagccucgcggugacccugaugcuggccaucuuuaucguguacauggucucccgggacaacgugagcugcagcaucugccucuga

SEQ ID NO: 14229 - RNA, 1758 nt, Artificial Sequence
  derived and/or modified CDS sequence (AUadapt) from InfluenzaB__ABN50536__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaauaucccguccgccaaggugucgauccugcacgagguccggcccgugacguccggcugcuuccccaucaugcacgaccgcaccaagauccggcagcugcccaaccuccugcgcggguacgagcggauccgccugucgaaccacaacgugaucaacgccgaggaggcgccgggcgggcccuacaagaucggcaccuccgggagcugccccaacgucaccaacggcaacggcuucuuugccacgauggccugggccgugcccaagaacgagaacaacaagaccgcgaccaacucccucaccaucgaggugccguacaucugcacggagggggaggaccagaucaccgucuggggcuuccacucggacaacgagauccagauggccaagcuguacggggacuccaagccccagaaguucaccucguccgccaacggcgugaccacgcacuacgugagucagaucggcggguuccccaaccagaccgaggacggcgggcugccccaguccggccggaucgucguggacuacauggugcagaaguccgggaagaccggcaccaucacguaccagcgcggcauccuccugccgcagaaggucuggugcgccuccgggcggucgaaggugaucaagggcucgcugccccucaucggggaggccgacugccugcacgagaaguacggcgggcugaacaaguccaagcccuacuacaccggcgagcacgcgaaggccaucggcaacugccccaucugggugaagaccccgcucaagcuggccaacgggaccaaguaucgcccgcccgccaagcugcucaaggagcggggcuucuucggggccaucgcgggcuuccuggagggcgggugggagggcaugaucgccggguggcacggcuacacgagccacggggcccacggcgucgccguggccgcggaccugaaguccacccaggaggccaucaacaagaucaccaagaaccucaacucgcuguccgagcuggaggucaagaaccuccagcgccugucgggcgccauggacgagcugcacaacgagauccucgagcuggacgagaagguggaugaccugcgggccgacaccaucuccagccagaucgagcucgccgugcugcuguccaacgaggggaucaucaacucggaggacgagcaccuccuggcgcuggagcgcaagcucaagaagaugcugggccccuccgccgucgagaucgggaacggcugcuucgagacgaagcacaagugcaaccagaccugccuggaccggaucgccgccgggaccuucaacgcgggcgaguucucgcuccccaccuuugacucccugaacaucaccgccgccagccugaacgacgacggccucgacaaccacacgauccugcuguacuacuccaccgccgccucgucccuggcggugacccucaugaucgccaucuucguggucuacauggugucgcgcgacaacguguccugcagcaucugccuguga

SEQ ID NO: 14230 - RNA, 1758 nt, Artificial Sequence
  derived and/or modified CDS sequence (AUadapt) from InfluenzaB__ABN50547__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggauguggcccucgggcgccccaagugcaccggcaacaucccguccgccaaggugucgauccugcacgagguccggcccgugacguccggcugcuuccccaucaugcacgaccgcaccaagauccggcagcugcccaaccuccugcgcggguacgagcacauccggcugucgacccacaacgugaucaacgccgagaaggcgccgggcgggcccuacaagaucggcaccuccgggagcugucccaacgucacgaacggcaacggcuucuucgccaccauggccugggccgugcccaagaacgacaacaacaagaccgcgaccaacucccucacgaucgaggugccguacaucugcaccgagggggaggaccagcugaccgucuggggcuuccacucggacaaugagaaccagauggccaagcuguacggggacuccaagccccagaaguucaccucguccgccaacggcgugacgacccacuacgugagccagaucggcggguuccccaaccagaccgaggacggcgggcucccccaguccggccgcaucgucguggacuacauggugcagaaguccgggaagaccggcacgaucaccuaccagcggggcauccugcugccgcagaaggucuggugcgccuccgggcgcucgaaggugaucaagggcucgcucccccugaucggggaggccgauugccugcacgagaaguacggcgggcucaacaaguccaagcccuacuacaccggcgagcacgcgaaggccaucggcaacugccccaucugggugaagaccccgcugaagcuggccaacgggacgaaguaccggccgcccgccaagcuccugaaggagcgcggcuucuucggggccaucgcgggcuuccuggagggcgggugggagggcaugaucgccggguggcacggcuacaccagccauggggcccacggcgucgccguggccgcggaccucaaguccacccaggaggccaucaacaagaucaccaagaaccugaacucgcuguccgagcucgaggucaagaaccugcagcggcugucgggcgccauggacgagcuccacaacgagauccuggagcuggacgagaagguggacgaccuccgcgccgacacgaucuccagccagaucgagcuggccgugcugcucuccaacgaggggaucaucaauucggaggacgagcaccuccuggcgcuggagcggaagcugaagaagaugcugggccccuccgccgucgagaucgggaacggcugcuucgagaccaagcacaagugcaaccagaccugccucgaccgcaucgccgccgggaccuucgacgcgggcgaguucucgcugcccaccuucgacucccugaauaucacggccgccagccucaacgacgacggccuggacaaccacaccauccugcuguacuacuccaccgccgccucgucccucgcggugacccugaugaucgccaucuucguggucuacauggugucgcgggacaacguguccugcagcaucugccuguga

SEQ ID NO: 14231 - RNA, 1758 nt, Artificial Sequence
  derived and/or modified CDS sequence (AUadapt) from InfluenzaB__ABN50558__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaauaucccguccgccaaggugucgauccugcacgagguccggcccgugacguccggcugcuuccccaucaugcacgaccgcaccaagauccggcagcugcccaaccuccugcgcggguacgagcacauccggcugucgacccacaacgugaucaacgccgagaaggcgccgggcgggcccuacaagaucggcaccuccgggucgugccccaacgucacgaacggcaacggcuucuuugccaccauggccugggccgugcccaagaacgacaacaacaagaccgcgaccaacucccucacgaucgaggugccguacaucugcaccgagggggaggaccagaucaccgucuggggcuuccacagcgacaaggagacccagauggccaagcuguacggggacuccaagccccagaaguucacgucguccgccaacggcgugaccacccacuacgugagucagaucggcggguuccccaaccagaccgaggacggcgggcugccccaguccggccgcaucgucguggacuacaugaugcagaaguccgggaagacgggcaccaucaccuaccagcggggcauccuccugccgcagaagguguggugcgccuccgggcgcagcaaggucaucaagggcucgcugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaucggccgcccgccaagcugcucaaggagcgcggcuucuucggggccaucgcgggcuuccuggagggcgggugggagggcaugaucgccggguggcacggcuacaccucgcacggggcccacggcguggccgucgccgcggaccugaaguccacccaggaggccaucaacaagaucacgaagaaccucaacucgcuguccgagcuggaggugaagaaccuccagcggcugagcggcgccauggacgagcugcacaacgagauccucgagcuggacgagaaggucgaugaccugcgcgccgacaccaucuccucgcagaucgagcucgccgugcugcuguccaacgaggggaucaucaacucggaggacgagcaccuccuggcgcuggagcggaagcucaagaagaugcugggccccuccgccguggagaucgggaacggcugcuucgagaccaagcacaagugcaaccagaccugccuggaccgcaucgccgccgggaccuucgacgcgggcgaguucucgcuccccacguuugacucccugaacaucaccgccgccagccugaacgacgacggccucgacaaccacaccauccugcuguacuacuccaccgccgccucgucccuggcggucacgcucaugaucgccaucuucgugguguacauggucucgcgggacaacguguccugcagcaucugccuguga

SEQ ID NO: 14232 - RNA, 1755 nt, Artificial Sequence; identical to SEQ ID NO: 14147
  derived and/or modified CDS sequence (AUadapt) from InfluenzaB__ABN50569__HA

SEQ ID NO: 14233 - RNA, 1758 nt, Artificial Sequence; identical to SEQ ID NO: 14159
  derived and/or modified CDS sequence (AUadapt) from InfluenzaB__ABN50580__HA

SEQ ID NO: 14234 - RNA, 1758 nt, Artificial Sequence
  derived and/or modified CDS sequence (AUadapt) from InfluenzaB__ABN50591__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggauguggcccucgggcgccccaagugcaccggcaacaucccguccgccaaggugucgauccugcacgagguccggcccgugacguccggcugcuuccccaucaugcacgaccgcaccaagauccggcagcugcccaaccuccugcgcggguacgagcggauccgccugucgaaccacaacgugaucaacgccgagaaggcgccgggcgggcccuacaagaucggcaccuccgggagcugucccaacgucaccaacggcaacggcuucuucgccacgauggccugggccgugcccaagaacgagaacaacaagaccgcgaccaacucccucaccaucgaggugccguacaucugcacggagggggaggaccagaucaccgucuggggcuuccacucggacaacgaggcccagauggccaagcuguauggggacuccaagccccagaaguucaccucguccgccaacggcgugaccacgcacuacgugagccagaucggcggguuccccaaccagaccgaggacggcgggcugccccaguccggccggaucgucguggacuacauggugcagaaguccgggaagaccggcaccaucacguaccagcgcggcauccuccugccgcagaaggucuggugcgccuccgggcggucgaaggugaucaagggcucgcugccccucaucggggaggcggacugucugcacgagaaguacggcgggcugaacaaguccaagcccuacuacaccggcgagcacgccaaggccaucggcaacugccccaucugggugaagaccccgcucaagcuggccaacgggaccaaguaccgcccgcccgccaagcugcucaaggagcggggcuucuucggggcgaucgccggcuuccuggagggcgggugggagggcaugaucgccggguggcacggcuacacgagccacggggcccauggcgucgccguggcggccgaccugaaguccacccaggaggccaucaacaagaucaccaagaaccucaacucgcuguccgagcuggaggucaagaaccuccagcgccugucgggcgccauggacgagcugcacaacgagauccucgagcuggacgagaagguggacgaccugcgggccgacaccaucuccagccagaucgagcucgcggugcugcuguccaacgaggggaucaucaacagugaggacgagcaccuccuggcccuggagcgcaagcucaagaagaugcugggccccuccgccgucgagaucgggaacggcugcuucgagacgaagcacaagugcaaccagaccugccuggaccggaucgccgcggggaccuucaacgccggcgaguucucgcuccccaccuucgacucccugaacaucaccgccgccagucugaacgacgacggccucgacaaccacacgauccugcuguacuacuccaccgccgcgucgucccuggccgugacccucaugaucgccaucuucguggucuacauggugucgcgcgacaacguguccugcagcaucugccuguga

SEQ ID NO: 14235 - RNA, 1758 nt, Artificial Sequence
  derived and/or modified CDS sequence (AUadapt) from InfluenzaB__ABN50602__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaugggcaccaucccguccgccaaggccaguauccugcacgaggugaagcccgucacguccggcugcuuccccaucaugcacgaccggaccaagauccgccagcugcccaaccuccugcggggguacgagaacauccgccugucgacccacaacgugaucaacgcggagaccgccccgggcgggcccuacaagaucggcacguccgggagcugccccaacaucaccaacggcaacggcuucuucgccaccauggccugggcggugcccaagaaugacaacaacaagaccgccacgaacccgcucaccgucgaggugcccuacaucugcaccgagggggaggaccagaucaccguguggggcuuccacuccgacaacgagacgcagauggucaagcuguacggggacucgaagccccagaaguucaccuccucggccaacggcgugaccgcccacuacgugucccagaucggcggguuucccaaccaggccgaggacggcgggcugccgcagucgggccggaucgucguggacuacauggugcagaaguccgggaagaccggcacgaucaccuaccagcgcggcauccuccugccccagaaggucuggugcgcgagcgggcgguccaaggugaucaagggcucgcugccccucaucggggaggccgacugccugcacgagaaguacggcgggcugaacaagucgaagcccuacuacaccggcgagcacgccaaggccaucggcaacugcccgaucugggugaagacgccccucaagcuggccaaugggaccaaguaccgcccgcccgcgaagcugcucaaggagcggggcuucuucggggccaucgccggcuuccuggagggcgggugggagggcaugaucgccggguggcacggcuacaccucccacggggcccacggcgucgcgguggccgccgaccugaaguccacccaggaggccaucaacaagaucaccaagaaccucaacucccugagcgagcuggaggucaagaaccuccagcgccuguccggcgccauggacgagcugcacaacgagauccucgagcuggacgagaagguggacgaucugcgggcggacacgaucucgucccagaucgagcucgccgugcugcugucgaacgaggggaucaucaacuccgaggacgagcaccuccuggcccuggagcgcaagcucaagaagaugcugggccccucggccgucgacaucgggaacggcugcuucgagaccaagcacaagugcaaccagaccugccuggaccggaucgcggccgggaccuucaacgccggcgaguucucccuccccaccuuugacagccugaacaucacggccgccucccugaacgacgacggccucgacaaccacaccauccugcuguacuacucgaccgcggccuccucgcuggccgugacccucaugaucgccaucuucaucguguacauggucucccgcgacaacgugagcugcuccaucugccuguga

SEQ ID NO: 14236 - RNA, 1752 nt, Artificial Sequence
  derived and/or modified CDS sequence (AUadapt) from InfluenzaB__ABN50624__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaagucccauuucgccaaccugaaggggacgaagacccggggcaagcucugccccaacugccugaacugcaccgaccuggacguggcccucgggcgccccauguguaucggcaccaucccguccgccaaggccagcauccugcacgaggugcggcccgucacguccggcugcuuccccaucaugcacgaccgcaccaagauccggcagcugcccaaccuccugcgcggguacgagaacauccggcugaguacccacaacgugaucaacgcggagcgcgccccgggcgggcccuaccggcucggcaccuccgggagcugccccaacgugacguccaagagcggcuuuuucgccaccauggccugggcggucccccgcgacaacaagaccgccaccaacccgcugacgguggaggugcccuacaucugcaccaagggcgaggaccagaucaccgucuggggguuccacuccgauaacaagaaccagaugaagaaccuguacggcgacagcaacccccagaaguucaccuccucggugaauggggugacgacccacuacgucucccagaucggcggcuuccccaaccagaccgaggacgggggccucccgcagagcgggcggaucgugguggacuacaugguccagaagcccggcaagaccgggacgaucguguaucagcgcggcgugcugcugccccagaaggucuggugcgccuccggccggagcaaggugaucaaggggagccucccccugaucggcgaggccgacugccugcacgagaaguacgggggccucaacaaguccaagccguacuauaccggggagcacgccaaggcgaucggcaacugccccaucugggucaagacgccccugaagcuggccaacggcaccaaguaccggcccccggccaagcuccugaaggagcgcggguucuucggcgccaucgccggguuccuggagggcgggugggagggcaugaucgcgggcuggcacggguauaccagccacggcgcccacgggguggccguggccgccgaccucaaguccacccaggaggcgaucaacaagaucaccaagaaccugaacucgcuguccgagcucgaggucaagaaucugcagcgccugagcggcgccauggacgagcuccacaacgagauccuggagcuggacgagaagguggacgaccuccgggccgacaccaucuccagccagaucgagcuggccgugcugcucuccaaugagggcaucaucaacagcgaggacgagcaccuccuggcccuggagcgcaagcugaagaagaugcuggggcccuccgcggucgacaucggcaacgggugcuucgagacgaagcacaaguguaaccagaccugccucgaccggaucgccgccggcaccuucaacgccggggaguucucgcugcccaccuucgauucccugaacaucaccgcggccagccucaacgacgacggccuggacaaccacacgauccugcuguacuauuccaccgccgccagcucccucgccgugacccugaugaucgcgaucuucaucguguacauggucagccgcgacaacguguccugcagcaucugccuguga

SEQ ID NO: 14237 - RNA, 1752 nt, Artificial Sequence
  derived and/or modified CDS sequence (AUadapt) from InfluenzaB__ABN50635__HA
augaaggccaucaucgugcugcucauggucgugaccaguaacgccgaccgcaucugcaccggcaucacguccagcaacaguccccacguggucaagaccgcgacccagggggaggugaacgugaccggcgucaucccgcugacgaccacccccaccaagucccacuucgccaaccugaaggggacgaagacccggggcaagcucugccccaauugccugaacugcaccgaccuggacguggcccucgggcgccccaugugcaucggcaccaucccguccgccaaggccaguauccugcacgaggugcggcccgucacguccggcugcuuccccaucaugcacgaccgcaccaagauccggcagcugcccaaccuccugcgcggguaugagcacauccggcugagcacccacaacgugaucaacgcggagcgcgccccgggcgggcccuaccggcucggcaccuccgggaguugccccaacgugacgucccgcagcggcuucuucgccaccauggccugggcggucccccgggacaauaagaccgccaccaacccgcugacgguggaggugcccuacaucugcaccaagggcgaggaccagaucaccgucuggggguuccacuccgauagcaagacccagaugaagaaccuguacggcgacuccaacccccagaaguuuacgagcuccgccaacggggugaccacccacuacgugagccagaucggcggcuuccccaaucagaccgaggacgggggccucccgcaguccgggcgcaucgucguggacuacauggugcagaagcccggcaagacggggaccaucgucuaccagcggggcgugcugcugccccagaagguguggugcgccagcggccgcaguaaggucaucaaggggucccucccccugaucggcgaggccgacugccugcacgagaaguacgggggccucaacaagagcaagccguauuacaccggggagcacgcgaaggccaucggcaacugccccaucugggugaagacgccccugaagcuggccaacggcaccaaguaccggcccccggccaagcuccugaaggagcgcggguuuuucggcgccaucgcgggguuccuggagggcgggugggagggcaugaucgccggcuggcacggguacaccucccacggcgcccacggggucgccguggccgcggaucucaagagcacccaggaggccaucaacaagaucaccaagaaccugaacucccugagcgagcucgaggugaagaaccugcagcggcuguccggcgccauggaugagcuccacaacgagauccuggagcuggacgagaaggucgacgaccuccgcgccgauacgaucagcucccagaucgagcuggccgugcugcucagcaacgagggcaucaucaacuccgaggacgagcaccuccuggcgcuggagcggaagcugaagaagaugcuggggcccagugccguggacaucggcaacgggugcuucgagaccaagcacaagugcaaucagaccugccucgaccgcaucgccgccggcaccuucaacgcgggggaguucucccugcccaccuucgauagccugaacaucacggccgccucccucaacgacgacggccuggacaaucacaccauccugcuguacuacagcaccgccgccuccagccucgcggucacccugaugaucgccaucuucaucguguauauggugucccgggacaacgucagcugcagcaucugccuguga

SEQ ID NO: 14238 - RNA, 1752 nt, Artificial Sequence
  derived and/or modified CDS sequence (AUadapt) from InfluenzaB__ABN50646__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaagucccacuucgccaaccugaaggggacgaagacccggggcaagcucugccccaacugccugaauugcaccgaccuggacguggcccucgggcgccccaugugcaucggcaccaucccguccgccaaggccagcauccugcacgaggugcggcccgucacguccggcuguuuccccaucaugcacgaccgcaccaagauccggcagcugcccaaccuccugcgcggguacgagcacauccggcugagcacccauaacgugaucaacgcggagcgcgccccgggcgggcccuaccggcucggcaccuccgggagcugccccaacgugacgucccgcagcggcuuuuucgccaccauggccugggcggucccccgggacaacaagaccgccaccaacccgcugacgguggaggugcccuacaucugcaccaagggcgaggaucagaucaccgucuggggguuccacuccgacaacaagaaccagaugaagaaccuguacggcgauagcaacccccagaaguucaccuccagcgccaacggggugacgacccacuacgugucccagaucggcggcuuucccaaccagaccgaggacgggggccucccgcagagcgggcgcaucgucguggacuacauggugcagaagcccggcaagaccgggacgaucgucuaccagcggggcgugcugcugccccagaagguguggugugccuccggccgcagcaaggucaucaaggggucgcucccccugaucggcgaggccgacugccugcacgagaaguacgggggccucaacaaguccaagccguauuacaccggggagcacgcgaaggccaucggcaacugccccaucugggugaagacgccccugaagcuggccaacggcaccaaguaccggcccccggccaagcuccugaaggagcgcggguuuuucggcgccaucgcgggguuccuggagggcgggugggagggcaugaucgccggcuggcacggguacaccagccacggcgcccacggggucgccguggccgcggaucucaaguccacccaggaggccaucaacaagaucaccaagaaccugaacagccuguccgagcucgaggugaagaaccugcagcggcugagcggcgccauggacgagcuccauaacgagauccuggagcuggacgagaaggucgacgaccuccgcgccgacaccaucuccagccagaucgagcuggccgugcugcucuccaaugagggcaucaucaacagcgaggacgagcaccuccuggcgcuggagcggaagcugaagaagaugcuggggcccuccgccguggacaucggcaacgggugcuuugagacgaagcacaagugcaaccagaccugccucgaccgcaucgccgccggcaccuucaacgcgggggaguuuagccugcccaccuucgacucccugaacaucaccgccgccagccucaacgaugacggccuggacaaccacacgauccugcuguacuacuccaccgccgccagcucccucgcggucacccugaugaucgccaucuuuaucguguacauggugagccgggacaacgucuccugcagcaucugccuguga

SEQ ID NO: 14239 - RNA, 1752 nt, Artificial Sequence
  derived and/or modified CDS sequence (AUadapt) from InfluenzaB__ABN50657__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaagucccacuucgccaaccugaaggggacgaagacccggggcaagcucugccccaacugccugaauugcaccgaccuggacguggcccucgggcgccccaugugcgugggcaucaccccguccgccaaggccagcauccugcacgagguccggcccgugacguccggcugcuuucccaucaugcacgaccgcaccaagauccggcagcugcccaaccuccugcgcggguacgagaacauccggcugagcacccagaacgugaucaaugcggagaaggccccgggcgggcccuaccgccucggcaccuccgggagcugccccaacgucacgucccggaccggcuucuucgccaccauggccugggcggugccccgcgacaauaagaccgccacgaacccgcugaccguggagguccccuacaucugcaccaagggcgaggaccagaucaccguguggggguuccacagcgauaacaagacgcagaugaagaaccuguacggcgacuccaacccccagaaguucaccucguccgccaauggggugaccacccacuacgucagccagaucggcggcuuccccgaccagacggaggacgggggccucccgcaguccgggcggaucgugguggacuauaugguccagaagcccggcaagaccgggaccaucguguaccagcgcggcauccugcugccccagaagguguggugcgccagcggccgguccaaggucaucaaggggagccucccccugaucggcgaggccgacugccugcacgagaaguaugggggccucaacaagagcaagccguacuacaccggggagcacgcgaaggccaucggcaacugucccaucugggugaagacgccccugaagcuggccaacggcaccaaguaccggcccccggccaagcuccugaaggagcgcggguucuucggcgccaucgcgggguuccuggagggcgggugggagggcaugaucgccggcuggcacggguacaccucccauggcgcccacggggucgccguggccgcggaccucaagagcacccaggaggccaucaacaagaucacgaagaaccugaacucccugagcgagcucgaggugaagaaucugcagcgccuguccggcgccauggacgagcuccacaacgagauccuggagcuggacgagaaggucgacgaccuccgggccgacaccaucaguucccagaucgagcuggccgugcugcucagcaacgagggcaucaucaacuccgaggacgagcaccuccuggcgcuggagcgcaagcugaagaagaugcuggggcccagcgccguggacaucggcaaugggugcuucgagaccaagcacaagugcaaccagaccugccucgaccggaucgccgccggcaccuuuaacgcgggggaguucucccugcccacguucgacagccugaacaucaccgccgccucccucaacgaugacggccuggacaaccacaccauccugcuguacuacagcaccgccgccuccagucucgcggucacgcugaugaucgccaucuucaucguguacauggugucccgcgacaacgucagcugcuccaucugccuguga

SEQ ID NO: 14240 - RNA, 1755 nt, Artificial Sequence
  derived and/or modified CDS sequence (AUadapt) from InfluenzaB__ABN50679__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaagucccacuucgccaaccugaaggggacgaagacccggggcaagcucugccccaacugucugaacugcaccgaccuggacguggcccucgggcgccccaugugcgugggcaccacgccguccgccaaggccagcauccugcaugagguccggcccgugaccuccggcugcuuccccaucaugcacgaccgcaccaagauccggcagcugcccaaccuccugcgcggguacgagaauauccggcugagcacccagaacgugaucaacgcggagaaggccccgggcgggcccuaccgccucggcacguccgggagcugccccaacgccaccucccggaguggcuucuucgccaccauggcgugggccgucccccgcgacaacaacaagaccgccacgaacccgcugaccguggaggugcccuauaucugcaccaagggcgaggaccagaucaccgucuggggguuccacuccgacgacaagacgcagaugaagaaucuguacggcgacucgaacccccagaaguucaccuccagcgccaauggggugaccacccacuacgugucccagaucggcggcuuccccgaccagacggaggacgggggccucccgcagagcgggcggaucgucguggauuacauggugcagaagcccggcaagaccgggaccaucgucuaccagcgcggcgugcugcugccccagaagguguggugcgccuccggccggagcaaggucaucaaggggagccucccccugaucggcgaggcggacugccugcaugagaaguacgggggccucaacaaguccaagccguacuacaccggggagcacgccaaggccaucggcaacugucccaucugggugaagacgccccugaagcuggccaacggcaccaaguaccggcccccggccaagcuccugaaggagcgcggguucuucggcgcgaucgccggguuccuggagggcgggugggagggcaugaucgccggcuggcacggguauaccagccacggcgcccacggggucgccguggcggccgaccucaaguccacccaggaggccaucaacaagaucacgaagaaccugaauagccuguccgagcucgaggugaagaaccugcagcgccugucgggcgccauggacgagcuccacaacgagauccuggagcuggaugagaaggucgacgaccuccgggccgacaccaucuccagccagaucgagcuggcggugcugcucuccaacgagggcaucaucaacagcgaggaugagcaccuccuggcccuggagcgcaagcugaagaagaugcuggggcccuccgccguggacaucggcaacgggugcuucgagaccaagcacaaguguaaccagaccugccucgaccggaucgccgcgggcaccuucaacgccggggaguucagucugcccacguucgacucccugaacaucaccgccgccagccucaacgacgauggccuggacaaccacaccauccugcuguacuacuccaccgccgcgagcucccucgccgucacgcugaugaucgccaucuuuaucguguacauggugagccgcgacaacgucuccugcagcaucugccuguga

SEQ ID NO: 14241 - RNA, 1755 nt, Artificial Sequence
  derived and/or modified CDS sequence (AUadapt) from InfluenzaB__ABN50690__HA
augaaggccaucaucgugcugcucauggucgugaccaguaacgccgaccgcaucugcaccggcaucacguccagcaacaguccccacguggucaagaccgcgacccagggggaggugaacgugaccggcgucaucccgcugacgaccacccccaccaagucccacuucgccaaccugaaggggacgaagacccggggcaagcucugccccaauugccugaacugcaccgaccuggacguggcccucgggcgccccaugugcgugggcaccacgccguccgccaaggccaguauccugcacgagguccggcccgugaccuccggcugcuuccccaucaugcacgaccgcaccaagauccggcagcugcccaaccuccugcgcggguaugagaacauccggcugagcacccagaacgugaucaacgcggagaaggccccgggcgggcccuaccgccucggcacguccgggagcugucccaacgccaccucccggagcggcuucuucgccaccauggcgugggccgucccccgcgacaacaauaagaccgccacgaacccgcugaccguggaggugcccuacgucugcaccgagggcgaggaccagaucaccguguggggguuccacuccgauaacaagacgcagaugaagaaccuguacggcgacagcaauccccagaaguucaccuccagcgccaacggggugaccacccacuacgucucccagaucggcggcuuccccgaucagacggaggacgggggccucccgcagagcgggcggaucgugguggacuacaugguccagaagcccggcaagaccgggaccaucguguaccagcgcggcgugcugcugccccagaaggucuggugcgccuccggccggaguaaggugaucaaggggucgcucccccugaucggcgaggcggacugccugcacgagaaguacgggggccucaacaaguccaagccguauuacaccggggagcacgccaaggccaucggcaacugccccaucugggucaagacgccccugaagcuggccaacggcaccaaguaccggcccccggccaagcuccugaaggagcgcggguuuuucggcgcgaucgccggguuccuggagggcgggugggagggcaugaucgccggcuggcacggguacaccagccacggcgcccaugggguggccguggcggccgaccucaaguccacccaggaggccaucaacaagaucacgaagaaccugaacagccuguccgagcucgaggucaagaaccugcagcgccugaguggcgccauggacgagcuccacaacgagauccuggagcuggacgagaagguggacgaucuccgggccgacaccaucuccagccagaucgagcuggcggugcugcucuccaacgagggcaucaucaacagcgaggacgagcaucuccuggcccuggagcgcaagcugaagaagaugcuggggcccuccgccgucgacaucggcaacgggugcuucgagaccaagcacaagugcaaucagaccugccucgaccggaucgccgcgggcaccuucaacgccggggaguucagccugcccacguuugacucccugaacaucaccgccgccagccucaacgacgacggccuggauaaccacaccauccugcuguacuacuccaccgccgcgagcucccucgccgugacgcugaugaucgccaucuucaucguguauauggucagccgcgacaacguguccugcagcaucugccuguga

SEQ ID NO: 14242 - RNA, 1752 nt, Artificial Sequence
  derived and/or modified CDS sequence (AUadapt) from InfluenzaB__ABN50701__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaagucccacuucgccaaccugaaggggacgaagacccggggcaagcucugccccaacugucugaacugcaccgaccuggacguggcccucgggcgccccaugugcgugggcaucaccccguccgccaaggccagcauccugcacgagguccggcccgugacguccggcuguuuccccaucaugcacgaccgcaccaagauccggcagcugcccaaccuccugcgcggguacgagaacauccggcugaguacccagaacgugaucaacgcggagaaggccccgggcgggcccuaccgccucggcaccuccgggagcugccccaacgucacgucccggaccggcuucuuugccaccauggccugggcggugccccgcgacaacaagaccgccacgaacccgcugaccguggagguccccuacaucugcaccaagggcgaggaccagaucaccguguggggguuucacagcgacaacaaggcccagaugaagaaccuguacggcgacuccaauccccagaaguucacgagcuccgccaacggggugaccacccacuacgucagccagaucggcggcuuucccgaccagaccgaggacgggggccucccgcaguccgggcggaucgugguggacuacaugguccagaagcccggcaagacggggaccaucguguaccagcgcggcauccugcugccccagaagguguggugcgccagcggccgguccaaggucaucaaggggagucucccccugaucggcgaggcggacugccugcacgagaaguacgggggccucaacaagagcaagccguauuacaccggggagcacgccaaggccaucggcaacugccccaucugggugaagacgccccugaagcuggccaacggcaccaaguaccggcccccggccaagcuccugaaggagcgcggguucuuuggcgcgaucgccggguuccuggagggcgggugggagggcaugaucgccggcuggcacggguacaccucccacggcgcccacggggucgccguggcggccgaccucaagaguacccaggaggccaucaacaagaucaccaagaaccugaacucccugagcgagcucgaggugaagaaccugcagcgccuguccggcgccauggacgagcuccacaaugagauccuggagcuggacgagaaggucgacgaccuccgggccgacacgaucagcucccagaucgagcuggcggugcugcucagcaaugagggcaucaucaacuccgaggacgagcaccuccuggcccuggagcgcaagcugaagaagaugcuggggcccagcgccguggacaucggcaacgggugcuuugagaccaagcacaagugcaaccagaccugccucgaccggaucgccgcgggcaccuucaaugccggggaguucucccugcccaccuucgacagccugaacaucacggccgccucccucaacgacgauggccuggacaaccacaccauccugcuguacuacagcaccgccgcguccagucucgccgucacccugaugaucgccaucuucaucguguacauggugucccgcgacaacgucagcugcuccaucugccuguga

SEQ ID NO: 14243 - RNA, 1755 nt, Artificial Sequence; identical to SEQ ID NO: 14241
  derived and/or modified CDS sequence (AUadapt) from InfluenzaB__ABN50712__HA

SEQ ID NO: 14244 - RNA, 1755 nt, Artificial Sequence
  derived and/or modified CDS sequence (AUadapt) from InfluenzaB__ABN50723__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaagucccacuucgccaaccugcgggggacgaagacccgcggcaagcucugcccgaccugccugaauugcaccgaccuggacguggcccucgggcggcccaugugcgugggcacgacccccuccgccaaggccagcauccugcacgagguccgccccgugaccuccggcugcuuucccaucaugcacgaccggaccaagauccgccagcugcccaaccuccugcggggguacgagaagauccgccugagcacgcagaacgugaucaaugcggagaaggccccgggcgggcccuaccggcucggcaccuccgggucgugccccaacgccaccucccgcagcggcuucuucgccaccauggcgugggccgucccccgggauaacaacaagacggccaccaacccgcugaccguggaggugcccuacaucugcaccaaggaggaggaccagaucacggucuggggcuuucacuccgacaacaagacccagaugaagaaccuguacggggacagcaauccccagaaguucaccuccagcgccaacggcgugaccacgcacuacgugucccagaucgggggcuuccccgaucagaccgaggacggcgggcucccgcagagcggccgcaucgucguggacuacauggugcagaagcccgggaagaccggcaccaucgucuaccagcgggggauccugcugccccagaagguguggugcgccuccggccgcagcaaggugaucaagggcagucucccccugaucggggaggcggacugccugcacgagaaguacggcgggcucaacaaguccaagccguacuauacgggcgagcacgccaaggccaucgggaacugccccaucugggucaagacgccccugaagcuggccaacggcaccaaguaccggcccccggccaagcuccugaaggagcgcggcuucuucggggcgaucgccggcuuucuggagggcgggugggaggggaugaucgccggcuggcacggcuacaccagccacggggcccacggcguggccgucgcggccgaccucaaguccacccaggaggccaucaauaagaucaccaagaaccugaacagccuguccgagcucgaggugaagaaccugcagcggcugagcggggccauggacgagcuccacaaugagauccuggagcuggacgagaagguggacgaccuccgcgccgacaccaucuccagccagaucgagcuggcgguccugcucuccaacgagggcaucaucaauucggaggacgagcaccuccuggcccuggagcggaagcugaagaagaugcugggccccuccgccguggacaucgggaacggcugcuucgagaccaagcauaagugcaaccagaccugccucgaccgcaucgccgcggggacguucaacgccggcgaguuuagccugcccaccuucgacucccugaacaucaccgccgccagccucaacgacgaugggcuggacaaccacaccauccugcuguacuacuccacggccgcgagcucccucgccgugacccugaugaucgccaucuuuaucgucuacaugaucagccgggacaacguguccugcagcaucugccuguga

SEQ ID NO: 14245 - RNA, 1755 nt, Artificial Sequence
  derived and/or modified CDS sequence (AUadapt) from InfluenzaB__ABN50734__HA
augaaggccaucaucgugcugcucauggucgugaccaguaacgccgaccgcaucugcaccggcaucacguccagcaacucgccccacguggucaagaccgcgacccagggggaggugaaugugaccggcgccaucccgcugacgaccacccccaccaagucccacuucgccaaccugaaggggacgaagacccggggcaagcucugcccgaccugccugaacugcaccgaccuggaugucgcccucgggcgccccaugugcgugggcaucacgcccuccgccaaggcgagcauccugcacgaggugcggcccgucaccuccggcugcuuccccaucaugcacgaccgcaccaagauccggcagcugcccaaccuccugcgcggguaugagaagauccggcugagcacccagaacgugaucaacgccgagaaggccccgggcgggcccuaccgccucggcacguccgggucgugccccaacgccaccucccggagcggcuuuuucaccaccauggcgugggccgugccccgcgacaacaacaagacggccaccaacccgcugaccgucgaggugccccacaucugcaccaaggaggaggaccagaucacgguguggggcuuucacuccgacgacaagacccagaugaagaaccuguacggggacagcaacccccagaaguuuaccuccucgaccaacggcaucacgacccacuacgucucccagaucgggggcuuccccgaccagaccgaggacggcgggcucccgcagagcggccggaucgugguggauuacaugguccagaagcccgggaagaccggcacgaucguguaccagcgcgggauccugcugccccagaagguguggugcgccuccggccggagcaaggucaucaagggcucgcucccccugaucggggaggccgacugccugcacgagaaguauggcgggcucaacaaguccaagccguacuacaccggcgagcacgcgaaggccaucgggaacugccccaucugggugaagacgccccugaagcuggccaacggcaccaaguaucggcccccggccaagcuccugaaggagcgcggcuucuucggggccaucgcgggcuuccuggagggcgggugggaggggaugaucgccggcuggcacggcuacaccagccacggggcccacggcguggccgucgccgcggaucucaaguccacccaggaggccaucaacaagaucaccaagaaccugaacucgcuguccgagcucgaggugaagaaccugcagcgccugagcggggccauggacgagcuccacaaugagauccuggagcuggacgagaaggucgacgaccuccgggccgacaccaucuccagccagaucgagcuggccgugcugcucuccaacgagggcaucaucaacucggaggaugagcaccuccuggcgcuggagcgcaagcugaagaagaugcugggccccuccgccguggacaucgggaacggcugcuucgagaccaagcacaagugcaaccagacgugucucgaccggaucgccgccgggaccuucaacgcgggcgaguucagccugcccaccuucgacucccugaacaucaccgccgccagucucaacgacgacgggcuggacaaccacacgauccugcuguacuacuccaccgccgccaguucccucgcggucacccugaugaucgccaucuucaucguguacaugaucagccgcgacaacguguccugcagcaucugccuguga

SEQ ID NO: 14246 - RNA, 1758 nt, Artificial Sequence
  derived and/or modified CDS sequence (AUadapt) from InfluenzaB__ABN50745__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagucgcacuucgccaaccugaaggggacgaagacccggggcaagcucugccccaagugccugaacugcaccgaccuggacguggcccucgggcgccccaagugcaccggcaacaucccguccgccaaggugagcauccugcacgagguccggcccgugacguccggcugcuuucccaucaugcacgaccgcaccaagauccggcagcugcccaaccuccugcgcggguacgagcacauccggcugucgacccacaacgugaucaacgccgagaaggcgccgggcgggcccuacaagaucggcaccuccgggucgugccccaacaucacgaacggcaacggcuucuucgccaccauggccugggccguccccaagaacgacaacaacaagaccgcgaccaacucccucacgaucgaggugccguacaucuguaccgagggggaggaccagaucaccguguggggcuuccacucggacaacgagacccagauggccaagcuguacggggacuccaagccccagaaguucacgagcuccgccaacggcgucaccacccacuacgugucgcagaucggcggguuccccaaccagaccgaggacggcgggcugccccaguccggccgcaucguggucgacuacauggugcagaaguccgggaagacgggcaccaucaccuaccagcggggcauccuccugccgcagaagguguggugcgccuccgggcgcucgaaggucaucaagggcucgcugccccucaucggggaggccgauugccugcacgagaaguacggcgggcugaacaaguccaagcccuacuacaccggcgagcacgcgaaggccaucggcaacugccccaucugggugaagacgccgcucaagcuggccaacgggaccaaguaccggccgcccgccaagcugcucaaggagcgcggcuucuucggggccaucgcgggcuuccuggagggcgggugggagggcaugaucgccggguggcacggcuacaccucgcacggggcccacggcguggccgucgccgcggaccugaaguccacccaggaggccaucaacaagaucacgaagaaccucaacagucuguccgagcuggaggugaagaaccuccagcggcugucgggcgccauggacgagcugcacaacgagauccucgagcuggacgagaaggucgacgaccugcgcgccgacaccaucuccucgcagaucgagcucgccgugcugcuguccaacgaggggaucaucaacucggaggacgagcaccuccuggcgcuggagcggaagcucaagaagaugcugggccccuccgccguggagaucgggaacggcugcuucgagaccaagcacaagugcaaccagaccugccuggaccgcaucgccgccgggaccuuuaacgcgggcgaguucagccuccccacguucgacucccugaacaucaccgccgccucgcugaacgacgacggccucgacaaccacaccauccugcuguacuacuccaccgccgccucgucccuggcggucacgcucaugaucgccaucuucgugguguacauggucucgcgggacaacguguccugcagcaucugccuguga

SEQ ID NO: 14247 - RNA, 1752 nt, Artificial Sequence
  derived and/or modified CDS sequence (AUadapt) from InfluenzaB__ABN51184__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaagucccauuucgccaaccugaaggggacgaagacccggggcaagcucugccccaacugccugaacugcaccgaccuggauguggcccucgggcgccccaugugcaucggcaccaucccguccgccaaggccagcauccugcacgaggugcggcccgucacguccggcugcuuccccaucaugcacgaccgcaccaagauccggcagcugcccaaccuccugcgcggguaugagaacauccggcugagcacccacaacgugaucaacgcggagcgcgccccgggcgggcccuaccggcucggcaccuccgggucgugccccaaugugacguccaagagcggcuucuucgccaccauggccugggcggucccccgcgacaacaagaccgccaccaacccgcugacgguggaggugcccuacaucugcaccaagggcgaggaucagaucaccgucuggggguuccacuccgacaacaagauccagaugaagaaccuguacggcgacagcaauccccagaaguucaccuccagcgccaacggggugacgacccacuacgugucccagaucggcggcuuccccaaccagaccgaggacgggggccucccgcagagugggcggaucgucguggacuacauggugcagaagcccggcaagaccgggacgaucgucuaccagcgcggcgugcugcugccccagaagguguggugcgccuccggccggagcaaggucaucaaggggucgcucccccugaucggcgaggccgacugccugcaugagaaguacgggggccucaacaaguccaagccguacuacaccggggagcacgcgaaggccaucggcaacugccccaucugggugaagacgccccugaagcuggccaacggcaccaaguaucggcccccggccaagcuccugaaggagcgcggguucuucggcgccaucgcgggguuccuggagggcgggugggagggcaugaucgccggcuggcacggguacaccagccacggcgcccacggggucgccguggccgcggaucucaaguccacccaggaggccaucaacaagaucaccaagaaccugaacagccuguccgagcucgaggugaagaaccugcagcgccugagcggcgccauggacgagcuccacaaugagauccuggagcuggacgagaaggucgacgaccuccgggccgacaccaucuccagccagaucgagcuggccgugcugcucuccaacgagggcaucaucaacucggaggaugagcaccuccuggcgcuggagcgcaagcugaagaagaugcuggggcccuccgccguggacaucggcaacgggugcuucgagacgaagcacaagugcaaccagaccugucucgaccggaucgccgccggcaccuucaacgcgggggaguucagccugcccaccuucgacucccugaacaucaccgccgccagucucaacgacgacggccuggacaaccacacgauccugcuguacuacuccaccgccgccaguucccucgcggucacccugaugaucgccaucuucaucguguacauggugagccgcgacaacgucuccugcagcaucugccuguga

SEQ ID NO: 14248 - RNA, 1752 nt, Artificial Sequence
  derived and/or modified CDS sequence (AUadapt) from InfluenzaB__ABN51195__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaagucccacuucgccaaccugaaggggacgaagacccggggcaagcucugccccaacugccugaacuguaccgaccuggacguggcccucgggcgccccaugugcaucggcaccaucccguccgccaaggccagcauccugcacgaggugcggcccgucacguccggcugcuuccccaucaugcacgaucgcaccaagauccggcagcugcccaaccuccugcgcggguacgagaacauccggcugagcacccacaacgugaucaacgcggagcgcgccccgggcgggcccuaucggcucggcaccuccgggagcugccccaacgugacgucccgcagcggcuucuucgccaccauggccugggcggucccccgggacaacaagaccgccaccaauccgcugacgguggaggugcccuacaucugcaccaagggcgaggaccagaucaccgucuggggguuccacuucgacaauaagauccagaugaagaaccuguacggcgacuccaacccccagaaguucaccagcuccgccaacggggugacgacccacuaugugagccagaucggcggcuuccccaaccagaccgaggacgggggccucccgcaguccgggcgcaucgucguggacuacauggugcagaagcccggcaagaccgggacgaucgucuaccagcggggcgugcugcugccccagaagguguggugugccagcggccgcuccaaggucaucaaggggagccucccccugaucggcgaggccgacugccugcacgagaaguacgggggccucaacaagagcaagccguauuacaccggggagcacgcgaaggccaucggcaacugccccaucugggugaagacgccccugaagcuggccaacggcaccaaguaccggcccccggccaagcuccugaaggagcgcggguucuuuggcgccaucgcgggguuccuggagggcgggugggagggcaugaucgccggcuggcacggguacaccucccacggcgcccacggggucgccguggccgcggaccucaagagcacccaggaggccaucaacaagaucaccaagaaucugaacucccugagcgagcucgaggugaagaaccugcagcggcuguccggcgccauggacgagcuccacaacgagauccuggagcuggacgagaaggucgaugaccuccgcgccgacaccaucagcucccagaucgagcuggccgugcugcucagcaacgagggcaucaucaacuccgaggacgagcaccuccuggcgcuggagcggaagcugaagaagaugcuggggcccagugccguggacaucggcaacgggugcuucgagacgaagcacaagugcaaccagaccugucucgaccgcaucgccgccggcaccuucaacgcgggggaguucucccugcccaccuucgacagccugaacaucaccgccgccucccucaaugacgacggccuggacaaccacacgauccugcuguacuacaguaccgccgccuccagccucgcggucacccugaugaucgccaucuucaucguguacauggugucccgggacaacgucagcugcuccaucugccuguga

SEQ ID NO: 14249 - RNA, 1758 nt, Artificial Sequence
  derived and/or modified CDS sequence (AUadapt) from InfluenzaB__ABN58661__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcacgaucccguccgccaaggugaguauccugcacgaggucaagcccgugaccuccggcugcuuccccaucaugcacgaccggaccaagauccgccagcugcccaaccuccugcggggguacgagcacauccgccugucgacccacaacgugaucaacgccgagaaggcgccgggcgggcccuacaagaucggcacguccgggucgugccccaacgucaccaacggcaacggcuucuucgccaccauggccugggccgugcccaagaaugacaacaacaagaccgcgacgaacucccucaccguggaggucccguacaucugcaccgagggggaggaccagaucaccguguggggcuuccacagcgacaacgagacgcagauggccaagcuguacggggacuccaagccccagaaguucaccucguccgccaacggcgugaccacccacuacgucagucagaucggcggguuccccaaccaggccgaggacggcgggcugccccaguccggccggaucgugguggacuacaugguccagaaguccgggaagacgggcaccaucaccuaccagcgcggcauccuccugccgcagaagguguggugcgccuccgggcggagcaaggugaucaagggcucgcugccccucaucggggaggcggacugccugcacgagaaguacggcgggcugaacaaguccaagcccuacuacaccggcgagcacgccaaggccaucggcaacugccccaucugggucaagacgccgcucaagcuggccaacgggaccaaguaucgcccgcccgccaagcugcucaaggagcggggcuucuucggggcgaucgccggcuuccuggagggcgggugggagggcaugaucgccggguggcacggcuacaccucgcacggggcccacggcguggccgucgcggccgaccugaaguccacccaggaggccaucaacaagaucacgaagaaccucaacucgcuguccgagcuggaggugaagaaccuccagcgccugagcggcgccauggacgagcugcacaacgagauccucgagcuggacgagaagguggaugaccugcgggccgacaccaucuccucgcagaucgagcucgcgguccugcuguccaacgaggggaucaucaacucggaggacgagcaccuccuggcccuggagcgcaagcucaagaagaugcugggccccuccgccguggagaucgggaacggcugcuucgagaccaagcacaagugcaaccagaccugccuggaccggaucgccgcggggaccuucaacgccggcgaguucucgcuccccacguuugacucccugaacaucaccgccgccagccugaacgacgacggccucgacaaccacaccauccugcuguacuacuccaccgccgcgucgucccuggccgugacgcucaugaucgccaucuucaucgucuacauggugucgcgcgacaacguguccugcagcaucugccuguga

SEQ ID NO: 14250 - RNA, 1755 nt, Artificial Sequence; identical to SEQ ID NO: 14138
  derived and/or modified CDS sequence (AUadapt) from InfluenzaB__ABN59445__HA

SEQ ID NO: 14251 - RNA, 1755 nt, Artificial Sequence
  derived and/or modified CDS sequence (AUadapt) from InfluenzaB__ABO72377__HA
augaaggccaucaucgugcugcucauggucgugaccaguaacgccgaccgcaucugcaccggcaucacguccagcaacucgccccacguggucaagaccgcgacccagggggaggugaacgugaccggcgccaucccgcugacgaccacccccaccaagucccauuucgccaaccugaaggggacgaagacccggggcaagcucugcccgaccugcuucaacugcaccgaccuggacgucgcccuggggcgccccaugugugugggcaucacgcccuccgccaaggcgagcauccuccacgaggugcggcccgucaccuccggcugcuuccccaucaugcacgaccgcaccaagauccggcagcugcccaaccugcuccgcggguacgagaagauccggcugaguacccagaacgugaucgacgccgagaaggccccgggcgggcccuaccgccugggcacguccgggucgugccccaacgccaccuccaagagcggcuucuucgcgaccauggccugggccgugccccgggauaacaacaagaccgccacgaacccgcucaccgucgaggugccccacaucugcaccaaggaggaggaccagaucaccguguggggcuuccacuccgauaacaagacgcagaugaagaaccuguacggggacagcaacccccagaaguucaccuccucggccaacggcaucaccacccauuacgucucccagaucgggggcuuccccgaccagacggaggacggcgggcugccgcagagcggccgcaucgugguggacuacaugguccagaagcccgggaagaccggcaccaucguguaccagcgggggauccuccugccccagaagguguggugugcguccggccgcagcaaggucaucaagggcucgcugccccucaucggggaggccgacugccugcacgagaaguacggcgggcugaacaaguccaagccguacuacaccggcgagcaugccaaggccaucgggaacugccccaucugggugaagacgccccucaagcuggccaacggcaccaaguaccggcccccggcgaagcugcucaaggagcgcggcuucuucggggccaucgccggcuuccuggagggcgggugggaggggaugaucgccggcuggcacggcuauaccagccacggggcccacggcguggcggucgccgccgaccugaaguccacccaggaggccaucaacaagaucacgaagaaccucaacucgcuguccgagcuggaggugaagaaccuccagcggcugaguggggccauggacgagcugcacaacgagauccucgagcuggacgagaaggucgacgaccugcgcgcggacaccaucuccagccagaucgagcucgccgugcugcuguccaaugagggcaucaucaacucggaggacgagcaccuccuggcccuggagcggaagcucaagaagaugcugggccccuccgccguggacaucgggaacggcugcuucgagaccaagcacaaguguaaccagaccugccuggaccgcaucgcggccgggaccuucaacgccggcgaguucagccuccccacguucgauucccugaacaucaccgccgccagccugaacgacgacgggcucgacaaccacaccauccugcuguacuauuccaccgcggccucgucccuggccgucacgcucaugaucgccaucuucaucguguacaugaucagccgggacaacguguccugcagcaucugccuguga

SEQ ID NO: 14252 - RNA, 1755 nt, Artificial Sequence; identical to SEQ ID NO: 14145
  derived and/or modified CDS sequence (AUadapt) from InfluenzaB__ABR15973__HA

SEQ ID NO: 14253 - RNA, 1752 nt, Artificial Sequence
  derived and/or modified CDS sequence (AUadapt) from InfluenzaB__ABR15995__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaagucccacuucgccaaccugaaggggacgaagacccggggcaagcucugccccaacugccugaauugcaccgaccuggacguggcccucgggcgccccaugugcaucggcaucaccccguccgccaaggccagcauccugcacgaggugcggcccgucacguccggcuguuuccccaucaugcacgaccgcaccaagauccggcagcugcccaaccuccugcgcggguacgagcacauccggcugagcacccauaacgugaucaacgcggagcgcgccccgggcgggcccuaccggcucggcaccuccgggagcugccccaacgugacgucccgcaguggcuucuucgccaccauggccugggcggucccccgggacaacaagaccgccaccaacccgcugacgguggaggugcccuacaucugcaccaagggcgaggaucagaucaccgucuggggguuccacuccgacuacaagacccagaugaagaaccuguacggcgacaguaacccccagaaguucacguccagcgccaacgggaucaccacccacuacgugucccagaucggcggcuuucccaaccagaccgaggacgggggccucccgcagagcgggcgcaucguggucgacuacauggugcagaagcccggcaagacggggaccaucguguaccagcggggcguccugcugccccagaagguguggugcgccuccggccgcaguaaggugaucaaggggagccucccccugaucggcgaggccgacugccugcacgagaaguacgggggccucaacaaguccaagccguauuacaccggggagcacgcgaaggccaucggcaacugccccaucugggucaagacgccccugaagcuggccaacggcaccaaguaccggcccccggccaagcuccugaaggagcgcggguucuuuggcgccaucgcgggguuccuggagggcgggugggagggcaugaucgccggcuggcacggguacaccagccacggcgcccacgggguggccgucgccgcggaucucaaguccacccaggaggccaucaacaagaucaccaagaaccugaacagccuguccgagcucgaggugaagaaccugcagcggcugagcggcgccauggacgagcuccauaacgagauccuggagcuggacgagaagguggacgaccuccgcgccgacacgaucuccagccagaucgagcuggccguccugcucuccaacgagggcaucaucaauagcgaggacgagcaccuccuggcgcuggagcggaagcugaagaagaugcuggggcccuccgccguggacaucggcaacgggugcuuugagaccaagcacaagugcaaccagaccugccucgaccgcaucgccgccggcaccuucaacgcgggggaguuuagccugcccaccuucgacucccugaacaucacggccgccagccucaacgaugacggccuggacaaccacaccauccugcuguacuacuccaccgccgccagcucccucgcggugacccugaugaucgccaucuuuaucgucuacauggugagccgggacaacguguccugcagcaucugccuguga

SEQ ID NO: 14254 - RNA, 1758 nt, Artificial Sequence
  derived and/or modified CDS sequence (AUadapt) from InfluenzaB__ABR16017__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugucccaagugccugaacugcaccgaccuggacguggcccucgggcgccccaagugcaccggcaacaucccguccgcccgggugagcauccugcacgagguccgccccgugacguccggcugcuuccccaucaugcacgaucggaccaagauccgccagcugcccaaccuccugcggggguacgagcacauccgccugucgacccacaacgugaucaacgccgagaacgcgccgggcgggcccuacaagaucggcaccuccgggagcugccccaacgucacgaauggcaacggcuucuucgccaccauggccugggccgugcccaagaacgacaacaacaagaccgcgaccaacucccucacgaucgaggugccguacaucugcaccgagggggaggaccagaucaccgucuggggcuuccacagugacaacgagacccagauggccaagcuguacggggacuccaagccccagaaguucacgagcuccgccaacggcgugaccacccacuacgugucgcagaucggcggguuccccaaccagaccgaggauggcgggcugccccaguccggccggaucgucguggacuacauggugcagaaguccgggaagacgggcaccaucaccuaccagcgcggcauccuccugccgcagaaggucuggugcgccuccgggcggagcaaggugaucaagggcucgcugccccucaucggggaggccgacugccugcacgagaaguacggcgggcugaacaaguccaagcccuacuauaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccucgcacggggcccauggcgucgccguggccgcggaccugaaguccacccaggaggccaucaacaagaucacgaagaaccucaacagccuguccgagcuggaggucaagaaccuccagcgccugucgggcgccauggacgagcugcacaacgagauccucgagcuggacgagaagguggacgaccugcgggccgauaccaucuccagccagaucgagcucgccgugcugcuguccaacgaggggaucaucaacucggaggacgagcaccuccuggcgcuggagcgcaagcucaagaagaugcugggccccuccgccgucgagaucgggaacggcugcuucgagaccaagcacaagugcaaccagaccugucuggaccggaucgccgccgggaccuucgacgcgggcgaguucagccuccccacguucgacucccugaacaucaccgccgccucgcugaacgacgacggccucgauaaccacaccauccugcuguacuacuccaccgccgccagcucccuggcggugacgcucaugaucgccaucuucguggucuacauggugucgcgcgacaacguguccugcagcaucugccuguga

SEQ ID NO: 14255 - RNA, 1758 nt, Artificial Sequence; identical to SEQ ID NO: 14254
  derived and/or modified CDS sequence (AUadapt) from InfluenzaB__ACA64899__HA

SEQ ID NO: 14256 - RNA, 1758 nt, Artificial Sequence
  derived and/or modified CDS sequence (AUadapt) from InfluenzaB__ACA64932__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucuccaaccugaaggggacggagacccggggcaagcucugccccaagugccugaacugcaccgaccuggauguggcccucgggcgccccaagugcaccggcaacaucccgucggcccggguguccauccugcacgagguccgccccgugacgagcggcugcuuccccaucaugcacgaccggaccaagauccgccagcugcccaaccuccugcggggguacgagcacauccgccuguccacccacaacgugaucaacgccgagaacgccccgggcgggcccuacaagaucggcaccaguggguccugccccaacgucacgaacggcaacggcuucuucgcgaccauggccugggccgugcccaagaacgacaucaacaagaccgccaccaacagccucacgaucgaggugccguacaucugcaccgagggggaggaccagaucaccgucuggggcuuccacuccgacaaugagacccagauggcgaagcuguacggggacucgaagccccagaaguucacguccucggccaacggcgugaccacccacuacgugucccagaucggcggguuccccaaccagaccgaggacggcgggcugccccagagcggccggaucgucguggacuacauggugcagaaguccgggaagacgggcaccaucaccuaccagcgcggcauccuccugccgcagaaggucuggugcgccucggggcggagcaaggugaucaagggcucccugccccucaucggggaggccgauugccugcacgagaaguacggcgggcugaacaagucgaagcccuacuacaccggcgagcacgccaaggcgaucggcaacugccccaucugggugaagacgccgcucaagcuggccaacgggaccaaguaccgcccgcccgccaagcugcucaaggagcggggcuucuucggggccaucgccggcuuccuggagggcgggugggagggcaugaucgcgggguggcacggcuacaccucccauggggcccacggcgucgccguggccgccgaccugaaguccacccaggaggcgaucaacaagaucacgaagaaccucaacucccugucggagcuggaggucaagaaccuccagcgccuguccggcgccauggacgagcugcacaacgagauccucgagcuggacgagaagguggacgaccugcgggccgacaccaucagcucccagaucgagcucgccgugcugcugucgaacgaggggaucaucaauuccgaggacgagcaccuccuggcccuggagcgcaagcucaagaagaugcugggccccagcgcggucgagaucgggaacggcugcuucgagaccaagcacaagugcaaccagaccugccuggacaagaucgccgccgggaccuucgacgccggcgaguucucccuccccacguucgacucgcugaauaucaccgcggccucccugaacgacgacggccucgacaaccacaccauccugcuguacuacucgaccgccgccuccagccuggccgugacgcucaugaucgcgaucuucguggucuacauggugucccgggacaacgugucgugcagcaucugccuguga

SEQ ID NO: 14257 - RNA, 1758 nt, Artificial Sequence; identical to SEQ ID NO: 14254
  derived and/or modified CDS sequence (AUadapt) from InfluenzaB__ACA64943__HA

SEQ ID NO: 14258 - RNA, 1758 nt, Artificial Sequence
  derived and/or modified CDS sequence (AUadapt) from InfluenzaB__ACA64954__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccacuucgccaaucugaaggggacggagacccggggcaagcucugccccaagugccugaacugcaccgaccuggacguggcccucgggcgccccaagugcaccggcaacaucccguccgcccgggugucgauccugcacgagguccgccccgugacguccggcugcuuucccaucaugcacgaccggaccaagauccgccagcugcccaaccuccugcggggguacgagcacauccgccugagcacccacaacgugaucaacgccgagaacgcgccgggcgggcccuacaagaucggcaccuccgggaguugccccaacgucacgaacggcaacggcuucuucgccaccauggccugggccgugcccaagaacgacaacaacaagaccgcgaccuccagccucacgaucgaggugccguauaucugcaccgagggggaggaccagaucaccgucuggggcuuccacuccgacaacgagacccagauggccaagcuguacggggacucgaagccccagaaguucacguccagcgccaauggcgugaccacccacuacgugucccagaucggcggguuccccaaccagaccgaggacggcgggcugccccagucgggccggaucgucguggacuacauggugcagaaguccgggaagacgggcaccaucaccuaccagcgcggcauccuccugccgcagaaggucuggugcgccagcgggcggucgaaggugaucaagggcucccugccccucaucggggaggccgauugccugcacgagaaguacggcgggcugaacaagagcaagcccuacuacaccggcgagcacgcgaaggccaucggcaacugccccaucugggugaagacgccgcucaagcuggccaacgggaccaaguaucgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagugagcuggaggucaagaaccuccagcgccuguccggcgccauggacgagcugcacaacgagauccucgagcuggacgagaagguggacgaccugcgggccgacaccaucagcucccagaucgagcucgccgugcugcugucgaacgaggggaucaucaauuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuuugacgcgggcgaguucucccuccccacguucgacucgcugaacaucaccgccgccucccugaacgacgacggccucgacaaccauaccauccugcuguacuacagcaccgccgccuccucgcuggcggugacgcucaugaucgccaucuucguggucuacauggugucccgcgacaacgugagcugcagcaucugccuguga

SEQ ID NO: 14259 - RNA, 1758 nt, Artificial Sequence; identical to SEQ ID NO: 14254
  derived and/or modified CDS sequence (AUadapt) from InfluenzaB__ACA64965__HA

SEQ ID NO: 14260 - RNA, 1758 nt, Artificial Sequence
  derived and/or modified CDS sequence (AUadapt) from InfluenzaB__ACA64998__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugccccaaguguuucaacugcaccgaccuggacguggcccuggggcgccccaagugcaccggcaacaucccguccgcccgggugagcauccuccacgagguccgccccgugacguccggcugcuuccccaucaugcacgaccggaccaagauccgccagcugcccaaccugcuccggggguaugagcacauccgccugucgacccacaacgugaucaacgccgagaacgcgccgggcgggcccuacaagaucggcaccuccgggagcugccccaacgucacgaacggcaacggcuucuucgccaccauggccugggccgugcccaagaaugacaacaacaagaccgcgaccaacucccugacgaucgaggugccguacaucugcaccgagggggaggaccagaucaccgucuggggcuuccacucggacaacgagacccagauggccaagcucuacggggauuccaagccccagaaguucacgagcuccgccaacggcgugaccacccacuacgugucgcagaucggcggguuccccaaccagaccgaggacggcgggcugccccaguccggccggaucgucguggacuacauggugcagaaguccgggaagacgggcaccaucaccuaccagcgcggcauccugcucccgcagaaggucuggugcgccuccgggcggagcaaggugaucaagggcagucugccccugaucggggaggccgacugccuccacgagaaguacggcgggcugaacaaguccaagcccuacuacaccggcgagcacgcgaaggccaucggcaacugccccaucugggugaagacgccgcugaagcucgccaacgggaccaaguaccgcccgcccgccaagcugcugaaggagcggggcuucuucggggccaucgcgggcuuucucgagggcgggugggagggcaugaucgccggguggcacggcuacaccucgcacggggcccacggcgucgccguggccgcggaccugaaguccacccaggaggccaucaacaagaucacgaagaaccugaacagccucuccgagcuggaggucaagaaccugcagcgccucucgggcgccauggacgagcugcauaacgagauccuggagcucgacgagaagguggacgaccugcgggccgacaccaucuccagccagaucgagcuggccgugcuccuguccaacgaggggaucaucaacucggaggacgagcaccuccuggcgcuggagcgcaagcugaagaagaugcucggccccuccgccgucgagaucgggaacggcugcuucgagaccaagcauaagugcaaccagaccugccuggaccggaucgccgccgggaccuucgacgcgggcgaguucagccugcccacguucgacucccucaacaucaccgccgccucgcugaacgacgauggccuggacaaccacaccauccuccuguacuacuccaccgccgccagcucccuggcggugacgcugaugaucgccaucuucguggucuacauggugucgcgcgacaacguguccugcagcaucugccucuga

SEQ ID NO: 14261 - RNA, 1758 nt, Artificial Sequence
  derived and/or modified CDS sequence (AUadapt) from InfluenzaB__ACA65020__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucuccaaccugaaggggacggagacccggggcaagcucugccccaagugucugaacugcaccgaccuggacguggcccucgggcgccccaagugcaccggcaacaucccgagcgcccggguguccauccugcacgagguccgccccgugacgucgggcugcuuccccaucaugcacgaccggaccaagauccgccagcugcccaaccuccugcggggguaugagcacauccgccuguccacccacaacgugaucaacgccgagaacgccccgggcgggcccuacaagaucggcaccagcggguccugccccaacgucacgaacggcaacggcuucuucgcgaccauggccugggccgugcccaagaacgauaacaacaagaccgccaccaacucgcucacgaucgaggugccguacaucugcaccgagggggaggaccagaucaccaucuggggcuuccacuccgacaacgagacccagauggcgaagcuguacggggacaguaagccccagaaguucacguccagcgccaacggcgucaccacccacuacgugucccagaucggcggguuccccaaccagaccgaggacggcgggcugccccagucgggccggaucguggucgacuacauggugcagaaguccgggaagacgggcaccaucaccuaccagcgcggcauccuccugccgcagaagguguggugcgccagcgggcggaguaaggucaucaagggcucccugccccucaucggggaggccgacugccugcacgagaaguacggcgggcugaacaagagcaagcccuacuacaccggcgagcacgccaaggcgaucggcaacugccccaucugggugaagacgccgcucaagcuggccaacgggaccaaguaccgcccgcccgccaagcugcucaaggagcggggcuucuuuggggccaucgccggcuuccuggagggcgggugggagggcaugaucgcgggguggcacggcuacaccucccacggggcccacggcguggccgucgccgccgaccugaaguccacccaggaggcgaucaacaagaucacgaagaaccucaacucccugucggagcuggaggugaagaaccuccagcgccuguccggcgccauggacgagcugcacaaugagauccucgagcuggacgagaaggucgacgaccugcgggccgacaccaucucgucccagaucgagcucgccgugcugcugagcaacgaggggaucaucaacuccgaggacgagcaccuccuggcccuggagcgcaagcucaagaagaugcugggccccucggcgguggaggucgggaacggcugcuucgagaccaagcauaagugcaaccagaccugccuggaccggaucgccgccgggaccuucgacgccggcgaguucucccuccccacguucgacagccugaacaucaccgcggccucccugaacgacgacggccucgauaaccacaccauccugcuguacuacucgaccgccgccuccagccuggccgugacgcucaugaucgcgaucuucguggucuacauggugucccgcgacaacgugucgugcagcaucugccuguga

SEQ ID NO: 14262 - RNA, 1758 nt, Artificial Sequence; identical to SEQ ID NO: 14260
  derived and/or modified CDS sequence (AUadapt) from InfluenzaB__ACA65031__HA

SEQ ID NO: 14263 - RNA, 1758 nt, Artificial Sequence
  derived and/or modified CDS sequence (AUadapt) from InfluenzaB__ACA65042__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucuccaaccugaaggggacggagacccggggcaagcucugccccaagugccugaacuguaccgaccuggacguggcccucgggcgccccaagugcaccggcaacaucccgucggcccggguguccauccugcacgagguccgccccgugacgagcggcugcuuccccaucaugcacgaccggaccaagauccgccagcugcccaaccuccugcggggguacgagcacauccgccuguccacccacaaugugaucaacgccgagaacgccccgggcgggcccuacaagaucggcaccucgggguccugccccaacgucacgaacggcaacggcuucuucgcgaccauggccugggccgugcccaagaacgacaacaacaagaccgccaccaacagccucacgaucgaggugccguauaucugcaccgagggggaggaccagaucaccgucuggggcuuccacuccgacaacgagacccagauggcgaagcuguacggggacucgaagccccagaaguucacguccucggccaacggcgugaccacccacuacgugucccagaucggcggguuccccaaucagaccgaggacggcgggcugccccagagcggccggaucaucgucgacuacauggugcagaaguccgggaagacgggcaccaucaccuaccagcgcggcauccuccugccgcagaagguguggugcgccucggggcggagcaaggucaucaagggcucccugccccucaucggggaggccgacugccugcacgagaaguacggcgggcugaacaagucgaagcccuacuauaccggcgagcacgccaaggcgaucggcaacugccccaucugggugaagacgccgcucaagcuggccaacgggaccaaguaccgcccgcccgccaagcugcucaaggagcggggcuucuucggggccaucgccggcuuccuggagggcgggugggagggcaugaucgcgggguggcacggcuacaccucccacggggcccacggcguggccgucgccgccgaccugaaguccacccaggaggcgaucaacaagaucacgaagaaccucaacucccugagugagcuggaggugaagaaccuccagcgccuguccggcgccauggacgagcugcacaacgagauccucgagcuggacgagaaggucgacgaccugcgggccgacaccaucagcucccagaucgagcucgccgugcugcugucgaacgaggggaucaucaacuccgaggacgagcaccuccuggcccuggagcgcaagcucaagaagaugcugggccccagcgcgguggagaucgggaauggcugcuucgagaccaagcacaagugcaaccagaccugccuggaccggaucgccgccgggaccuucgacgccggcgaguucucccuccccacguucgacucgcugaacaucaccgcggccucccugaacgaugacggccucgacaaccacaccauccugcuguacuacucgaccgccgccuccagccuggccgucacgcucaugaucgcgaucuucgugguguacauggucucccgcgacaacgugucgugcagcaucugccuguga

SEQ ID NO: 14264 - RNA, 1758 nt, Artificial Sequence
  derived and/or modified CDS sequence (AUadapt) from InfluenzaB__ACA65053__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccacuucgccaaucugaaggggacggagacccggggcaagcucugccccaagugccugaacugcaccgaccuggacguggcccucgggcgccccaagugcaccggcaacaucccguccgcccgggugucgauccugcacgagguccgccccgugacguccggcugcuuucccaucaugcacgaccggaccaagauccgccagcugcccaaccuccugcggggguacgagcacauccgccugagcacccggaacgugaucaacgccgagaacgcgccgggcgggcccuacaagaucggcaccuccgggucgugucccaacgucacgaacggcaacggcuucuucgccaccauggccugggccgugcccaagaacgacaacaacaagaccgcgaccaacucccucacgaucgaggugccguacaucuguaccgagggggaggaccagaucaccgucuggggcuuccacagcgacaacgagacccagauggccaagcuguacggggacuccaagccccagaaguucacgucguccgccaacggcgugaccacccauuacgugagccagaucggcggguuccccaaccagaccgaggacggcgggcugccccaguccggccgcaucgucguggacuacauggugcagaaguccgggaagacgggcaccaucaccuaccagcggggcauccuccugccgcagaaggucuggugcgccuccgggcgcucgaaggugaucaagggcagccugccccucaucggggaggccgauugccugcacgagaaguacggcgggcugaacaaguccaagcccuacuacaccggcgagcacgcgaaggccaucggcaacugccccaucugggugaagacgccgcucaagcuggccaacgggaccaaguaccggccgcccgccaagcugcucaaggagcgcggcuuuuucggggccaucgcgggcuuccuggagggcgggugggagggcaugaucgccggguggcacggcuacaccucgcacggggcccacggcgucgccguggccgcggaccugaaguccacccaggaggccaucaacaagaucacgaagaaccucaacagucuguccgagcuggaggucaagaaccuccagcggcugucgggcgccauggacgagcugcacaacgagauccucgagcuggacgagaagguggacgaccugcgcgccgacaccaucuccagccagaucgagcucgccgugcugcuguccaacgaggggaucaucaauucggaggacgagcaccuccuggcgcuggagcggaagcucaagaagaugcugggccccuccgccgucgagaucgggaacggcugcuucgagaccaagcacaagugcaaccagaccugccuggaccgcaucgccgccgggaccuuugacgcgggcgaguucagccuccccacguucgacucccugaacaucaccgccgccucgcugaacgacgacggccucgacaaucacaccauccugcuguacuacuccaccgccgccagcucccuggcggugacgcucaugaucgccaucuucguggucuacauggugucgcgggacaacguguccugcagcaucugccuguga

SEQ ID NO: 14265 - RNA, 1758 nt, Artificial Sequence
  derived and/or modified CDS sequence (AUadapt) from InfluenzaB__ACA65075__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugucccaagugccugaacugcaccgaccuggacguggcccucgggcgccccaagugcaccggcaacaucccguccgcccgggugagcauccugcacgagguccgccccgugacguccggcugcuuccccaucaugcacgaucggaccaagauccgccagcugcccaaccuccugcggggguacgagcacauccgccugucgacccacaacgugaucaacgccgagaacgcgccgggcgggcccuacaagaucggcaccuccgggagcugccccaacaucacgaauggcaacggcuucuucgccaccauggccugggccguccccaagaacgacaacaacaagaccgcgaccaacucccucacgaucgaggugccguacaucugcaccgagggggaggaccagaucaccguguggggcuuccacagugacaacgagacccagauggccaagcuguacggggacuccaagccccagaaguucacgagcuccgccaacggcgucaccacccacuacgugucgcagaucggcggguuccccaaccagaccgaggauggcgggcugccccaguccggccggaucguggucgacuacauggugcagaaguccgggaagacgggcaccaucaccuaccagcgcggcauccuccugccgcagaagguguggugcgccuccgggcggagcaaggucaucaagggcucgcugccccucaucggggaggccgacugccugcacgagaaguacggcgggcugaacaaguccaagcccuacuauaccggcgagcacgcgaaggccaucggcaacugccccaucugggugaagacgccgcucacccuggccaacgggaccaaguaccgcccgcccgccaagcugcucaaggagcggggcuucuucggggccaucgcgggcuuccuggagggcgggugggagggcaugaucgccggguggcacggcuacaccucgcacggggcccauggcguggccgucgccgcggaccugaaguccacgcaggaggccaucaacaagaucaccaagaaccucaacagccuguccgagcuggaggugaagaaccuccagcgccugucgggcgccauggacgagcugcacaacgagauccucgagcuggacgagaaggucgacgaccugcgggccgauaccaucuccagccagaucgagcucgccgugcugcuguccaacgaggggaucaucaacucggaggacgagcaccuccuggcgcuggagcgcaagcucaagaagaugcugggccccuccgccguggagaucgggaacggcugcuucgagaccaagcacaagugcaaccagaccugucuggaccggaucgccgccgggacguucgacgcgggcgaguucagccuccccaccuucgacucccugaacaucaccgccgccucgcugaacgacgacggccucgauaaccacaccauccugcuguacuacuccacggccgccagcucccuggcggucacccucaugaucgccaucuucgugguguacauggucucgcgcgacaacguguccugcagcaucugccuguga

SEQ ID NO: 14266 - RNA, 1758 nt, Artificial Sequence; identical to SEQ ID NO: 14254
  derived and/or modified CDS sequence (AUadapt) from InfluenzaB__ACA65086__HA

SEQ ID NO: 14267 - RNA, 1758 nt, Artificial Sequence; identical to SEQ ID NO: 14254
  derived and/or modified CDS sequence (AUadapt) from InfluenzaB__ACA65097__HA

SEQ ID NO: 14268 - RNA, 1758 nt, Artificial Sequence; identical to SEQ ID NO: 14254
  derived and/or modified CDS sequence (AUadapt) from InfluenzaB__ACA96552__HA

SEQ ID NO: 14269 - RNA, 1758 nt, Artificial Sequence; identical to SEQ ID NO: 14254
  derived and/or modified CDS sequence (AUadapt) from InfluenzaB__ACA96563__HA

SEQ ID NO: 14270 - RNA, 1758 nt, Artificial Sequence; identical to SEQ ID NO: 14254
  derived and/or modified CDS sequence (AUadapt) from InfluenzaB__ACA96574__HA

SEQ ID NO: 14271 - RNA, 1758 nt, Artificial Sequence; identical to SEQ ID NO: 14254
  derived and/or modified CDS sequence (AUadapt) from InfluenzaB__ACA96585__HA

SEQ ID NO: 14272 - RNA, 1758 nt, Artificial Sequence
  derived and/or modified CDS sequence (AUadapt) from InfluenzaB__ACA96596__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccacuucgccaaucugaaggggacggagacccggggcaagcucugccccaagugccugaacugcaccgaccuggacguggcccucgggcgccccaagugcaccggcaacaucccguccgcccgggugucgauccugcacgagguccgccccgugacguccggcugcuuucccaucaugcacgaccggaccaagauccgccagcugcccaaccuccugcggggguacgagcacauccgccugagcacccacaacgugaucaacgccgagaacgcgccgggcgggcccuacaagaucggcaccuccgggaguugccccaacgucacgaacggcaacggcuucuucgccaccauggccugggccgugcccaagaacgacaacaacaagaccgcgaccaacucccucacgaucgaggugccguauaucugcaccgagggggaggaccagaucaccgucuggggcuuccacagcgacaacgagacccagauggccaagcuguacggggacuccaagccccagaaguucacgucguccgccaauggcgugaccacccacuacgugagccagaucggcggguuccccaaccagaccgaggacggcgggcugccccaguccggccggaucgucguggacuacauggugcagaaguccgggaagacgggcaccaucaccuaccagcgcggcauccuccugccgcagaaggucuggugcgccuccgggcggucgaaggugaucaagggcagccugccccucaucggggaggccgauugccugcacgagaaguacggcgggcugaacaaguccaagcccuacuacaccggcgagcacgcgaaggccaucggcaacugccccaucugggugaagacgccgcucaagcuggccaacgggaccaaguaccgcccgcccgccaagcugcucaaggagcggggcuuuuucggggccaucgcgggcuuccuggagggcgggugggagggcaugaucgccggguggcacggcuacaccucgcacggggcccacggcgucgccguggccgcggaccugaaguccacccaggaggccaucgacaagaucacgaagaaccucaacagucuguccgagcuggaggucaagaaccuccagcgccugucgggcgccauggacgagcugcacaacgagauccucgagcuggacgagaagguggacgaccugcgggccgacaccaucuccagccagaucgagcucgccgugcugcuguccaacgaggggaucaucaauucggaggacgagcaccuccuggcgcuggagcgcaagcucaagaagaugcugggccccuccgccgucgagaucgggaacggcugcuucgagaccaagcacaagugcaaccagaccugccuggaccggaucgccgccgggaccuuugacgcgggcgaguucagccuccccacguucgacucccugaacaucaccgccgccucgcugaacgacgacggccucgacaaucacaccauccugcuguacuacuccaccgccgccagcucccuggcggugacgcucaugaucgccaucuucguggucuacauggugucgcgcgacaacguguccugcagcaucugccuguga

SEQ ID NO: 14273 - RNA, 1758 nt, Artificial Sequence; identical to SEQ ID NO: 14254
  derived and/or modified CDS sequence (AUadapt) from InfluenzaB__ACA96607__HA

SEQ ID NO: 14274 - RNA, 1758 nt, Artificial Sequence
  derived and/or modified CDS sequence (AUadapt) from InfluenzaB__ACA96618__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugccccaagugucugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcauauccgccugucgacccacaacgugaucaacgccgagaacgcgccgggcgggcccuacaagaucggcaccuccgggagcugccccaacgucacgaacggcaacggcuucuucgccaccauggccugggccgugcccaagaaugacaacaacaagaccgcgaccaacucccucacgaucgaggugccguacaucugcaccgagggggaggaccagaucaccgucuggggcuuccacucggacaacgagacccagauggccaagcuguacggggacuccaagccccagaaguuuacgagcuccgccaacggcgugaccacccacuacgugucgcagaucggcggguuccccaaccagaccgaggacggcgggcugccccaguccggccggaucgucguggacuacauggugcagaaguccgggaagacgggcaccaucaccuaccagcgcggcauccuccugccgcagaaggucuggugcgccuccgggcggagcaaggugaucaagggcucgcugccccucaucggggaggccgauugccugcacgagaaguacggcgggcugaacaaguccaagcccuacuacaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuucuggagggcgggugggagggcaugaucgccggguggcacggcuacaccagccacggggcccacggcgucgccguggccgcggaccugaaguccacccaggaggccaucaacaagaucacgaagaaccucaacucgcuguccgagcuggaggucaagaaccuccagcgccugagcggcgccauggacgagcugcacaaugagauccucgagcuggacgagaagguggacgaccugcgggccgacaccaucuccucgcagaucgagcucgccgugcugcuguccaacgaggggaucaucaacagcgaggacgagcaccuccuggcgcuggagcgcaagcucaagaagaugcugggccccuccgccgucgagaucgggaacggcugcuucgagaccaagcauaagugcaaccagaccugccuggaccggaucgccgccgggaccuucgacgcgggcgaguucuuccuccccacguucgacucgcugaacaucaccgccgccucccugaacgacgauggccucgacaaccacaccauccugcuguacuacagcaccgccgccuccucgcuggcggugacgcucaugaucgccaucuucguggucuacauggugucccgcgacaacgugagcugcuccaucugccuguga

SEQ ID NO: 14275 - RNA, 1758 nt, Artificial Sequence; identical to SEQ ID NO: 14254
  derived and/or modified CDS sequence (AUadapt) from InfluenzaB__ACA96629__HA

SEQ ID NO: 14276 - RNA, 1758 nt, Artificial Sequence; identical to SEQ ID NO: 14260
  derived and/or modified CDS sequence (AUadapt) from InfluenzaB__ACA96640__HA

SEQ ID NO: 14277 - RNA, 1755 nt, Artificial Sequence
  derived and/or modified CDS sequence (AUadapt) from InfluenzaB__ACD56566__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaaguccuacuucgccaaccugaaggggacgcggacccgcggcaagcucugccccgacugucugaacugcaccgaccuggacguggcccucgggcggcccaugugcgugggcaccacgccguccgccaaggccagcauccugcaugagguccgccccgugaccuccggcugcuuccccaucaugcacgaccggaccaagauccgccagcugcccaaccuccugcggggguacgagaacauccgccugaguacccagaacguggucgacgcggagaacgccccgggcgggcccuaccggcucggcacguccgggagcugccccaaugccaccuccaagagcggcuucuucgccaccauggcgugggccgugcccaaggacaacaacaagaaugccaccaacccgcugacgguggagguccccuacgugugcaccgagggcgaggaccagaucaccguguggggguuccacuccgauaacaagacccagaugaagaaccuguacggcgacagcaacccccagaaguucacguccagugccaacggggucaccacccacuacgugucccagaucggcggcuuccccgcccagaccgaggacgggggccucccgcagagcgggcgcaucguggucgauuacauggugcagaagccccggaagacgggcaccaucguguaccagcgcgggguccugcugccccagaagguguggugcgcguccggccggagcaaggucaucaagggcucgcucccccugaucggggaggccgacugucugcacgagaaguacggcgggcucaacaaguccaagccguacuacaccggcgagcacgccaaggccaucgggaauugccccaucugggugaagacgccccugaagcuggccaacggcaccaaguaccggcccccggcgaagcuccugaaggagcgcggcuucuucggggccaucgccggcuuccuggagggcgggugggaggggaugaucgccggcuggcacggcuauaccagccacggggcccacggcguggcggucgccgccgaccucaaguccacccaggaggccaucaacaagaucaccaagaaccugaauagccuguccgagcucgaggugaagaaccugcagcgccugagcggggccauggacgagcuccacaacgagauccuggagcuggaugagaagguggacgaccuccgggcggacacgaucuccagccagaucgagcuggccguccugcucuccaacgagggcaucaucaacagugaggacgagcaccuccuggcccuggagcgcaagcugaagaagaugcugggccccuccgccguggacaucgggaacggcugcuucgagaccaagcacaaguguaaccagaccugccucgacaagaucgcggccgggaccuucaacgccggcgaguucagucugcccaccuucgacucccugaacaucacggccgccagccucaacgacgaugggcuggacaaccacaccauccugcuguacuacuccaccgcggccagcucccucgccgugacccugaugcuggccaucuuuaucgucuacauggugagccgggacaacguguccugcagcaucugccucuga

SEQ ID NO: 14278 - RNA, 1755 nt, Artificial Sequence
  derived and/or modified CDS sequence (AUadapt) from InfluenzaB__ACD56577__HA
augaaggccaucaucgugcugcucauggucgugaccaguaacgccgaccgcaucugcaccggcaucacguccagcaacaguccccacguggucaagaccgcgacccagggggaggugaacgugaccggcgucaucccgcugacgaccacccccaccaaguccuacuucgccaaccugaaggggacgcggacccgcggcaagcucugccccgauugccugaacugcaccgaccuggacguggcccucgggcggcccaugugcgugggcaccacgccguccgccaaggccaguauccugcacgagguccgccccgugaccuccggcugcuuccccaucaugcacgaccggaccaagauccgccagcugcccaaccuccugcggggguaugagaacauccgccugagcacccagaacgugaucgacgcggagaacgccccgggcgggcccuaccggcucggcacguccgggaguugccccaacgccaccuccaagagcggcuucuucgccaccauggcgugggccguccccaaggacaauaacaagaacgccaccaacccgcugacgguggaggugcccuacaucugcaccgagggcgaggaccagaucaccgucuggggguuucacuccgacaacaaggcccagaugaagaaccuguacggcgacaguaacccccagaaguucaccuccagcgccaacggggugacgacccacuacgugucccagaucggcggcuuucccgcgcagaccgaggacgggggccucccgcagagcgggcgcaucgucguggacuacauggugcagaagccccggaagaccggcacgaucgucuaccagcgcggggugcugcugccccagaagguguggugcgccuccggccggaguaaggucaucaagggcagccucccccugaucggggaggccgacugccugcacgagaaguacggcgggcucaauaaguccaagccguacuacaccggcgagcacgccaaggccaucgggaacugccccaucugggugaagacgccccugaagcuggcgaacggcaccaaguaucggcccccggccaagcuccugaaggagcgcggcuucuucggggccaucgccggcuuccuggagggcgggugggaggggaugaucgccggcuggcacggcuacaccagccauggggcgcacggcgucgccguggccgccgaccucaaguccacccaggaggccaucaacaagaucaccaagaaccugaacagccuguccgagcucgaggugaagaaucugcagcgccugagcggggcgauggacgagcuccacaacgagauccuggagcuggacgagaaggucgacgaucuccgggccgacaccaucuccagccagaucgagcuggccgugcugcucuccaacgagggcaucaucaacagcgaggacgagcaucuccuggcccuggagcgcaagcugaagaagaugcugggccccuccgcgguggacaucgggaacggcugcuucgagacgaagcacaagugcaaucagaccugccucgaccggaucgccgccgggaccuucaacgccggcgaguucagccugcccaccuuugacucccugaacaucaccgccgcgagccucaacgacgacgggcuggauaaccacacgauccugcuguacuacuccaccgccgccagcucccucgccgucacccugaugcuggccaucuucaucguguauauggugagccgcgacaacgucuccugcagcaucugccucuga

SEQ ID NO: 14279 - RNA, 1758 nt, Artificial Sequence; identical to SEQ ID NO: 14260
  derived and/or modified CDS sequence (AUadapt) from InfluenzaB__ACF41658__HA

SEQ ID NO: 14280 - RNA, 1758 nt, Artificial Sequence
  derived and/or modified CDS sequence (AUadapt) from InfluenzaB__ACF54136__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugccccaagugccugaacuguaccgaccuggacguggcccucgggcgccccaagugcaccggcaacaucccguccgcccgggugucgauccugcacgagguccgccccgugacguccggcugcuuccccaucaugcacgaccggaccaagauccgccagcugcccaaccuccugcggggguacgagcacauccgccugagcacccacaaugugaucaacgccgagaacgcgccgggcgggcccuacaagaucggcaccuccgggucgugccccaacgucacgaacggcaacggcuucuucgccaccauggccugggccgugcccaagaacgacaacaacaagaccgcgaccaacucccucacgaucgaggugccguauaucugcaccgagggggaggaccagaucaccgucuggggcuuccacucggacaacaagacccagauggccaagcuguacggggacuccaagccccagaaguucacgagcuccgccaacggcgugaccacccacuacgugucgcagaucggcggguuucccaaccagaccgaggacggcgggcugccccaguccggccggaucgucguggacuacauggugcagaaguccgggaagacgggcaccaucaccuaccagcgcggcauccuccugccgcagaaggucuggugcgccuccgggcggagcaaggugaucaagggcucgcugccccucaucggggaggccgacugccugcacgagaaguacggcgggcugaacaaguccaagcccuacuacaccggcgagcacgcgaaggccaucggcaauugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccucgcacggggcccacggcgucgccguggccgcggaccugaaguccacccaggaggccaucaacaagaucacgaagaaccucaacagucuguccgagcuggaggucaagaaccuccagcgccugucgggcgccauggacgagcugcacaacgagauccucgagcuggacgagaagguggacgaccugcgggccgacaccaucuccucgcagaucgagcucgccgugcugcuguccaacgaggggaucaucaacagcgaggacgagcaccuccuggcgcuggagcgcaagcucaagaagaugcugggccccuccgccgucgagaucgggaauggcugcuucgagaccaagcacaagugcaaccagaccugccuggaccggaucgccgccgggaccuucgacgcgggcgaguucucgcuccccacguucgacucccugaacaucaccgccgccucgcugaaugacgacggccucgacaaccacaccauccugcuguacuacuccaccgccgccagcucccuggcggugacgcucaugaucgccaucuucguggucuacauggugucgcgcgacaacaucuccugcagcaucugccuguga

SEQ ID NO: 14281 - RNA, 1758 nt, Artificial Sequence; identical to SEQ ID NO: 14254
  derived and/or modified CDS sequence (AUadapt) from InfluenzaB__ACF54147__HA

SEQ ID NO: 14282 - RNA, 1755 nt, Artificial Sequence
  derived and/or modified CDS sequence (AUadapt) from InfluenzaB__ACF54158__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaaguccuacuucgccaaccugaaggggacgcggacccgcggcaagcucugccccgacugucugaacugcaccgaccuggacguggcccucgggcggcccaugugcgugggcaccacgccguccgccaaggccagcauccugcaugagguccgccccgugaccuccggcugcuuccccaucaugcacgaccggaccaagauccgccagcuggcgaaccuccugcggggguacgagaacauccgccugaguacccagaacgugaucgacgccgagaaggcccccggcgggccguaccggcucggcacguccgggagcugccccaacgccaccuccaagaguggcuucuucgcgaccauggccugggccguccccaaggacaacaacaagaacgccaccaauccccugacgguggaggugccguacaucugcaccgagggcgaggaccagaucaccgucuggggguuccacuccgacaauaagacccagaugaagaaccuguacggcgacagcaacccccagaaguucacguccagcgccaauggggugaccacccacuacgugucccagaucggcggcuuccccgaccagaccgaggacgggggccucccccagagcgggcgcaucgucguggauuacaugaugcagaagccgggcaagacggggaccaucguguaccagcggggcguccugcugccccagaagguguggugcgcguccggccgcagcaaggugaucaaggggucgcucccccugaucggcgaggccgacugucugcacgagaaguacgggggccucaacaagucccggcccuacuacaccggggagcacgccaaggccaucggcaauugcccgaucugggucaagacgccccugaagcuggccaacggcaccaaguaccgcccgcccgcgaagcuccugaaggagcggggguucuucggcgccaucgccggguuccuggagggcgggugggagggcaugaucgccggcuggcacggguauaccagccacggcgcccacgggguggcggucgccgccgaccucaaguccacccaggaggccaucaacaagaucaccaagaaccugaauagccuguccgagcucgaggugaagaaccugcagcgccugagcggcgccauggacgagcuccacaacgagauccuggagcuggaugagaagguggacgaccuccgggcggacacgaucuccagccagaucgagcuggccguccugcucuccaacgagggcaucaucaacagugaggacgagcaccuccuggcccuggagcgcaagcugaagaagaugcuggggcccuccgccguggacaucggcaacgggugcuucgagaccaagcacaaguguaaccagaccugccucgaccggaucgcggccggcaccuucaacgccggggaguucagucugcccaccuucgacucccugaacaucacggccgccagccucaacgacgauggccuggacaaccacaccauccugcuguacuacuccaccgcggccagcucccucgccgugacccugaugcuggccaucuuuaucgucuacauggugagccgcgacaacguguccugcagcaucugccucuga

SEQ ID NO: 14283 - RNA, 1755 nt, Artificial Sequence
  derived and/or modified CDS sequence (AUadapt) from InfluenzaB__ACF54169__HA
augaaggccaucaucgugcugcucauggucgugaccaguaacgccgaccgcaucugcaccggcaucacguccagcaacaguccccacguggucaagaccgcgacccagggggaggugaacgugaccggcgucaucccgcugacgaccacccccaccaaguccuacuucgccaaccugaaggggacgcggacccgcggcaagcucugccccgauugccugaacugcaccgaccuggacguggcccucgggcggcccaugugcgugggcaccacgccguccgccaaggccaguauccugcacgagguccgccccgugaccuccggcugcuuccccaucaugcacgaccggaccaagauccgccagcugcccaaccuccugcggggguaugagaacauccgccugagcacccagaacgugaucgacgcggagaacgccccgggcgggcccuaccggcucggcacguccgggaguugccccaacgccaccuccaagagcggcuucuucgccaccauggcgugggccguccccaaggacaauaacaagaacgccaccaacccgcugacgguggaggugcccuacgucugcaccgagggcgaggaccagaucaccguguggggguuucacuccgacaacaagacccccaugaagaaccuguacggcgacaguaacccccagaaguucacguccagcgccaacggggugaccacccacuacgucucccagaucggcggcuuuccggcccagaccgaggacgaggggaucccccagagcggccgcaucgugguggacuacaugguccagaagccccggaagacggggaccaucguguaccagcgcggcgugcuccugccccagaaggucuggugcgcguccgggcggaguaaggugaucaagggcagccugccgcucaucggcgaggccgacugccugcacgagaaguacgggggccugaauaaguccaagcccuacuacaccggggagcacgccaaggccaucggcaacugccccaucugggucaagacgccccucaagcuggccaacgggaccaaguaucgcccgcccgcgaagcugcucaaggagcggggcuucuucggcgccaucgccggguuccuggagggcgggugggagggcaugaucgccggguggcacggcuacaccagccauggcgcccacgggguggcgguggccgccgaccugaaguccacccaggaggccaucagcaagaucaccaagaaccucaacucccugagcgagcuggaggucaagaaucuccagcgccuguccggcgccauggacgagcugcacaacgagauccucgagcuggacgagaagguggacgaccugcgggcggauacgaucagcucccagaucgagcucgccgugcugcugagcaacgaggggaucaucaacuccgaggacgagcaccuccuggcccuggagcgcaagcucaagaagaugcugggccccagugccgucgacaucggcaacgggugcuucgagaccaagcacaagugcaaucagaccugccuggaccggaucgcggccggcaccuucaacgccggggaguucucccuccccaccuucgauagccugaacaucacggccgccucccugaacgacgacggccucgacaaucacaccauccugcuguacuacagcaccgcggccuccagccuggccgugacccucaugcuggccaucuucaucguguauauggucucccgcgacaacgugagcugcagcaucugccuguga

SEQ ID NO: 14284 - RNA, 1755 nt, Artificial Sequence
  derived and/or modified CDS sequence (AUadapt) from InfluenzaB__ACF54180__HA
augaaggccaucaucgugcugcucauggucgugaccaguaacgccgaccgcaucugcaccggcaucacguccagcaacaguccccacguggucaagaccgcgacccagggggaggugaacgugaccggcgucaucccgcugacgaccacccccaccaaguccuacuucgccaaccugaaggggacgcggacccgcggcaagcucugccccgauugccugaacugcaccgaccuggacguggcccucgggcggcccaugugugugggcaccacgccguccgccaaggccagcauccugcacgagguccgccccgugaccuccggcugcuuccccaucaugcacgaccggaccaagauccgccagcugcccaaucuccugcggggguacgagaacauccgccugagcacccagaacgugaucgacgcggagaaugccccgggcgggcccuaccggcucggcacguccgggagcugccccaacgccaccuccaagagcggcuucuuugccaccauggcgugggccguccccaaggacaacaacaagaacgccaccaacccgcugacgguggaggugcccuacgucuguaccgagggcgaggaccagaucaccguguggggguuccacuccgacaacaagacccccaugaagaaucuguacggcgacagcaacccccagaaguucacguccagcgccaauggggugaccacccacuacgucucccagaucggcggcuucccggcccagaccgaggacgggggccucccccagagcgggcgcaucgugguggauuacaugguccagaagccccggaagacgggcaccaucguguaccagcgcggggugcugcugccccagaaggucuggugcgcguccggccggagcaaggugaucaagggcagccucccgcugaucggggaggccgacugucugcacgagaaguacggcgggcucaacaaguccaagcccuacuacaccggcgagcacgccaaggccaucgggaauugccccaucugggucaagacgccccugaagcuggccaacggcaccaaguaccgcccgcccgcgaagcuccugaaggagcggggcuucuucggggccaucgccggcuuucuggagggcgggugggaggggaugaucgccggcuggcacggcuacaccagccacggggcccacggcguggcgguggccgccgaccucaaguccacccaggaggccaucaauaagaucaccaagaaccugaacagccuguccgagcucgaggucaagaaccugcagcgccugagcggggccauggaugagcuccacaacgagauccuggagcuggacgagaagguggacgaccuccgggcggacacgaucuccagucagaucgagcuggccgugcugcucuccaacgagggcaucaucaacagcgaggacgagcaccuccuggcccuggagcgcaagcugaagaagaugcugggccccuccgccgucgacaucgggaauggcugcuucgagaccaagcacaagugcaaccagaccugucucgaccggaucgcggccgggaccuucaacgccggcgaguucagccugcccaccuucgauucccugaacaucacggccgccagccucaacgacgacgggcuggauaaccacaccauccugcuguacuacuccaccgcggccagcucccucgccgugacccugaugcuggccaucuucaucguguauauggucagccgcgacaacguguccugcagcaucugccucuga

SEQ ID NO: 14285 - RNA, 1755 nt, Artificial Sequence
  derived and/or modified CDS sequence (AUadapt) from InfluenzaB__ACF54202__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaaguccuacuucgccaaccugaaggggacgcggacccgcggcaagcucugccccgacugucugaacugcaccgaccuggacguggcccucgggcggcccaugugcgugggcaccacgccguccgccaaggccagcauccugcaugagguccgccccgugaccuccggcugcuuccccaucaugcacgaccggaccaagauccgccagcugcccaaccuccugcggggguacgagaacauccgccugaguacccagaacgugaucgacgcggagaacgccccgggcgggcccuaccggcucggcacgucccgcagcugccccaaugccaccuccaagagcggguucuucgccaccauggcgugggccguccccaaggacaacaacaagaaugccaccaacccgcugacgguggaggugcccuacgucugcaccgagggcgaggaccagaucaccguguggggcuuccacuccgauaacaagacccagaugaagaaccuguacggggacagcaacccccagaaguucacguccagugccaacggcgugaccacccacuacgucucccagaucgggggcuuccccgcccagaccgaggacgagggccucccgcagagcgggcggaucgugguggauuacaugguccagaagccccgcaagacgggcaccaucguguaccagcgcggggugcugcugccccagaaggucuggugcgcguccggccggagcaaggugaucaaggggucgcucccccugaucggcgaggccgacugucugcacgagaaguacggcgggcucaacaaguccaagccguacuacaccggcgagcacgccaaggccaucgggaauugccccaucugggucaagacgccccugaagcuggccaacggcaccaaguaccggcccccggcgaagcuccugaaggagcgcggguucuucggcgccaucgccggcuuccuggagggcgggugggaggggaugaucgccggcuggcacggguauaccagccacggcgcccacggcguggcgguggccgccgaccucaaguccacccaggaggccaucaacaagaucaccaagaaccugaauagccuguccgagcucgaggucaagaaccugcagcggcugagcggggccauggacgagcuccacaacgagauccuggagcuggaugagaagguggacgaccuccgcgcggacacgaucuccagccagaucgagcuggccgugcugcucuccaacgagggcaucaucaacagugaggacgagcaccuccuggcccuggagcggaagcugaagaagaugcuggggcccuccgccgucgacaucggcaacggcugcuucgagaccaagcacaaguguaaccagaccugccucgaccgcaucgcggccgggaccuucaacgccggcgaguucagucugcccaccuucgacucccugaacaucacggccgccagccucaacgacgaugggcuggacaaccacaccauccugcuguacuacuccaccgcggccagcucccucgccgugacccugaugcuggccaucuuuaucguguacauggucagccgggacaacguguccugcagcaucugccucuga

SEQ ID NO: 14286 - RNA, 1755 nt, Artificial Sequence
  derived and/or modified CDS sequence (AUadapt) from InfluenzaB__ACF54213__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacuguaccgaccuggacguggcccucgggcggcccaugugcgugggcaccacgccguccgccaaggccagcauccugcacgagguccgccccgugaccuccggcugcuuccccaucaugcaugaccggaccaagauccgccagcugcccaaccuccugcggggguacgagaacauccgccugagcacccagaacgugaucgacgcggagaaggccccgggcgggcccuaucggcucggcacguccgggucgugccccaacgccaccuccaagagcggcuucuucgccaccauggcgugggccguccccaaggacaauaacaagaacgccaccaacccgcugacgguggaggugcccuacaucugcaccgagggcgaggaccagaucaccgucuggggguuccauuccgacgacaagacccagaugaagaaccuguacggcgacagcaacccccagaaguuuacguccagcgccaacggggugaccacccacuacgugucccagaucggcggcuuccccgaccagaccgaggacgggggccucccgcagagugggcgcaucgucguggacuacaugaugcagaagcccggcaagacggggaccaucguguaccagcggggcguccugcugccccagaagguguggugcgccuccggccgcagcaaggugaucaaggggucgcucccccugaucggcgaggcggacugucugcacgagaaguacgggggccucaacaaguccaagccguacuacaccggggagcacgccaaggccaucggcaacugucccaucugggucaagacgccccugaagcuggccaacggcaccaaguaccggcccccggccaagcuccugaaggagcgcggguucuucggcgcgaucgccggguuccuggagggcgggugggagggcaugaucgccggcuggcacggguacaccagucacggcgcccacgggguggccgucgcggccgaccucaaguccacccaggaggccaucaacaagaucaccaagaaccugaacagccuguccgagcucgaggugaagaaucugcagcggcugagcggcgccauggacgagcuccacaacgagauccuggagcuggacgagaagguggacgaccuccgcgccgauacgaucuccagccagaucgagcuggcgguccugcucuccaacgagggcaucaucaacucggagaacgagcaccuccuggcccuggagcggaagcugaagaagaugcuggggcccuccgccguggacaucggcaaugggugcuucgagaccaagcacaagugcaaccagaccugccucgaccgcaucgccgcgggcaccuuuaacgccggggaguucagccugcccaccuucgacucccugaacaucacggccgccagccucaaugacgacggccuggacaaccacaccauccugcuguacuacuccaccgccgcgaguucccucgccgugacccugaugcuggccaucuucaucgucuacauggugagccgggacaacguguccugcagcaucugccucuga

SEQ ID NO: 14287 - RNA, 1758 nt, Artificial Sequence
  derived and/or modified CDS sequence (AUadapt) from InfluenzaB__ACF54224__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacgaagacccggggcaagcucugccccaagugucugaacugcaccgaccuggacguggcccucgggcgccccaagugcaccggcaacaucccguccgccgaggugagcauccugcacgagguccggcccgugacguccggcugcuuccccaucaugcacgaccgcaccaagauccggcagcugcccaaccuccugcgcggguacgagcauauccggcugucgacccacaacgugaucaacgccgagaaggcgccgggcgggcccuacaagaucggcaccuccgggagcugccccaacgucacgaacggcaacggcuucuucgccaccauggccugggccgugcccaagaacgauaacaacaagaccgcgaccaacucccucacgaucgaggugccguacaucugcaccgagggggaggaccagaucaccgucuggggcuuccacucggacaacgagacccagauggccaagcuguacggggacuccaagccccagaaguucacgaguuccagcaacggcgugaccacccacuacgugucccagaucggcggguuccccaaccagaccgaggacggcgggcugccccagucgggccgcaucgucguggacuacauggugcagaaguccgggaagacgggcaccaucaccuaccagcggggcauccuccugccgcagaaggucuggugcgccagcgggcgcucgaaggugaucaagggcucccugccccucaucggggaggccgauugccugcacgagcgguacggcgggcugaacaagagcaagcccuacuacaccggcgagcacgccaaggcgaucggcaacugccccaucugggugaagacgccgcucaagcuggccaacgggaccaaguaccgcccgcccgccaagcugcucaaggagcggggcuucuuuggggccaucgccggcuuccuggagggcgggugggagggcaugaucgcgggguggcacggcuacaccucccacggggcccacggcgucgccguggccgccgaccugaaguccacccaggaggcgaucaacaagaucacgaagaaccucaacucccugucggagcuggaggucaagaaccuccagcgccuguccggcgccauggacgagcugcacaacgagauccucgagcuggaugagaagguggacgaccugcgggccgacaccaucucgucccagaucgagcucgccgugcugcugagcaacgaggggaucaucaacuccgaggacgagcaccuccuggcccuggagcgcaagcucaagaagaugcugggccccucggcggucgagaucgggaacggcugcuucgagaccaagcauaagugcaaccagaccugccuggaccggaucgccgccgggaccuucgacgccggcgaguucucccuccccacguucgacagccugaacaucaccgcggccucccugaacgacgacggccucgauaaccacaccauccugcuguacuacucgaccgccgccuccagccuggccgugacgcucaugaucgcgaucuucguggucuacauggugucccgcgacaacgugucgugcagcaucugccuguga

SEQ ID NO: 14288 - RNA, 1755 nt, Artificial Sequence
  derived and/or modified CDS sequence (AUadapt) from InfluenzaB__ACF54257__HA
augaaggccaucaucgugcugcucauggucgugaccaguaacgccgaccgcaucugcaccggcaucacguccagcaacagcccccacguggucaagaccgcgacccagggggaggugaaugugaccggcgccaucccgcugacgaccacccccaccaagucccacuucgccaaccugaaggggacgaagacccggggcaagcucugcccgaccugccugaacugcaccgaucuggacgucgcccucgggcgccccaugugcgugggcaucacgcccuccgccaaggcgucgauccugcacgaggugcggcccgucaccuccggcugcuuccccaucaugcacgaucgcaccaagauccggcagcugcccaaccuccugcgcggguacgagaagauccggcugagcacccagaacgugaucgacgccgagaaggccccgggcgggcccuaccgccucggcacguccgggagcugccccaaugccaccuccaagucgggcuucuucgcgaccauggccugggccgugccccgggagaacaacaagaccgccacgaacccgcugaccgucgaggugccccacaucuguaccaaggaggaggaccagaucaccguguggggcuuccacuccgacaacaagccccagaugaagaaccuguacggggauagcaacccccagaaguucacguccagcgccaacggcaucaccacccacuacgucucccagaucgggggcuucccggaucagaccgaggacggcgggcucccccagucgggccgcaucgugguggacuacaugguccagaagcccgggaagacgggcaccaucguguaccagcgggggauccugcugccccagaagguguggugcgcguccggccgcagcaaggucaucaagggcagucucccgcugaucggggaggccgacugccugcacgagaaguacggcgggcucaacaaguccaagcccuacuacaccggcgagcaugccaaggccaucgggaacugccccaucugggugaagacgccccugaagcuggccaacggcaccaaguaccggccgcccgcgaagcuccugaaggagcgcggcuucuucggggccaucgccggcuuccuggagggcgggugggaggggaugaucgccggcuggcauggcuacaccucgcacggggcccacggcguggcggucgccgccgaccucaaguccacccaggaggccaucaacaagaucaccaagaaccugaacagucuguccgagcucgaggugaagaaccugcagcggcugagcggggccauggacgagcuccacaacgagauccuggagcuggacgagaaggucgacgaucuccgcgcggacacgaucuccucgcagaucgagcuggccgugcugcucuccaacgagggcaucaucaacagcgaggacgagcaccuccuggcccuggagcggaagcugaagaagaugcugggccccuccgccguggauaucgggaacggcugcuucgagaccaagcacaagugcaaccagaccugccucgaccgcaucgcggccgggaccuuuaacgccggcgaguucagccugcccaccuucgacucccugaacaucacggccgccucgcucaaugacgacgggcuggacaaccacaccauccugcuguacuacuccaccgcggccaguucccucgccgucacccugaugaucgccaucuucaucguguacaugaucagccgggacaacguguccugcagcaucugccuguga

SEQ ID NO: 14289 - RNA, 1755 nt, Artificial Sequence
  derived and/or modified CDS sequence (AUadapt) from InfluenzaB__ACF54268__HA
augaaggccaucaucgugcugcucauggucgugaccaguaacgccgaccgcaucugcaccggcaucacguccagcaacucgccccacguggucaagaccgcgacccagggggaggugaacgugaccggcgccaucccgcugacgaccacccccaccaagucccacuuugccaaccugaaggggacgaagacccggggcaagcucugcccgaccugccugaacugcaccgaccuggacgucgcccucgggcgccccaugugcgugggcaucacgcccuccgccaaggcgagcauccugcaugaggugcggcccgucaccuccggcugcuuccccaucaugcacgaccgcaccaagauccggcagcugcccaaccuccugcgcggguacgagaagauccggcugucgacccagaacgugaucgacgccgagaaggccccgggcgggcccuaucgccucggcacguccgggagcugccccaacgccaccuccaagagcggcuucuucgcgaccauggccugggccgugccccgggagaacaacaagaccgccacgaacccgcugaccgucgaggugccccauaucugcaccaaggaggaggaccagaucaccguguggggcuuccacuccgacaacaagauccagaugaagaaccuguacggggacaguaacccccagaaguucacguccagcgccaacggcaucaccacccacuacgucucccagaucgggggcuuccccgaccagaccgaggacggcgggcucccgcagaguggccgcaucgugguggacuacaugguccagaagcccgggaagacgggcaccaucguguaccagcgggggauccugcugccccagaagguguggugcgcguccggccgcagcaaggucaucaagggcagccucccccugaucggggaggccgacugccugcacgagaaguauggcgggcucaacaaguccaagccguacuacaccggcgagcacgccaaggccaucgggaacugccccaucugggugaagacgccccugaagcuggccaacggcaccaaguaccggcccccggcgaagcuccugaaggagcgcggcuucuuuggggccaucgccggcuuccuggagggcgggugggaggggaugaucgccggcuggcacggcuacaccucgcacggggcccacggcguggcggucgccgccgaccucaaguccacccaggaggccaucaacaagaucaccaagaaccugaauagccuguccgagcucgaggugaagaaccugcagcggcugucgggggccauggacgagcuccacaacgagauccuggagcuggacgagaaggucgacgaccuccgcgcggauacgaucuccagccagaucgagcuggccgugcugcucuccaacgagggcaucaucaacagcgaggacgagcaccuccuggcccuggagcggaagcugaagaagaugcugggccccuccgccaucgacaucgggaacggcugcuuugagaccaagcacaagugcaaccagaccugccucgaccgcaucgcggccgggaccuucaacgccggcgaguucucgcugcccaccuuugacucccugaacaucacggccgccagccucaacgacgacgggcuggacaaccacaccauccugcuguauuacuccaccgcggccucgucccucgccgugacccugaugaucgccaucuucaucgucuacaugaucagccgggacaacguguccugcagcaucugccuguga

SEQ ID NO: 14290 - RNA, 1755 nt, Artificial Sequence
  derived and/or modified CDS sequence (AUadapt) from InfluenzaB__ACF54279__HA
augaaggccaucaucgugcugcucauggucgugaccaguaacgccgaccgcaucugcaccggcaucacguccagcaacucgccccacguggucaagaccgcgacccagggggaggugaaugugaccggcgccaucccgcugacgaccacccccaccaagucccacuucgccaaccugaaggggacgaagacccggggcaagcucugcccgaccugccugaacugcaccgaccuggaugucgcccucgggcgccccaugugcgugggcaucacgcccuccgccaaggcgagcauccugcacgaggugcggcccgucaccuccggcugcuuccccaucaugcacgaccgcaccaagauccggcagcugcccaaccuccugcgcggguaugagaagauccggcugagcacccagaacgugaucgacgccgagaaggccccgggcgggcccuaccgccucggcacguccgggucgugccccaacgccaccuccaagagcggcuuuuucgcgaccauggccugggccgugccccgggagaacaacaagaccgccacgaacccgcugaccgucgaggugccccacaucugcaccaaggaggaggaccagaucaccguguggggcuuccauuccgacaacaagacgcagaugaagaaccuguacggggacagcaacccccagaaguuuaccuccucggccaacggcaucaccacccacuacgucucccagaucgggggcuuccccgaccagacggaggacggcgggcucccgcagagcggccgcaucgugguggauuacaugguccagaagcccgggaagaccggcaccaucguguaccagcgggggauccugcugccccagaagguguggugcgcguccggccgcagcaaggucaucaagggcucgcucccccugaucggggaggccgacugccugcacgagaaguauggcgggcucaacaaguccaagccguacuacaccggcgagcacgccaaggccaucgggaacugccccaucugggugaagacgccccugaagcuggccaacggcaccaaguaccggcccccggcgaagcuccugaaggagcgcggcuuuuucggggccaucgccggcuuccuggagggcgggugggaggggaugaucgccggcuggcacggcuacaccagccacggggcccacggcguggcggucgccgccgaccucaaguccacccaggaggccaucaauaagaucacgaagaaccugaacucgcuguccgagcucgaggugaagaaccugcagcggcugagcggggccauggacgagcuccacaaugagauccuggagcuggacgagaaggucgacgaccuccgcgcggacaccaucuccagccagaucgagcuggccgugcugcucuccaacgagggcaucaucaacucggaggaugagcaccuccuggcccuggagcggaagcugaagaagaugcugggccccuccgccguggacaucgggaacggcugcuucgagaccaagcacaagugcaaccagaccugucucgaccgcaucgcggccgggaccuucaacgccggcgaguucagccugcccacguucgacucccugaacaucaccgccgccagucucaacgacgacgggcuggacaaccacaccauccugcuguacuacuccaccgcggccaguucccucgccgucacgcugaugaucgccaucuucaucguguacaugaucagccgggacaacguguccugcagcaucugccuguga

SEQ ID NO: 14291 - RNA, 1755 nt, Artificial Sequence
  derived and/or modified CDS sequence (AUadapt) from InfluenzaB__ACF54290__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaaguccuacuucgccaaccugaaggggacgcggacccgcggcaagcucugccccgacugucugaacugcaccgaccuggacguggcccucgggcggcccaugugcgugggcaccacgccguccgccaaggccagcauccugcaugagguccgccccgugaccuccggcugcuuccccaucaugcacgaccggaccaagauccgccagcugcccaaccuccugcggggguacgagaauauccgccugagcacccagaacguggucgacgcggagaacgccccgggcgggcccuaccggcucggcacguccgggagcugccccaaugccaccuccaagagcggcuucuucgccaccauggcgugggccgugcccaaggacaacaacaagaaugccaccaacccgcugacgguggagguccccuacgugugcaccgagggcgaggaccagaucaccguguggggguuccacuccgauaagaagacccagaugaagaaccuguacggcgacagcaacccccagaaguucacguccagugccaacggggucaccacccacuacgugucccagaucggcggcuuccccgcccagaccgaggacgggggccucccgcagagcgggcgcaucguggucgauuacauggugcagaagccccggaagacgggcaccaucguguaccagcgcgggguccugcugccccagaagguguggugcgcguccggccggagcaaggucaucaagggcucgcucccccugaucggggaggccgacugccugcaugagaaguacggcgggcucaacaaguccaagccguacuacaccggcgagcacgccaaggccaucgggaacugucccaucugggugaagacgccccugaagcuggccaacggcaccaaguaccggcccccggcgaagcuccugaaggagcgcggcuucuucggggccaucgccggcuuccuggagggcgggugggaggggaugaucgccggcuggcacggcuauaccagccacggggcccacggcguggcggucgccgccgaccucaaguccacccaggaggccaucaacaagaucaccaagaaccugaauagccuguccgagcucgaggugaagaaccugcagcgccugagcggggccauggacgagcuccacaacgagauccuggagcuggaugagaagguggacgaccuccgggcggacacgaucuccagccagaucgagcuggccguccugcucuccaacgagggcaucaucaacagcgaggaugagcaccuccuggcccuggagcgcaagcugaagaagaugcugggccccuccgccguggacaucgggaacggcugcuucgagaccaagcacaaguguaaccagaccugccucgacaagaucgcggccgggaccuucaacgccggcgaguucagucugcccaccuucgacucccugaacaucacggccgccagccucaacgacgaugggcuggacaaccacaccauccugcuguacuacuccaccgcggccagcucccucgccgugacccugaugcuggccaucuuuaucgucuacauggugagccgggacaacguguccugcagcaucugccucuga

SEQ ID NO: 14292 - RNA, 1758 nt, Artificial Sequence
  derived and/or modified CDS sequence (AUadapt) from InfluenzaB__ACF54312__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacgaagacccggggcaagcucugccccaagugccugaacugcaccgaccuggacguggcccucgggcgccccaagugcaccggcaauaucccguccgccgaggugucgauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggucgugccccaacgucacgaacggcaacggcuucuuugccaccauggccugggccgugcccaagaacgacaacaacaagaccgcgaccaacucccucacgaucgaggugccguacaucugcaccgagggggaggaccagaucaccgucuggggcuuccacucggacuccgagacccagauggccaagcuguacggggacagcaagccccagaaguucacguccucguccaacggcgugaccacccacuacaucagucagaucggcggguuccccaaccagaccgaggacggcgggcugccccaguccggccgcaucguggucgacuacauggugcagaaguccgggaagacgggcaccaucaccuaccagcggggcauccuccugccgcagaagguguggugcgccagcgggcgcuccaaggucaucaagggcucgcugccccucaucggggaggccgacugccugcacgagaaguacggcgggcugaacaaguccaagcccuacuacaccggcgagcacgccaaggcgaucggcaacugccccaucugggugaagacgccgcucaagcuggccaaugggaccaaguaccggccgcccgccaagcugcucaaggagcgcggcuucuucggggccaucgccggcuuccuggagggcgggugggagggcaugaucgcgggguggcacggcuacaccucgcacggggcccacggcguggccgucgccgccgaccugaaguccacccaggaggcgaucaacaagaucacgaagaaccucaacagccuguccgagcuggaggugaagaaccuccagcggcugucgggcgccauggacgagcugcacaacgagauccucgagcuggacgagaaggucgaugaccugcgcgccgacaccaucuccucgcagaucgagcucgccgugcugcuguccaacgaggggaucaucaacagcgaggacgagcaccuccuggcccuggagcggaagcucaagaagaugcugggccccuccgcgaucgagaucgggaacggcugcuucgagaccaagcacaagugcaaccagaccugccuggaccgcaucgccgccgggaccuucgacgccggcgaguucucgcuccccacguuugacucccugaacaucaccgcggccucgcugaacgacgacggccucgacaaccacaccauccugcuguacuacuccaccgccgccagcucccuggccgugacgcucaugaucgcgaucuucgucguguacauggugucgcgggacaacgucagcugcuccaucugccuguga

SEQ ID NO: 14293 - RNA, 1758 nt, Artificial Sequence
  derived and/or modified CDS sequence (AUadapt) from InfluenzaB__ACF54323__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccacuuugccaaccugaaggggacggagacccggggcaagcucugccccaagugccugaacugcaccgaccuggacguggcccucgggcgccccaagugcaccggcaacaucccguccgcccgggugucgauccugcaugagguccgccccgugacguccggcugcuuccccaucaugcacgaccggaccaagauccgccagcugcccaaccuccugcggggguacgagcacauccgccugagcacccggaacgugaucaacgccgagaaugcgccgggcgggcccuacaagaucggcaccuccgggucgugccccaacgucacgaacggcaacggcuucuucgccaccauggccugggccgugcccaagaacgacaauaacaagaccgcgaccaacucccucacgaucgaggugccguacaucugcaccgagggggaggaccagaucaccgucuggggcuuccacagcgacaacgaggcccagauggccaagcuguauggggacuccaagccccagaaguucaccucguccgccaacggcgugacgacccacuacgugagccagaucggcggguuccccaaccagaccgaggacggcgggcugccccaguccggccgcaucgucguggauuacauggugcagaaguccgggaagaccggcacgaucaccuaccagcggggcauccuccugccgcagaaggucuggugcgccuccgggcgcagcaaggugaucaagggcucgcugccccucaucggggaggcggacugccugcacgagaaguacggcgggcugaacaaguccaagcccuacuauaccggcgagcacgccaaggccaucggcaacugccccaucugggugaagaccccgcucaagcuggccaacgggacgaaguaccggccgcccgccaagcugcucaaggagcgcggcuucuucggggcgaucgccggcuuccuggagggcgggugggagggcaugaucgccggguggcacggcuacaccagucacggggcccacggcgucgccguggcggccgaccugaaguccacccaggaggccaucaacaagaucaccaagaaccucaacucgcuguccgagcuggaggucaagaaccuccagcggcugagcggcgccauggacgagcugcauaacgagauccucgagcuggacgagaagguggacgaccugcgcgccgacacgaucuccucgcagaucgagcucgcggugcugcuguccaacgaggggaucaucaacagcgaggacgagcaucuccuggcccuggagcggaagcucaagaagaugcugggccccuccgccgucgagaucgggaacggcugcuucgagaccaagcacaagugcaaccagaccugccuggaccgcaucgccgcggggaccuucgacgccggcgaguuuucgcuccccaccuucgacucccugaacaucacggccgccagccugaacgacgacggccucgacaaccauaccauccugcuguacuacuccaccgccgcgucgucccuggccgugacccucaugaucgccaucuucguggucuacauggugagccgggacaacguguccugcagcaucugccuguga

SEQ ID NO: 14294 - RNA, 1755 nt, Artificial Sequence
  derived and/or modified CDS sequence (AUadapt) from InfluenzaB__ACF54345__HA
augaaggccaucaucgugcugcucauggucgugaccaguaacgccgaccgcaucugcaccggcaucacguccagcaacaguccccacguggucaagaccgcgacccagggggaggugaacgugaccggcgucaucccgcugacgaccacccccaccaaguccuacuucgccaaccugaaggggacgcggacccgcggcaagcucugccccgauugccugaacugcaccgaccuggacguggcccucgggcggcccaugugcgugggcaccacgccguccgccaaggccaguauccugcacgagguccgccccgugaccuccggcugcuuccccaucaugcacgaccggaccaagauccgccagcuggcgaaccuccugcggggguaugagaacauccgccugagcacccagaacgugaucgacgccgagaaggcccccggcgggccguaccggcucggcacguccgggagcugucccaacgccaccuccaagagcggcuucuucgcgaccauggccugggccguccccaaggacaacaauaagaacgccaccaacccccugacgguggaggugccguacaucugcaccgagggcgaggaccagaucaccgucuggggguuccauuccgacaacaaggcccagaugaagaaccuguacggcgacagcaauccccagaaguucaccuccagcgcgaacggggugacgacccacuacgugucccagaucggcggcuuccccgaucagaccgaggacgggggccucccccagagcgggcgcaucgucguggacuacaugauccagaagccgggcaagaccgggacgaucguguaccagcggggcguccugcugccccagaagguguggugcgccuccggccgcaguaaggugaucaaggggagccucccccugaucggcgaggccgacugccugcacgagaaguacgggggccucaauaaguccaagcccuacuacaccggggagcacgccaaggccaucggcaacugcccgaucugggucaagacgccccugaagcuggcgaacggcaccaaguaucggccgcccgccaagcuccugcgcgagcggggguucuucggcgccaucgccggguuccuggagggcgggugggagggcaugaucgccggcuggcacggguacaccagccauggcgcgcacgggguggccgucgccgccgaccucaaguccacccaggaggccaucaacaagaucaccaagaaccugaacagccuguccgagcucgaggugaagaaucugcagcgccugagcggcgcgauggacgagcuccacaacgagauccuggagcuggacgagaagguggacgaucuccgggccgacaccaucuccagccagaucgagcuggccguccugcucuccaacgagggcaucaucaacagcgaggacgagcaucuccuggcccuggagcgcaagcugaagaagaugcuggggcccuccgcgguggacaucggcaacgggugcuucgagacgaagcacaagugcaaucagaccugccucgaccggaucgccgccggcaccuucaacgccggggaguucagccugcccaccuuugacucccugaacaucaccgccgcgagccucaacgacgacggccuggauaaccacacgauccugcuguacuacuccaccgccgccagcucccucgccgugacccugaugcuggccaucuucaucgucuauauggugagccgcgacaacguguccugcagcaucugccucuga

SEQ ID NO: 14295 - RNA, 1755 nt, Artificial Sequence
  derived and/or modified CDS sequence (AUadapt) from InfluenzaB__ACF54367__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccgcccccaccaaguccuacuucgccaaccugaaggggacccggacgcgcggcaagcucugccccgacugucugaacugcaccgaccuggacguggcccucgggcggcccaugugcgugggcaccaccccguccgccaaggcgagcauccugcaugagguccgccccgugacguccggcugcuuccccaucaugcacgaccggaccaagauccgccagcuggccaaccuccugcggggguacgagaacauccgccugaguacccagaacgugaucgacgccgagaaggcccccggcgggccguaccggcucggcaccuccgggagcugccccaacgcgacguccaagaguggcuucuucgccaccauggccugggccguccccaaggacaacaacaagaacgccaccaauccccugaccguggaggugccguacaucugcacggagggcgaggaccagaucaccgucuggggguuccacuccgacaguaagacccagaugaagaaccuguacggcgacuccaacccccagaaguucaccagcuccgcgaacggggugacgacccauuacgugagccagaucggcggcuuccccgaccagaccgaggacgggggccucccccaguccgggcgcaucgucguggacuauaugaugcagaagccgggcaagaccgggacgaucguguaccagcggggcguccugcugccccagaagguguggugcgccagcggccgcucgaaggugaucaaggggucccucccccugaucggcgaggccgacugccugcaugagaaguacgggggccucaacaagagcaagcccuacuacaccggggagcacgccaaggccaucggcaauugcccgaucugggucaagacgccccugaagcuggcgaacggcaccaaguaccggccgcccgccaagcuccugaaggagcgcggguucuucggcgccaucgccggguuccuggagggcgggugggagggcaugaucgccggcuggcacggguauaccucccacggcgcgcacgggguggccgucgccgccgaccucaagagcacccaggaggccaucaacaagaucaccaagaaccugaauucccugagcgagcucgaggugaagaaccugcagcggcuguccggcgcgauggacgagcuccacaacgagauccuggagcuggacgagaagguggaugaccuccgcgccgacaccaucagcucccagaucgagcuggccguccugcucagcaacgagggcaucaucaacuccgaggaugagcaccuccuggcccuggagcggaagcugaagaagaugcuggggcccagcgcgguggacaucggcaacgggugcuucgagacgaagcacaaguguaaccagaccugccucgaccgcaucgccgccggcaccuucaacgccggggaguucucccugcccaccuuugacagccugaacaucaccgccgcgucccucaacgacgacggccuggauaaccacacgauccugcuguacuacagcaccgccgccuccagccucgccgugacccugaugcuggccaucuuuaucgucuacauggugucccgggacaacgugagcugcagcaucugccucuga

SEQ ID NO: 14296 - RNA, 1755 nt, Artificial Sequence
  derived and/or modified CDS sequence (AUadapt) from InfluenzaB__ACN32556__HA
augaaggccaucaucgugcugcucauggucgugaccaguaacgccgaccgcaucugcaccggcaucacguccagcaacucgccccacguggucaagaccgcgacccagggggaggugaacgugaccggcgccaucccgcugacgaccacccccaccaagucccacuuugccaaccugaaggggacgaagacccggggcaagcucugcccgaccugccugaacugcaccgaccuggacgucgcccucgggcgccccaugugcgugggcaucacgcccuccgccaaggcgagcauccugcaugaggugcggcccgucaccuccggcugcuuccccaucaugcacgaccgcaccaagauccggcagcugcccaaccuccugcgcggguacgagaagauccggcugagcacccagaacgugaucaacgccgagaaggccccgggcgggcccuaucgccucggcacguccgggucgugccccaacgccaccuccaagagcggcuucuucgcgaccauggccugggccgugccccgggacaacaacaagaccgccacgaauccgcugaccgucgaggugccccacaucugcaccaaggaggaggaccagaucaccguguggggcuuccacuccgacaacaagacgcagaugaagaaccuguacggggauucgaacccccagaaguucaccuccuucgccaacggcaucaccacccacuacgucagccagaucgggggcuuccccgaucagacggaggacggcgggcucccgcaguccggccgcaucgugguggacuacaugguccagaagcccgggaagaccggcaccaucguguaccagcgggggauccugcugccccagaagguguggugcgcgagcggccgcuccaaggucaucaagggcucgcucccccugaucggggaggccgacugccugcacgagaaguauggcgggcucaacaagagcaagccguacuacaccggcgagcacgccaaggccaucgggaacugccccaucugggugaagacgccccugaagcuggccaacggcaccaaguaccggcccccggcgaagcuccugaaggagcgcggcuuuuucggggccaucgccggcuuccuggagggcgggugggaggggaugaucgccggcuggcacggcuacaccucccacggggcccacggcguggcggucgccgccgaccucaagagcacccaggaggccaucaacaagaucacgaagaaucugaacucccugucggagcucgaggugaagaaccugcagcggcuguccggggccauggacgagcuccacaacgagauccuggagcuggacgagaaggucgacgaccuccgcgcggauaccaucagcucccagaucgagcuggccgugcugcucucgaacgagggcaucaucaacuccgaggacgagcaccuccuggcccuggagcggaagcugaagaagaugcugggccccagcgccguggacaucgggaacggcuguuucgagaccaagcacaagugcaaccagaccugccucgaccgcaucgcggccgggaccuucaacgccggcgaguucucccugcccacguuugacagccugaacaucaccgccgccucccucaacgacgacgggcuggacaaccacaccauccugcuguauuacucgaccgcggccuccagccucgccgucacgcugaugaucgccaucuucaucguguacaugaucucccgggacaacgugagcugcuccaucugccuguga

SEQ ID NO: 14297 - RNA, 1758 nt, Artificial Sequence
  derived and/or modified CDS sequence (AUadapt) from InfluenzaB__ACN32567__HA
auggaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccacuucgccaaucugaaggggacggagacccggggcaagcucugccccaagugccugaacugcaccgaccuggacguggcccucgggcgccccaagugcaccggcaacaucccguccgcccgggugucgauccugcacgagguccgccccgugacguccggcugcuuucccaucaugcacgaccggaccaagauccgccagcugcccaaccuccugcggggguacgagcacauccgccugagcacccacaacgugaucaacgccgagaacgcgccgggcgggcccuacaagaucggcaccuccgggaguugccccaacgucacgaacggcaacggcuucuucgccaccauggccugggccgugcccaagaacgacaacaacaagaccgcgaccaacucccucacgaucgaggugccguauaucugcaccgagggggaggaccagaucaccgucuggggcuuccacagcgacaacgagacccagauggccaagcuguacggggacuccaagccccagaaguucacgucguccgccaauggcgugaccacccacuacgugagccagaucggcggguuccccaaccagaccgaggacggcgggcugccccaguccggccggaucgucguggacuacauggugcagaaguccgggaagacgggcaccaucaccuaccagcgcggcauccuccugccgcagaaggucuggugcgccuccgggcggucgaaggugaucaagggcagccugccccucaucggggaggccgauugccugcacgagaaguacggcgggcugaacaaguccaagcccuacuacaccggcgagcacgcgaaggccaucggcaacugccccaucugggugaagacgccgcucaagcuggccaacgggaccaaguaccgcccgcccgccaagcugcucaaggagcggggcuuuuucggggccaucgcgggcuuccuggagggcgggugggagggcaugaucgccggguggcacggcuacaccucgcacggggcccacggcgucgccguggccgcggaccugaaguccacccaggaggccaucaacaagaucacgaagaaccucaacagucuguccgagcuggaggucaagaaccuccagcgccugucgggcgccauggacgagcugcacaacgagauccucgagcuggacgagaagguggacgaccugcgggccgacaccaucuccagccagaucgagcucgccgugcugcuguccaacgaggggaucaucaauucggaggacgagcaccuccuggcgcuggagcgcaagcucaagaagaugcugggccccuccgccgucgagaucgggaacggcugcuucgagaccaagcacaagugcaaccagaccugccuggaccggaucgccgccgggaccuuugacgcgggcgaguucagccuccccacguucgacucccugaacaucaccgccgccucgcugaacgacgacggccucgacaaucacaccauccugcuguacuacuccaccgccgccagcucccuggcggugacgcucaugaucgccaucuucguggucuacauggugucgcgcgacaacguguccugcagcaucugccuguga

SEQ ID NO: 14298 - RNA, 1758 nt, Artificial Sequence; identical to SEQ ID NO: 14254
  derived and/or modified CDS sequence (AUadapt) from InfluenzaB__ACN32578__HA

SEQ ID NO: 14299 - RNA, 1758 nt, Artificial Sequence
  derived and/or modified CDS sequence (AUadapt) from InfluenzaB__ACN32589__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucuccaaccugaaggggacggagacccggggcaagcucugccccaagugccugaacuguaccgaccuggacguggcccucgggcgccccaagugcaccggcaacaucccgucggcccggguguccauccugcacgagguccgccccgugacgagcggcugcuuccccaucaugcacgaccggaccaagauccgccagcugcccaaccuccugcggggguacgagcacauccgccuguccacccacaaugugaucaacgccgagaacgccccgggcgggcccuacaagaucggcaccucgggguccugccccaacgucacgaacggcaacggcuucuucgcgaccauggccugggccgugcccaagaacgacaacaacaagaccgccaccaacagccucacgaucgaggugccguauaucugcaccgagggggaggaccagaucaccaucuggggcuuccacuccgacaacgagacccagauggcgaagcuguacggggacucgaagccccagaaguucacguccucggccaacggcgucaccacccacuacgugucccagaucggcggguuccccaaucagaccgaggacggcgggcugccccagagcggccggaucguggucgacuacauggugcagaaguccgggaagacgggcaccaucaccuaccagcgcggcauccuccugccgcagaagguguggugcgccucggggcggagcaaggucaucaagggcucccugccccucaucggggaggccgacugccugcacgagaaguacggcgggcugaacaagucgaagcccuacuauaccggcgagcacgccaaggcgaucggcaacugccccaucugggugaagacgccgcucaagcuggccaacgggaccaaguaccgcccgcccgccaagcugcucaaggagcggggcuucuucggggccaucgccggcuuccuggagggcgggugggagggcaugaucgcgggguggcacggcuacaccucccacggggcccacggcguggccgucgccgccgaccugaaguccacccaggaggcgaucaacaagaucacgaagaaccucaacucccugagugagcuggaggugaagaaccuccagcgccuguccggcgccauggacgagcugcacaacgagauccucgagcuggacgagaaggucgacgaccugcgggccgacaccaucagcucccagaucgagcucgccgugcugcugucgaacgaggggaucaucaacuccgaggacgagcaccuccuggcccuggagcgcaagcucaagaagaugcugggccccagcgcgguggagaucgggaauggcugcuucgagaccaagcacaagugcaaccagaccugccuggaccggaucgccgccgggaccuucgacgccggcgaguucucccuccccacguucgacucgcugaacaucaccgcggccucccugaacgaugacggccucgacaaccacaccauccugcuguacuacucgaccgccgccuccagccuggccgucacgcucaugaucgcgaucuucgugguguacauggucucccgcgacaacgugucgugcagcaucugccuguga

SEQ ID NO: 14300 - RNA, 1758 nt, Artificial Sequence
  derived and/or modified CDS sequence (AUadapt) from InfluenzaB__ACN32600__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccacuucuccaaucugaaggggacggagacccggggcaagcucugccccaagugccugaacugcaccgaccuggacguggcccucgggcgccccaagugcaccggcaacaucccgucggcccggguguccauccugcacgagguccgccccgugacgagcggcuguuuccccaucaugcacgaccggaccaagauccgccagcugcccaaccuccugcggggguacgagcacauccgccuguccacccacaacgugaucaacgccgagaacgccccgggcgggcccuacaagaucggcaccaguggguccugccccaacgucacgaacggcaacggcuucuucgcgaccauggccugggccgugcccaagaacgacaacaacaagaccgccaccaacagccucacgaucgaggugccguauaucugcaccgagggggaggaccagaucaccgucuggggcuuccacuccgacaacgagacccagauggcgaagcuguacggggacucgaagccccagaaguucacguccagcgccaauggcgugaccacccacuacgugucccagaucggcggguuccccaaccagaccgaggacggcgggcugccccagucgggccggaucgucguggacuacauggugcagaaguccgggaagacgggcaccaucaccuaccagcgcggcauccuccugccgcagaaggucuggugcgccagcgggcggaguaaggugaucaagggcucccugccccucaucggggaggccgacugccugcacgagaaguacggcgggcugaacaagagcaagcccuacuacaccggcgagcacgccaaggcgaucggcaacugccccaucugggugaagacgccgcucaagcuggccaaugggaccaaguaccgcccgcccgcccggcugcucaaggagcgcggcuucuucggggccaucgccggcuuccuggagggcgggugggagggcaugaucgcgggguggcacggcuacaccucccacggggcccacggcgucgccguggccgccgaccugaaguccacccaggaggcgaucaacaagaucacgaagaaccucaacucccugagugagcuggaggucaagaaccuccagcggcuguccggcgccauggacgagcugcacaacgagauccucgagcuggacgagaagguggacgaccugcgcgccgacaccaucagcucccagaucgagcucgccgugcugcugucgaacgaggggaucaucaauuccgaggacgagcaccuccuggcccuggagcggaagcucaagaagaugcugggccccagcgcggucgagaucgggaacggcugcuucgagaccaagcacaagugcaaccagaccugccuggaccgcaucgccgccgggaccuuugacgccggcgaguucucccuccccacguucgacucgcugaacaucaccgcggccucccugaacgacgacggccucgacaaccauaccauccugcuguacuacagcaccgccgccuccucgcuggccgugacgcucaugaucgcgaucuucguggucuacauggugucccgggacaacgugagcugcagcaucugccuguga

SEQ ID NO: 14301 - RNA, 1758 nt, Artificial Sequence; identical to SEQ ID NO: 14265
  derived and/or modified CDS sequence (AUadapt) from InfluenzaB__ACN32611__HA

SEQ ID NO: 14302 - RNA, 1755 nt, Artificial Sequence; identical to SEQ ID NO: 14166
  derived and/or modified CDS sequence (AUadapt) from InfluenzaB__ACN32716__HA

SEQ ID NO: 14303 - RNA, 1758 nt, Artificial Sequence; identical to SEQ ID NO: 14254
  derived and/or modified CDS sequence (AUadapt) from InfluenzaB__ACN32771__HA

SEQ ID NO: 14304 - RNA, 1758 nt, Artificial Sequence; identical to SEQ ID NO: 14260
  derived and/or modified CDS sequence (AUadapt) from InfluenzaB__ACN32782__HA

SEQ ID NO: 14305 - RNA, 1758 nt, Artificial Sequence
  derived and/or modified CDS sequence (AUadapt) from InfluenzaB__ACO05957__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugccccaagugucugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcauauccgccugucgacccacaacgugaucaacgccgagaacgcgccgggcgggcccuacaagaucggcaccuccgggagcugccccaacgucacgaacggcaacggcuucuucgccaccauggccugggccgugcccaagaaugacaacaacaagaccgcgaccaacucccucacgaucgaggugccguacaucugcaccgagggggaggaccagaucaccgucuggggcuuccacucggacaacgagauccagauggccaagcuguacggggacuccaagccccagaaguuuaccagcuccgccaacggcgugacgacccacuacgugucgcagaucggcggguuccccaaccagaccgaggacggcgggcugccccaguccggccggaucgucguggacuacauggugcagaaguccgggaagaccggcacgaucaccuaccagcgcggcauccuccugccgcagaaggucuggugcgccuccgggcggagcaaggugaucaagggcucgcugccccucaucggggaggccgauugccugcacgagaaguacggcgggcugaacaaguccaagcccuacuacaccggcgagcacgcgaaggccaucggcaacugccccaucugggugaagaccccgcucaagcuggccaacgggacgaaguaccgcccgcccgccaagcugcucaaggagcggggcuucuucggggccaucgcgggcuuucuggagggcgggugggagggcaugaucgccggguggcacggcuacaccucgcacggggcccacggcgucgccguggccgcggaccugaaguccacccaggaggccaucaacaagaucaccaagaaccucaacagccuguccgagcuggaggucaagaaccuccagcgccugucgggcgccauggacgagcugcacaaugagauccucgagcuggacgagaagguggacgaccugcgggccgacacgaucuccagccagaucgagcucgccgugcugcuguccaacgaggggaucaucaacucggaggacgagcaccuccuggcgcuggagcgcaagcucaagaagaugcugggccccuccgccgucgagaucgggaacggcugcuucgagaccaagcauaagugcaaccagaccugccuggaccggaucgccgccgggaccuucgacgcgggcgaguucagccuccccaccuucgacucccugaacaucacggccgccucgcugaacgacgauggccucgacaaccacaccauccugcuguacuacuccaccgccgccagcucccuggcggugacccucaugaucgccaucuucguggucuacauggugucgcgcgacaacguguccugcagcaucugccuguga

SEQ ID NO: 14306 - RNA, 1755 nt, Artificial Sequence
  derived and/or modified CDS sequence (AUadapt) from InfluenzaB__ACO05968__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacugcaccgaucuggacguggcccucgggcggcccaugugcgugggcaccacgccguccgccaaggccagcauccugcacgagguccgccccgugaccuccggcugcuuccccaucaugcacgaucggaccaagauccgccagcugcccaaccuccugcggggguacgagaacauccgccugucgacccagaacgugaucgacgcggagaaggccccgggcgggcccuaccggcucggcacguccgggagcugucccaacgccaccuccaagagcggcuucuucgccaccauggcgugggccguccccaaggacaacaacaagaaugccaccaacccgcugacgguggaggugcccuacaucugcaccgagcgcgaggaccagaucaccgucuggggcuuccacuccgacaacaagacccagaugaagaaucuguacggggacagcaacccccagaaguucacguccagcgccaacggcgugaccacccauuacgugucccagaucgggucguuccccgaccagaccgaggacggcggccucccgcaguccgggcggaucgucguggacuacaugaugcagaagcccggcaagacggggaccaucguguaccagcgcggcguccugcugccccagaagguguggugugccagcgggcggagcaaggugaucaagggcucccucccccugaucggcgaggcggacugccugcacgagaaguacgggggccucaacaagaguaagccguacuacaccggggagcacgccaaggccaucggcaacugccccaucugggucaagacgccccugaagcuggccaacgggaccaaguaccggcccccggccaagcuccugaaggagcgcggcuucuuuggcgcgaucgccggguuccuggagggcgggugggagggcaugaucgccggguggcacggcuacaccucccacggcgcccacgggguggccgucgcggccgaccucaagucgacccaggaggccaucaauaagaucaccaagaaccugaacucccugagcgagcucgaggugaagaaccugcagcgccuguccggcgccauggacgagcuccacaacgagauccuggagcuggacgagaagguggaugaccuccgggccgacacgaucagcucccagaucgagcuggcgguccugcucagcaacgaggggaucaucaacuccgaggacgagcaucuccuggcccuggagcgcaagcugaagaagaugcugggccccagcgccguggagaucggcaacgggugcuucgagaccaagcacaagugcaaccagaccugccucgaucggaucgccgcgggcaccuucaacgccggggaguucucccugcccaccuucgacucgcugaacaucacggccgccucccucaaugacgacggccuggacaaccacaccauccugcuguacuacagcaccgccgcguccagucucgccgugacccugaugcuggccaucuucaucgucuacauggugucccgcgacaacgugagcugcagcaucugccucuga

SEQ ID NO: 14307 - RNA, 1755 nt, Artificial Sequence
  derived and/or modified CDS sequence (AUadapt) from InfluenzaB__ACO05979__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacugcaccgaucuggacguggcccucgggcggcccaugugcgugggcaccacgccguccgccaaggccagcauccugcacgagguccgccccgugaccuccggcugcuuccccaucaugcacgaucggaccaagauccgccagcugcccaaccuccugcggggguacgagaacauccgccugucgacccagaacgugaucgacgcggagaaggccccgggcgggcccuaccggcucggcacguccgggagcugucccaacgccaccuccaagagcggcuucuucgccaccauggcgugggccguccccaaggacaacaacaagaaugccaccaacccgcugacgguggaggugcccuacaucugcaccgagggcgaggaccagaucaccgucuggggguuccacuccgacaacaagacccagaugaagaaucuguacggcgacagcaacccccagaaguucacguccagcgccaacggggugaccacccauuacgugucccagaucggcucguuccccgaccagaccgaggacggcgggcucccgcaguccggccgcaucgucguggacuacaugaugcagaagcccgggaagacgggcaccaucguguaccagcgcgggguccugcugccccagaagguguggugugccagcggccggagcaaggugaucaagggcucccucccccugaucggggaggcggacugccugcacgagaaguacggcgggcucaacaagaguaagccguacuacaccggcgagcacgccaaggccaucgggaacugccccaucugggucaagacgccccugaagcuggccaacggcaccaaguaccggcccccggccaagcuccugaaggagcgcggcuucuuuggggcgaucgccggcuuccuggagggcgggugggaggggaugaucgccggcuggcacggcuacaccucccacggggcccacggcguggccgucgcggccgaccucaagucgacccaggaggccaucaauaagaucaccaagaaccugaacucccugagcgagcucgaggugaagaaccugcagcggcuguccggggccauggacgagcuccacaacgagauccuggagcuggacgagaagguggaugaccuccgcgccgacacgaucagcucccagaucgagcuggcgguccugcucagcaacgagggcaucaucaacuccgaggacgagcaucuccuggcccuggagcggaagcugaagaagaugcugggccccagcgccguggagaucgggaacggcugcuucgagaccaagcacaagugcaaccagaccugccucgaucgcaucgccgcggggaccuucaacgccggcgaguucucccugcccaccuucgacucgcugaacaucacggccgccucccucaaugacgacgggcuggacaaccacaccauccugcuguacuacagcaccgccgcguccagucucgccgugacccugaugcuggccaucuucaucgucuacauggugucccgggacaacgugagcugcagcaucugccucuga

SEQ ID NO: 14308 - RNA, 1755 nt, Artificial Sequence; identical to SEQ ID NO: 14307
  derived and/or modified CDS sequence (AUadapt) from InfluenzaB__ACO05990__HA

SEQ ID NO: 14309 - RNA, 1758 nt, Artificial Sequence
  derived and/or modified CDS sequence (AUadapt) from InfluenzaB__ACO06001__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugccccaagugccugaacuguaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugucgacccacaaugugaucaacgccgagaacgcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucuguaccgagggggaggaccagaucaccgucuggggcuuccacucggacaacgagaaccagauggccaagcuguacggggacuccaagccccagaaguucaccucguucgccaacggcgugacgacccacuacgugucccagaucggcggguuucccaaccagaccgaggacggcgggcugccccagagcggccggaucgucguggacuacauggugcagaaguccgggaagaccggcacgaucaccuaccagcgcggcauccuccugccgcagaaggucuggugcgccucggggcgguccaaggugaucaagggcagccugccccucaucggggaggccgacugccugcacgagaaguacggcgggcugaacaagucgaagcccuauuacaccggcgagcacgcgaaggccaucggcaacugccccaucugggugaagaccccgcucaagcuggccaacgggacgaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucaccaagaaccucaauucccugagcgagcuggaggucaagaaccuccagcgccuguccggcgccauggacgagcugcacaacgagauccucgagcuggacgagaagguggacgaccugcgggccgacacgaucucgucccagaucgagcucgccgugcugcugucgaacgaggggaucaucaacuccgaggacgagcaccuccuggcgcuggagcgcaagcucaagaagaugcugggccccagugccgucgagaucgggaacggcugcuucgagaccaagcacaagugcaaccagaccugccuggaccggaucgccgccgggaccuucgacgcgggcgaguucucccuccccaccuucgacucgcugaacaucacggccgccucccugaaugacgacggccucgacaaccacaccauccugcuguacuacagcaccgccgccuccucgcuggcggugacccucaugaucgccaucuucguggucuacauggugucccgcgacaacgugagcugcuccaucugccuguga

SEQ ID NO: 14310 - RNA, 1755 nt, Artificial Sequence; identical to SEQ ID NO: 14307
  derived and/or modified CDS sequence (AUadapt) from InfluenzaB__ACO06012__HA

SEQ ID NO: 14311 - RNA, 1755 nt, Artificial Sequence; identical to SEQ ID NO: 14307
  derived and/or modified CDS sequence (AUadapt) from InfluenzaB__ACO06023__HA

SEQ ID NO: 14312 - RNA, 1755 nt, Artificial Sequence
  derived and/or modified CDS sequence (AUadapt) from InfluenzaB__ACO06062__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuauuucgccaaccugaaggggacgcggacccgcggcaagcucugccccgacugccugaacugcaccgaccuggauguggcccucgggcggcccaugugcgugggcaccacgccguccgccaaggccucgauccugcacgagguccgccccgugaccuccggcugcuuccccaucaugcacgaccggaccaagauccgccagcugcccaaccuccugcggggguaugagaacauccgccugagcacccagaacgugaucgacgcggagaaggccccgggcgggcccuaccggcucggcacguccgggagcugccccaacgccaccuccaagaguggcuucuucgccaccauggcgugggccguccccaaggacaacaacaagaacgccaccaacccgcugacgguggaggugcccuacaucuguaccgagggcgaggaccagaucaccgucuggggguuccacuccgacaacaagacccagaugaagaaccuguacggcgacaguaacccccagaaguucacguccagcgccaacggggugaccacccacuacgugucccagaucgacagcuuucccgaccagaccgaggacggcggccucccgcaguccgggcgcaucgucguggacuacaugaugcagaagcccggcaagacggggaccaucguguaccagcggggcguccugcugccccagaagguguggugcgccagcgggcgcucgaaggugaucaagggcucccucccccugaucggcgaggcggacugucugcacgagaaguacgggggccucaacaagagcaagccguacuacaccggggagcacgccaaggccaucggcaacugucccaucugggucaagacgccccugaagcuggccaacgggaccaaguaccggcccccggccaagcuccugaaggagcgcggcuucuucggcgcgaucgccggguuccuggagggcgggugggagggcaugaucgccggguggcacggcuacaccucccacggcgcccaugggguggccgucgcggccgaccucaagagcacccaggaggccaucaacaagaucaccaagaaccugaacucccugagcgagcucgaggugaagaaccugcagcggcuguccggcgccauggacgagcuccauaacgagauccuggagcuggacgagaagguggacgaccuccgcgccgacacgaucucgucccagaucgagcuggcgguccugcucagcaacgaggggaucaucaauuccgaggacgagcaccuccuggcccuggagcggaagcugaagaagaugcugggccccagcgccguggagaucggcaacgggugcuucgagaccaagcacaagugcaaucagaccugccucgaccgcaucgccgcgggcaccuucaacgccggggaguucucccugcccaccuucgacagccugaauaucacggccgccucccucaacgacgacggccuggacaaccacaccauccugcuguacuacaguaccgccgcguccagccucgccgugacccugaugcuggccaucuucaucgucuacauggugucccgggacaacgugagcugcagcaucugccucuga

SEQ ID NO: 14313 - RNA, 1758 nt, Artificial Sequence
  derived and/or modified CDS sequence (AUadapt) from InfluenzaB__ACO94661__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugccccaagugucugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcauauccgccugucgacccacaacgugaucaacgccgagaacgcgccgggcgggcccuacaagaucggcaccuccgggucgugccccaacgucacgaacggcaacggcuucuucaccaccauggccugggccgugcccaagaaugacaacaacaagaccgccacgaacucccucaccaucgaggugccguacaucugcaccgagggggaggaccagaucaccgucuggggcuuccacagcgacaacgagacgcagauggcgaagcuguacggggacuccaagccccagaaguuuaccucguccgccaacggcgugaccacccacuacgugagccagaucggcggguuccccaaccagacggaggacggcgggcugccccaguccggccggaucgucguggacuacauggugcagaaguccgggaagaccggcaccaucaccuaccagcgcggcauccuccugccgcagaaggucuggugcgccuccgggcggucgaaggugaucaagggcucgcugccccucaucggggaggccgauugccugcacgagaaguacggcgggcugaacaaguccaagcccuacuacacgggcgagcacgccaaggcgaucggcaacugccccaucugggugaagaccccgcucaagcuggccaacgggaccaaguaccgcccgcccgccaagcugcucaaggagcggggcuucuucggggccaucgccggcuuucuggagggcgggugggagggcaugaucgcgggguggcacggcuacaccagccacggggcccacggcgucgccguggccgccgaccugaaguccacgcaggaggcgaucaacaagaucaccaagaaccucaacucgcuguccgagcuggaggucaagaaccuccagcgccugagcggcgccauggacgagcugcacaaugagauccucgagcuggacgagaagguggacgaccugcgggccgacaccaucuccucgcagaucgagcucgccgugcugcuguccaacgaggggaucaucaacucggaggacgagcaccuccuggcccuggagcgcaagcucaagaagaugcugggccccuccgcggucgagaucgggaacggcugcuucgagaccaagcauaagugcaaccagaccugccuggaccggaucgccgccgggacguucgacgccggcgaguucagccuccccaccuucgacucccugaacaucaccgcggccucgcugaacgacgauggccucgacaaccacaccauccugcuguacuacuccacggccgccagcucccuggccgugacccucaugaucgcgaucuucguggucuacauggugucgcgcgacaacguguccugcagcaucugccuguga

SEQ ID NO: 14314 - RNA, 1758 nt, Artificial Sequence; identical to SEQ ID NO: 14254
  derived and/or modified CDS sequence (AUadapt) from InfluenzaB__ACR15622__HA

SEQ ID NO: 14315 - RNA, 1758 nt, Artificial Sequence
  derived and/or modified CDS sequence (AUadapt) from InfluenzaB__ACR15633__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccacuucgccaaucugaaggggacggagacccggggcaagcucugccccaagugccugaacugcaccgaccuggacguggcccucgggcgccccaagugcaccggcaacaucccguccgcccgggugucgauccugcacgagguccgccccgugacguccggcugcuuucccaucaugcacgaccggaccaagauccgccagcugcccaaccuccugcggggguacgagcacauccgccugagcacccacaacgugaucaacgccgagaacgcgccgggcgggcccuacaagaucggcaccuccgggaguugccccaacgucacgaacggcaacggcuucuucgccaccauggccugggccgugcccaagaacgacaacaacaagaccgcgaccaacucccucacgaucgaggugccguauaucugcaccgagggggaggaccagaucaccgucuggggcuuccacagcgacuccgagacccagauggccaagcuguacggggacucgaagccccagaaguucacguccagcgccaauggcgugaccacccacuacgugucccagaucggcggguuccccaaccagaccgaggacggcgggcugccccagucgggccggaucgucguggacuacauggugcagaaguccgggaagacgggcaccaucaccuaccagcgcggcauccuccugccgcagaaggucuggugcgccagcgggcggucgaaggugaucaagggcucccugccccucaucggggaggccgauugccugcacgagaaguacggcgggcugaacaagagcaagcccuacuacaccggcgagcacgcgaaggccaucggcaacugccccaucugggugaagacgccgcucaagcuggccaacgggaccaaguaucgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagugagcuggaggucaagaaccuccagcgccuguccggcgccauggacgagcugcacaacgagauccucgagcuggacgagaagguggacgaccugcgggccgacaccaucagcucccagaucgagcucgccgugcugcugucgaacgaggggaucaucaauuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuuugacgcgggcgaguucucccuccccacguucgacucgcugaacaucaccgccgccucccugaacgacgacggccucgacaaccauaccauccugcuguacuacagcaccgccgccuccucgcuggcggugacgcucaugaucgccaucuucguggucuacauggugucccgcgacaacgugagcugcagcaucugccuguga

SEQ ID NO: 14316 - RNA, 1755 nt, Artificial Sequence
  derived and/or modified CDS sequence (AUadapt) from InfluenzaB__ACR15644__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaaguccuacuucgccaaccugaaggggacgcggacccgcggcaagcucugccccgacugucugaacugcaccgaccuggacguggcccucgggcggcccaugugcgugggcaccacgccguccgccaaggccagcauccugcaugagguccgccccgugaccuccggcugcuuccccaucaugcacgaccggaccaagauccgccagcugcccaaccuccugcggggguacgagaacauccgccugaguacccagaacgugaucgacgcggagaacgccccgggcgggcccuaccggcucggcacguccgggagcugccccaaugccaccuccaagagcggcuucuucgccaccauggcgugggccguccccaaggacaacaacaagaaugccaccaacccgcugacgguggaggugcccuacgucugcaccgagggcgaggaccagaucaccguguggggguuccacuccgauaacaagauccagaugaagaaccuguacggcgacagcaacccccagaaguucaccuccagugccaacggggugacgacccacuacgucucccagaucggcggcuuccccgcccagaccgaggacgggggccucccgcagagcgggcgcaucgugguggauuacaugguccagaagccccggaagaccggcacgaucguguaccagcgcggggugcugcugccccagaaggucuggugcgcguccggccggagcaaggugaucaagggcagccucccccugaucggggaggccgacugucugcacgagaaguacggcgggcucaacaaguccaagccguacuacaccggcgagcacgccaaggccaucgggaauugccccaucugggucaagacgccccugaagcuggccaacggcaccaaguaccggcccccggcgaagcuccugaaggagcgcggcuucuucggggccaucgccggcuuccuggagggcgggugggaggggaugaucgccggcuggcacggcuauaccagccacggggcccacggcguggcgguggccgccgaccucaaguccacccaggaggccaucaacaagaucaccaagaaccugaauagccuguccgagcucgaggucaagaaccugcagcgccugagcggggccauggacgagcuccacaacgagauccuggagcuggaugagaagguggacgaccuccgggcggacaccaucuccagccagaucgagcuggccgugcugcucuccaacgagggcaucaucaacagugaggacgagcaccuccuggcccuggagcgcaagcugaagaagaugcugggccccuccgccgucgacaucgggaacggcugcuucgagacgaagcacaaguguaaccagaccugccucgaccggaucgcggccgggaccuucaacgccggcgaguucagucugcccaccuucgacucccugaacaucaccgccgccagccucaacgacgaugggcuggacaaccacacgauccugcuguacuacuccaccgcggccagcucccucgccgugacccugaugcuggccaucuuuaucguguacauggucagccgcgacaacguguccugcagcaucugccucuga

SEQ ID NO: 14317 - RNA, 1758 nt, Artificial Sequence
  derived and/or modified CDS sequence (AUadapt) from InfluenzaB__ACR15655__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugucccaagugccugaacugcaccgaccuggacguggcccucgggcgccccaagugcaccggcaacaucccguccgcccgggugagcauccugcacgagguccgccccgugacguccggcugcuuccccaucaugcacgaucggaccaagauccgccagcugcccaaccuccugcggggguacgagcacauccgccugucgacccacaacgugaucaacgccgagaacgcgccgggcgggcccuacaagaucggcaccuccgggagcugccccaacgucacgaauggcaacggcuucuucgccaccauggccugggccgugcccaagaacgacaacaacaagaccgcgaccaacucccucacgaucgaggugccguacaucugcaccgagggggaggaccagaucaccgucuggggcuuccacagugacuccgagacccagauggccaagcuguacggggacagcaagccccagaaguucacguccucggccaacggcgugaccacccacuacgugucccagaucggcggguuccccaaccagaccgaggacggcgggcugccccagaguggccggaucgucguggacuacauggugcagaaguccgggaagacgggcaccaucaccuaccagcgcggcauccuccugccgcagaaggucuggugcgccucggggcggagcaaggugaucaagggcucccugccccucaucggggaggccgacugccugcacgagaaguacggcgggcugaacaagucgaagcccuauuacaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccauggcgucgccguggccgcggaccugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucaguucccagaucgagcucgccgugcugcugagcaacgaggggaucaucaacuccgaggacgagcaccuccuggcgcuggagcgcaagcucaagaagaugcugggccccucggccgucgagaucgggaacggcugcuucgagaccaagcacaagugcaaccagaccugucuggaccggaucgccgccgggaccuucgacgcgggcgaguucucccuccccacguucgacagccugaacaucaccgccgccucccugaacgacgacggccucgacaaucacaccauccugcuguacuacucgaccgccgccuccagccuggcggugacgcucaugaucgccaucuucguggucuacauggugucccgcgacaacaucucgugcagcaucugccuguga

SEQ ID NO: 14318 - RNA, 1758 nt, Artificial Sequence
  derived and/or modified CDS sequence (AUadapt) from InfluenzaB__ACR15666__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugucccaagugccugaacugcaccgaccuggacguggcccucgggcgccccaagugcaccggcaacaucccguccgcccgggugagcauccugcacgagguccgccccgugacguccggcugcuuccccaucaugcacaaucggaccaagauccgccagcugcccaaccuccugcggggguacgagcacauccgccugucgacccacaacgugaucaacgccgagaacgcgccgggcgggcccuacaagaucggcaccuccgggagcugccccaacgucacgaauggcaacggcuucuucgccaccauggccugggccgugcccaagaacgacaacaacaagaccgcgaccaacucccucacgaucgaggugccguacaucugcaccgagggggaggaccagaucaccgucuggggcuuccacagugacgacgagacccagauggccaagcuguacggggacuccaagccccagaaguucacgagcuccgccaacggcgugaccacccacuacgugucgcagaucggcggguuccccaaccagaccgaggauggcgggcugccccaguccggccggaucgucguggacuacauggugcagaaguccgggaagacgggcaccaucaccuaccagcgcggcauccuccugccgcagaaggucuggugcgccuccgggcggagcaaggugaucaagggcucgcugccccucaucggggaggccgacugccugcacgagaaguacggcgggcugaacaaguccaagcccuacuauaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccucgcacggggcccauggcgucgccguggccgcggaccugaaguccacccaggaggccaucaacaagaucacgaagaaccucaacagccuguccgagcuggaggucaagaaccuccagcgccugucgggcgccauggacgagcugcacaacgagauccucgagcuggacgagaagguggacgaccugcgggccgauaccaucuccagccagaucgagcucgccgugcugcuguccaacgaggggaucaucaacucggaggacgagcaccuccuggcgcuggagcgcaagcucaagaagaugcugggccccuccgccgucgagaucgggaacggcugcuucgagaccaagcacaagugcaaccagaccugucuggaccggaucgccgccgggaccuucgacgcgggcgaguucagccuccccacguucgacucccugaacaucaccgccgccucgcugaacgacgacggccucgauaaccacaccauccugcuguacuacuccaccgccgccagcucccuggcggugacgcucaugaucgccaucuucguggucuacauggugucgcgcgacaacguguccugcagcaucugccuguga

SEQ ID NO: 14319 - RNA, 1758 nt, Artificial Sequence
  derived and/or modified CDS sequence (AUadapt) from InfluenzaB__ACR15677__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggauguggcccucgggcgccccaagugcaccggcaacaucccguccgccaaggugucgauccugcacgagguccggcccgugacguccggcugcuuccccaucaugcacgaccgcaccaagauccggcagcugcccaaccuccugcgcggguacgagcacauccggcugucgacccacaacgugaucaacgccgagaaggcgccgggcgggcccuacaagaucggcaccuccgggagcugucccaacaucacgaacggcaacggcuucuucgccaccauggccugggccguccccaagaacgacaacaacaagaccgcgaccaacucccucacgaucgaggugccguacaucugcaccgagggggaggaccagaucaccguguggggcuuccacucggacaaugaggcccagauggccaagcuguacggggacuccaagccccagaaguucaccucguccgccaacggcgucacgacccacuacgugagccagaucggcggguuccccaaccagaccgaggacggcgggcugccccaguccggccgcaucguggucgacuacauggugcagaaguccgggaagaccggcacgaucaccuaccagcggggcauccuccugccgcagaagguguggugcgccuccgggcgcucgaaggucaucaagggcucgcugccccucaucggggaggcggauugccugcacgagaaguacggcgggcugaacaaguccaagcccuacuacaccggcgagcacgccaaggccaucggcaacugccccaucugggugaagaccccgcucaagcuggccaacgggacgaaguaccggccgcccgccaagcugcucaaggagcgcggcuucuucggggcgaucgccggcuuccuggagggcgggugggagggcaugaucgccggguggcacggcuacaccagccauggggcccacggcguggccgucgcggccgaccugaaguccacccaggaggccaucaacaagaucaccaagaaccucaacucgcuguccgagcuggaggugaagaaccuccagcggcugucgggcgccauggacgagcugcacaacgagauccucgagcuggacgagaaggucgacgaccugcgcgccgacacgaucuccagccagaucgagcucgcggugcugcuguccaacgaggggaucaucaauucggaggacgagcaccuccuggcccuggagcggaagcucaagaagaugcugggccccuccgccguggagaucgggaacggcugcuucgagaccaagcacaagugcaaccagaccugccuggaccgcaucgccgcggggaccuucgacgccggcgaguucucgcuccccaccuucgacucccugaauaucacggccgccagccugaacgacgacggccucgacaaccacaccauccugcuguacuacuccaccgccgcgucgucccuggccgucacccucaugaucgccaucuucgugguguacauggucucgcgggacaacguguccugcagcaucugccuguga

SEQ ID NO: 14320 - RNA, 1755 nt, Artificial Sequence; identical to SEQ ID NO: 14307
  derived and/or modified CDS sequence (AUadapt) from InfluenzaB__ACR15710__HA

SEQ ID NO: 14321 - RNA, 1755 nt, Artificial Sequence
  derived and/or modified CDS sequence (AUadapt) from InfluenzaB__ACR15721__HA
augaaggccaucaucgugcugcucauggucgugaccaguaacgccgaccgcaucugcaccggcaucacguccagcaacaguccccacguggucaagaccgcgacccagggggaggugaacgugaccggcgucaucccgcugacgaccacccccaccaagucccacuucgccaaccugaaggggacgaagacccggggcaagcucugucccaacugccugaacugcaccgaccuggauguggcccucgggcgccccaugugcgugggcaccacgccguccgccaaggccagcauccugcacgagguccggcccgugaccuccggcugcuuccccaucaugcacgaucgcaccaagauccggcagcugcccaaccuccugcgcggguacgagaacauccggcugagcacccagaacgugaucaaugcggagaaggccccgggcgggcccuaccgccucggcacguccgggagcugccccaacgccaccucccggagcggcuuuuucgccaccauggcgugggccgucccccgcgacgacaacaagaccgccacgaacccgcugaccguggaggugcccuaugucugcaccgagggcgaggaccagaucaccguguggggguuccacuccgacaacaaggcccagaugaagaaucuguacggcgacagcaacccccagaaguucacguccagugccaacggggugaccacccacuacgucucccagaucggcggcuuccccgaccagaccgaggaugggggccucccgcagagcgggcggaucgugguggacuacaugguccagaagcccggcaagacggggaccaucguguaccagcgcggcgugcugcugccccagaaggucuggugcgcguccggccggaguaaggugaucaaggggagccucccccugaucggcgaggccgacugccugcacgagaaguacgggggccucaacaaguccaagccguauuacaccggggagcacgccaaggccaucggcaacugccccaucugggucaagacgccccugaagcuggccaacggcaccaaguaucggcccccggcgaagcuccugaaggagcgcggguucuucggcgccaucgccggguuccuggagggcgggugggagggcaugaucgccggcuggcacggguacaccagucacggcgcccacgggguggcgguggccgccgaccucaaguccacccaggaggccaucaacaagaucaccaagaaccugaauagccuguccgagcucgaggucaagaaccugcagcgccugagcggcgccauggacgagcuccacaacgagauccuggagcuggaugagaagguggacgaccuccgggcggacacgaucuccagccagaucgagcuggccgugcugcucuccaacgagggcaucaucaauagcgaggacgagcaccuccuggcccuggagcgcaagcugaagaagaugcuggggcccuccgccgucgacaucggcaacggguguuucgagaccaagcacaagugcaaccagaccugccucgaucggaucgcggccggcaccuucaacgccggggaguucagccugcccaccuucgacucccugaauaucacggccgccagccucaacgacgacggccuggacaaucacaccauccugcuguacuacuccaccgcggccagcucccucgccgugacccugaugaucgccaucuucaucguguauauggucagccgcgacaacguguccugcagcaucugccuguga

SEQ ID NO: 14322 - RNA, 1758 nt, Artificial Sequence
  derived and/or modified CDS sequence (AUadapt) from InfluenzaB__ACR39336__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccacuucgccaaucugaaggggacggagacccggggcaagcucugccccaagugccugaacugcaccgaccuggacguggcccucgggcgccccaagugcaccggcaacaucccguccgcccgggugucgauccugcacgagguccgccccgugacguccggcugcuuucccaucaugcacgaccggaccaagauccgccagcugcccaaccuccugcggggguacgagcacauccgccugagcacccacaacgugaucaacgccgagaacgcgccgggcgggcccuacaagaucggcaccuccgggaguugccccaacgucacgaacggcaacggcuucuucgccaccauggccugggccgugcccaagaacgacaacaacaagaccgcgaccaacucccucacgaucgaggugccguauaucugcaccgagggggaggaccagaucaccgucuggggcuuccacagcgacaacgaggcccagauggccaagcuguacggggacuccaagccccagaaguucaccucguccgccaauggcgugacgacccacuacgugagccagaucggcggguuccccaaccagaccgaggacggcgggcugccccaguccggccggaucgucguggacuacauggugcagaaguccgggaagaccggcacgaucaccuaccagcgcggcauccuccugccgcagaaggucuggugcgccuccgggcggucgaaggugaucaagggcagccugccccucaucggggaggcggauugccugcacgagaaguacggcgggcugaacaaguccaagcccuacuacaccggcgagcacgccaaggccaucggcaacugccccaucugggugaagaccccgcucaagcuggccaacgggacgaaguaccgcccgcccgccaagcugcucaaggagcggggcuuuuucggggcgaucgccggcuuccuggagggcgggugggagggcaugaucgccggguggcacggcuacaccucgcacggggcccacggcgucgccguggcggccgaccugaaguccacccaggaggccaucaacaagaucaccaagaaccucaacagucuguccgagcuggaggucaagaaccuccagcgccugucgggcgccauggacgagcugcacaacgagauccucgagcuggacgagaagguggacgaccugcgggccgacacgaucuccagccagaucgagcucgcggugcugcuguccaacgaggggaucaucaauucggaggacgagcaccuccuggcccuggagcgcaagcucaagaagaugcugggccccuccgccgucgagaucgggaacggcugcuucgagaccaagcacaagugcaaccagaccugccuggaccggaucgccgcggggaccuuugacgccggcgaguucagccuccccaccuucgacucccugaacaucacggccgccucgcugaacgacgacggccucgacaaucacaccauccugcuguacuacuccaccgccgcgagcucccuggccgugacccucaugaucgccaucuucguggucuacauggugucgcgcgacaacguguccugcagcaucugccuguga

SEQ ID NO: 14323 - RNA, 1755 nt, Artificial Sequence
  derived and/or modified CDS sequence (AUadapt) from InfluenzaB__AEA51386__HA
augaaagccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaaguccuacuucgccaaccugaaggggacgcggacccgcggcaagcucugccccgacugccugaauugcaccgaccuggacguggcccucgggcggcccaugugcgugggcaccacgccguccgccaaggccagcauccugcacgagguccgccccgugaccuccggcuguuuccccaucaugcacgaccggaccaagauccgccagcugcccaaccuccugcggggguacgagaacauccgccugagcacccagaaugugaucgacgcggagaaggccccgggcgggcccuaccggcucggcacguccgggagcugccccaacgccaccuccaagagcggcuucuuugccaccauggcgugggccguccccaaggacaacuacaagaacgccaccaacccgcugacgguggaggugcccuacaucuguaccgagggcgaggggcagaucaccgucuggggcuuccacuccgacaacaagccccagaugaagaaccuguacggggacaguaacccccagaaguucaccuccagcgccuccggcgugacgacccacuacgugagccagaucggcgacuuuccggaccagaccgaggacgggggccucccccaguccgggcgcaucgucguggacuacaugaugcagaagcccggcaagaccgggacgaucguguaccagcggggcguccugcugccccagaagguguggugcgccaguggccgcagcaaggugaucaaggggucccucccgcugaucggcgaggcggacugccugcacgagaaguacgggggccucaacaagagcaagcccuauuacaccggggagcacgccaaggccaucggcaacugccccaucugggucaucacgccccagaagcuggccaacggcaccaccuucuccccgcccgccaagcugcucaaggagcggggguuuuucggcgcgaucgccggguuccuggagggcgggugggagggcaugaucgccggcuggcacggguacaccagccacggcgcccacgggguggccgucgcggccgaucugaaguccacccaggaggccaucaacaagaucaccaagaaccucaacagccuguccgagcuggaggugaagaaccuccagcgccugagcggcgccauggacgagcugcauaacgagauccucgagcuggacgagaagguggacgaccugcgggccgacacgaucuccagccagaucgagcucgcgguccugcuguccaaugagggcaucaucaacagcgaggacgagcaccuccuggcccuggagcgcaagcucaagaagaugcuggggcccuccgccguggacaucggcaacgggugcuuugagaccaagcacaagugcaaccagaccugccuggaccggaucgccgcgggcaccuucaacgccggggaguuuagccuccccaccuucgacucccugaacaucacggccgccagccugaacgaugacggccucgacaaccacaccauccugcuguacuacuccaccgccgcgagcucccuggccgugacccucaugcuggccaucuuuaucgucuacauggugagccgcgacaacgugagcugcuccaucugccuguga

SEQ ID NO: 14324 - RNA, 1755 nt, Artificial Sequence
  derived and/or modified CDS sequence (AUadapt) from InfluenzaB__AEA51387__HA
augaaggccaucaucgugcugcucauggucgugaccaguaacgccgaccgcaucugcaccgagaucacguccagcaacuccccgcugguggucaagaccgcgacccagggcgaggugaacgugaccggggucaucccgcugacgaccacccccaccaagagcuacuuugccaaccucaagggcacgcggacccgcgggaagcugugccccgacugccugaacugcaccgaccucgacguggcccugggccggcccauguguguggggaccacgccguccgccaaggccagcauccugcacgagguccgccccgugaccuccggcugcuuccccaucaugcacgaccggaccaagauccgccagcuccccaaccugcugcggggcuacgagaauauccgccucagcacccagaacgugaucgacgcggagaaggcccccgggggccccuaccggcuggggacguccggcucgugccccaacgccaccuccaagaucggguucuuugccaccauggcgugggccguccccaaggacaacuacaagaacgccaccaacccgcugacgguggaggugcccuacaucugcaccgagggcgaggaccagaucaccgucuggggcuuucacagcgacaacaagacccagaugaagaaccucuacggggacuccaacccccagaaguuuacgagcuccgccaacggcgugaccacccacuacgugagccagaucggggacuuccccgaccagaccgaggauggcggccugccgcaguccgggcgcaucgucguggacuacaugaugcagaagcccggcaagacggggcccaucguguaccagcggggcguccugcucccccagaagguguggugcgccagcgggcgcuccaaggugaucaagggcagccugccgcugaucggcgaggcggacugccuccacgagaaguaugggggccugaacaagucgaaguacucccacaccggggaccacgccaagacccugggcaacugccccaucugggucaagacgccccucaagcuggccaaugggaccaaguaccggcccccggccaagcugcucaaggagcgcggcuucuucggcgccaucgcgggguuccuggagggcgggugggagggcaugaucgccggguggcacggcuacaccagccacggcgcccaugggguggccgucgccgcggaccugaaguccacccaggaggccaucaacaagaucaccaagaaccucaacagccuguccgagcuggaggugaagaaccuccagcggcugagcggcgccauggacgagcugcauaacgagauccucgagcuggacgagaagguggacgaccugcgcgccgacacgaucuccagccagaucgagcucgccguccugcuguccaacgaggggaucaucaacagugaggacgagcaccuccuggcgcuggagcggaagcucaagaagaugcugggccccuccgccguggacaucggcaacgggugcuucgagaccaagcacaagugcaaucagaccugccuggaccgcaucgccgccggcaccuucaacgcgggggaguucagccuccccaccuucgacucccugaauaucacggccgccagccugaacgacgacggccuggacaaccacaccauccuccuguacuauuccaccgccgccagcucccuggcggugacccucaugcuggccaucuucaucgucuacauggugagccgggacaacguguccugcagcaucugccuguga

SEQ ID NO: 14325 - RNA, 1755 nt, Artificial Sequence
  derived and/or modified CDS sequence (AUadapt) from InfluenzaB__AEA51388__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuauuucgccaaccugaaggggacgcggacccgcggcaagcucugccccgacugccugaacugcaccgaccuggauguggcccucgggcggcccaugugcgugggcaccacgccguccgccaaggccucgauccugcacgagguccgccccgugaccuccggcugcuuccccaucaugcacgaccggaccaagauccgccagcugcccaaccuccugcggggguaugagaacauccgccugagcacccagaacgugaucgacgcggagaaggccccgggcgggcccuaccggcucggcacguccgggagcugccccaacgccaccuccaagaucggcuuuuucgccaccauggcgugggccguccccaaggacaacuacaagaacgccaccaacccgcugacgguggaggugcccuacaucugcaccgagggcgaggaucagaucaccgucuggggguuccacagcgacaacaagacccagaugaagaaccuguacggcgacuccaacccccagaaguuuacgucguccgccaacggggugaccacccacuacgugagccagaucggcgacuuccccgaccagaccgaggauggcgggcucccgcaguccggccgcaucgucguggacuacaugaugcagaagcccgggaagacgggcaccaucguguaccagcgcgggguccugcugccccagaagguguggugcgccagcggccgguccaaggugaucaagggcagccucccccugaucggggaggcggacugccugcaugagaaguacggcgggcucaacaagucgaagccguccuacaccggcgagcacgccaaggccaaggggaacugccccaucugggucaacacgccccugaagcuggccaauggcaccaaguaccggcccccggccaagcuguucaaggagcgcggcuucuucggggcgaucgccggcuuccucgagggcgggugggaggggaugaucgccggcuggcacggcuacaccagccauggggcccacggcguggccgucgcggccgaccugaaguccacccaggaggccaucaacaagaucaccaagaaccucaacagccuguccgagcuggaggugaagaaccuccagcggcugucgggggccauggacgagcugcauaacgagauccucgagcuggacgagaagguggacgaccugcgcgccgacacgaucuccagccagaucgagcucgcgguccugcuguccaacgagggcaucaucaacagugaggacgagcaccuccuggcccuggagcggaagcucaagaagaugcugggccccuccgccguggacaaggggaacggcugcuucgagaccaagcacaagugcaaucagaccugccuggaccgcaucgccgcggggaccuucaacgccggcgaguucagccuccccaccuucgacucccugaauaucacggccgccucgcugaacgacgacgggcucgacaaccacaccauccugcuguacuauuccaccgccgcgagcucccuggccgugacccucaugcuggccaucuucaucgucuacauggugagccgggacaacguguccugcagcaucugccuguga

SEQ ID NO: 14326 - RNA, 1755 nt, Artificial Sequence
  derived and/or modified CDS sequence (AUadapt) from InfluenzaB__AEA51389__HA
augaaggccaucaucgugcugcucauggucgugaccaguaacgccgaccgcaucugcaccggcaucacguccagcaucagcccccugguggauaagaccgcgacccagggggaggucaacgugaccggcgugaucccgcugacgaccacccccaccaaguccuacuucgccaacgucaaggggacgcggacccgcggcaagcucugccccgacugucugaacugcaccgaccuggacguggcccucgggcggcccaugugcgugggcaccacgccguccgccaaggccagcauccugcaugagguccgccccgugaccuccggcugcuuccccaucaugcacgaccggaccaagauccgccagcugcccaaccuccugcggggguacgagaauauccgccugagcacccagaacgugaucgacgcgcagaaggccccgggcgggcccuaccggcucggcacguccgggagcugccccaaugccaccuccaagaucggcuucuucgccaccauggcgugcgccguccccaaggacaacuacaagaaugccaccaacccgcugacgguggaggugcccuacauccgcaccgagggcgaggaccagaucaccgucuggggguuccacagcgauaacaagacccagaugaagaaccuguacggcgacuccaacccgcccaaguuuacgagcuccgccaacggggugaccacccacuacgugagccagaccggcgacuuucccgaccagacggaggacggcgggcucccgcccuccggccggaucgucguggacuacaugaugcagaagcccgggaagaccggcaccaucgccuaccagcgcggggugcugcugccccagaaggucuggugcgcgaguggccgguccaaggugaucaagggcagccucccccugaucggggaggccgacugccugcacgagaaguacggcgggcucaacaagaguaagccgccccacaccggcgagcacacgaaggccaucgggaacugccccaucugggugaagacgccccugaagcuggccaacggcaccaaguaccgccccuccgccaagcuccugaaggagcggggcuuuuucggggcgaucgccggcuuccuggagggcgggugggaggggaugaucgccggcuggcacggcuacaccagccacggggcccauggcgucgccguggcggccgaccucaaguccacccaggaggccaucaacaagaucaccaagaaccugaacagccuguccgagcucgaggucaagaaccugcagcgccugaguggggccauggacgagcuccacaacgagauccuggagcuggacgagaagguggacgaucuccgggccgacaccaucuccagccagaucgagcuggcggugcugcucuccaacgagggcaucaucaacagcgaggacgagcaucuccuggcccuggagcgcaagcugaagaagaugcugggccccuccgccgucgacaucgggaacggcugcuucgagaccaagcacaagugcaaucagaccugccucgaccggaucgccgcggggacguucaacgccggcgaguucuuccugccgaccuuugacagccugaacaucaccgccgccucccucaacgacgacgggcuggauaaccacaccauccugcuguacuacagcacggccgcguccagccucgccgugacccugaugcuggccaucuuuaucguguacauggucucccgcgacaacgugagcugcuccaucugccucuga

SEQ ID NO: 14327 - RNA, 1755 nt, Artificial Sequence
  derived and/or modified CDS sequence (AUadapt) from InfluenzaB__AEA51390__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaaguccuacuucgccaaccugaaggggacgcggacccgcggcaagcucugccccgacugccugaauugcaccgaccuggacguggcccucgggcggcccaugugcgugggcaccacgccguccgccaaggccagcauccugcacgagguccgccccgugaccuccggcugcuuucccaucaugcacgaccggaccaagauccgccagcugcccaaccuccugcggggguacgagaacauccgccugagcacccagaaugugaucgacgcggagaaggccccgggcgggcccuaccggcucggcacguccgggagcugccccaacgccaccuccaagaucggcuucuucgccaccauggcgugggccguccccaaggauaacuacaagaacgccaccaacccgcugacgguggaggugcccuacaucugcaccgagggcgaggaccagaucaccgucuggggguuucacagcgacaacaagacccagaugaagaaccuguacggcgauuccaacccccagaaguucacgagcuccgccaacggggugaccacccacuacgugagccagaucggcgauuuccccgaccagaccgaggacggcgggcucccgcccuccggccgcaucgucguggacuacaugaugcagaagcccgggaagacgggcaccaucguguaccagcgcgggggccugcugccccagaaggucuggugcgccaguggccgguccaaggugaucaaggggagccucccgcugaucggcgaggcggacugccugcacgagaaguacgggggccucaacaagaguaagcccuacuacaccggggagcacgccaaggccaucggcaacugccccaucugggugaagcccccgcugaagcuggccaacggcaccaaguaccggccgcccgccaagcuguuuaaggagcgcggguucuucggcgcgcuggccggguuccuggagggcgggugggagggcaugaucgccggcuggcacggguacacgucccacggcgcccacggggucgccguggcggccgaucucaagagcacccaggaggccaucaacaagaucaccaagaaccugaacucccugagcgagcucgaggucaagaaccugcagcggcuguccggcgccauggaugagcuccacaacgagauccuggagcuggacgagaagguggacgaccuccgcgccgacaccaucagcucccagaucgagcuggcggugcugcucaguaacgagggcaucaucaacuccgaggacgagcaccuccuggcccucgagcggaagcugaagaagaugcuggggcccagcgccgucgacaucggcaacggguguuucgagacgaagcacaagugcaaccagaccugccucgaccgcaucgccgcgggcaccuuuaacgccggggaguucucccugcccaccuucgacagccugaacaucaccgccgccucccucaacgaugacggccuggacaaccacacgauccugcuguacuacagcaccgccgcguccagucucgccgugacccugaugcuggccaucuucaucguguacauggucucccgggacaacgugagcugcuccaucugccucuga

SEQ ID NO: 14328 - RNA, 1758 nt, Artificial Sequence
  derived and/or modified CDS sequence (AUadapt) from InfluenzaB__AEA51391__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugccccaagugucugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcauauccgccugucgacccacaacgugaucaacgccgagaacgcgccgggcgggcccuacaagaucggcaccuccgggagcugccccaacaucacgaacggcaacggcuucuucgccaccauggccugggccguccccaagaaugacaagaacaagaccgcgaccaacccgcucacgaucgaggugcccuacaucugcaccgagggggaggaccagaucaccguguggggcuuccacuccgucaacgagacccagauggccaagcuguacggggacucgaagccccagaaguucacguccagugccaacggcgugaccacccacuacaucucccagaucggcggguuccccaaccagaccgaggacggcgggcugccgcagagcggccggaucguggucgacuacauggugcagaaguccgggaagacgggcaccaucaccuaccagcgcggcauccuccugccccagaagguguggugcgccucggggcgguccaaggucaucaagggcagccugccccucaucggggaggccgacugucugcacgagaaguacggcgggcugaacaagucgaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuucuggagggcgggugggagggcaugaucgccggguggcacggcuacaccucccacggggcccacggcgugcccgucgccgccgaccugaaguccacccaggaggcgaucaacaagaucacgaagaaccucaacucccugagcgagcuggaggugaagaaccuccagcgccuguccggcgccauggacgagcugcacaacgagauccucgagcuggaugagaaggucgacgaccugcgggccgacaccaucucgucccagaucgagcucgccgugcugcugucgaacgaggggaucaucaacuccgaggacgagcaccuccuggcccuggagcgcaagcucaagaagaugcugggccccagcgcgguggagaucgggaacggcugcuucgagaccaagcauaagugcaaccagaccugccuggaccggaucgccgccgggaccuucgacgccggcgaguucucccuccccacguucgacucgcugaacaucaccgcggccucccugaacgacgauggccucgacaaccacaccauccugcuguacuacagcaccgccgccuccucgcuggccgucacgcucaugaucgcgaucuucgugguguacauggucucccgcgacaacgugagcugcuccaucugccuguga

SEQ ID NO: 14329 - RNA, 1758 nt, Artificial Sequence
  derived and/or modified CDS sequence (AUadapt) from InfluenzaB__AEA51392__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuuugccaaccugaaggggacggagacccggggcaagcucugccccaagugccccaacugcaccgaccuggacguggcccuggggcgcccgaagugcaccggcaagauccccuccgcccgggugucgauccuccacgagguccgccccgugacguccggcugcuuucccaucaugcacgaccggaccaagauccgccagcugccgaaccugcuccggggguacgagcacauccgccugagcacccacaacgugaucaacgccgagaacgcgcccggcgggcccuacaagaucggcaccuccgggaguugccccaacgucacgaacggcaacggcuucuucgccaccauggccugggccgugccgaagaacgacaagaacaagaccgcgaccaacccccugacgaucgaggugcccuacaucuguaccgagggggaggaccagaucaccgucuggggcuuccacuccgacaacgagacccagauggccaagcucuacggggacagcaagccccagaaguucacguccucggccaacggcggcaccacccauuacgugucccagaucgggggcuucccgaaccagaccgaggacgggggccugccccagucggggcggaucguggucgacuacauggugcagaaguccggcaagacgggcaccaucaccuaccagcgcgggauccugcucccccagaagguguggugcgccagcggccgguccaaggucaucaaggggucgcugccccugaucggcgaggccgauugccuccacgagaaguacgggggccugaacaagucgaagccguacuacaccggcgagcacgcgaaggccaucgggaacugccccaucugggugaagacgccccugaagcucgccaacggcaccaagaauaucgcccccgccaagcugcugaaggagcgcggguucuucggcgcgaucgccggguuccucgagggcggcugggaggggaugaucgccggcuggcacggguacaccucccacggcgcccacggcguggccgucgcggccgaccugaaguccacccaggaggccaucaacaagaucacgaagaaccugaacucccucagugagcuggaggugaagaaccugcagcggcucuccggggccauggacgagcugcacaacgagauccuggagcucgacgagaaggucgacgaccugcgcgccgacaccaucucgucccagaucgagcuggcggugcuccugagcaacgagggcaucaucaauuccgaggacgagcaccuccuggcccuggagcggaagcugaagaagaugcucgggccgucggccguggagaucggcaacgggugcuucgagaccaagcacaagugcaaccagaccugccuggaccgcaucgccgcgggcaccuuugacgccggcgaguucucccugcccacguucgacucgcucaacaucaccgccgccucccugaacgacgacgggcuggacaaccauaccauccuccuguacuacagcaccgccgcguccucgcuggccgucacgcugaugaucgccaucuucgugguguacauggucucccgggacaacgugagcugcuccaucugccucuga

SEQ ID NO: 14330 - RNA, 1755 nt, Artificial Sequence
  derived and/or modified CDS sequence (AUadapt) from InfluenzaB__AEA51395__HA
augaaagccaucaucgugcugcucauggucgugaccaguaacgccgaccgcaucugcaccggcaucacguccagcaacagcccccacguggucaagaccgcgacccugggggaggugaacgugaccggcgucaucccgcugacgaccacccccaccaaguccuauuucgccaaccucaaggggacgcggacccgcggcaagcugugccccgacugccugaacugcaccgaccucgauguggcccuggggcggcccaugugcgugggcaccacgccguccgccaaggccagcauccugcacgagguccgccccgugaccuccggcugcuuccccaucaugcacgaccggaccaagauccgccagcuccccaaccugcugcggggguaugagaacauccgccucagcacccagaacgugaucgacgcggagaaggccccgggcgggcccuaccggcugggcacguccgggagcugccccaacgccaccuccaagaucggcuuuuucgccaccauggcgugggccguccccaaggacaacuacaagaacgccaccaacccgcugacgguggaggugcccuacaucugcaccgagggcgaagaucaguucaccgucuggggguuccacagcgacaacaucacccagcucaagaaccuguucggcgauuccaacccccagcgcuucacgagcuccgccaacggggugaccacccacuacgugagccagaucggcgacuuucccgaccagaccgaggacggcgggcugccgcaguccggccggaucgucguggacuacgugaugcagaagcccgggaagacgggcaccaucgucuaccagcgcggggugcuccugccgcccaaggugugguucgcccggggccgcagcaaggucaucaagggcucccugccccucaucggggaggcggacugcauccaugagaaguacggcgggcugaacaagagcaaacccuacuacaccggcgagcacgccaaggccaucgggaacugccccaucugggugaagacgccccugaagcucgccaauggcaccaaguaccggccgcccgccaagcugcugaaggagcgcggcuucuucggggcgaucgccggcuuccucgagggcgggugggaggggaugaucgccggcuggcacggcuacaccagccacggggcccauggcgucgccguggcggccgaccugaaguccacccaggaggccaucaacaagaucaccaagaaccugaacagccucuccgagcuggaggugaagaaccugcagcggcucagcggggccauggacgaacugcauaacgagauccuggagcucgacgagaaggucgacgaccugcgcgccgacacgaucuccagccagaucgagcuggcggugcuccuguccaacgagggcaucaucaacagugaggacgagcaccuccuggcccuggagcggaagcugaagaagaugcucggccccuccgccguggacaucgggaacggcugcuucgagaccaagcacaagugcaaucagaccugccuggaccgcaucgccgcggggaccuucaacgccggcgaguucagccugcccaccuucgacucccucaauaucacggccgccagccugaacgacgacgggcuggacaaccacaccauccugcucuacuauuccaccgccgcgagcucccuggccgucacccugaugcucgccaucuucaucguguacauggugagccgggacaacgucuccugcagcaucugccuguga

SEQ ID NO: 14331 - RNA, 1758 nt, Artificial Sequence
  derived and/or modified CDS sequence (AUadapt) from InfluenzaB__AEA51398__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagucccacuucgccaaccugaaggggacggagacccggggcaagcucugccccaagugccccaacugcaccgaucuggacguggcccuggggcgcccgaagugcaccggcaagauccccuccgcccgggugagcauccuccacgagguccgccccgugacguccggcugcuuccccaucaugcacgaccggaccaagauccgccagcugccgaaccugcuccggggguacgagcacauccgccugucgacccacaacgugaucaacgccgagaaugcgcccggcgggcccuacaagaucggcaccuccgggagcugccccaacgucacgaacggcaucggcuucuucgccaccauggccugggccgugccgaagaacgacaagaacaagaccgcgaccaacccccugacgaucgaggugcccuacaucugcaccgagggggaggaccagaucaccgucuggggcuuccacuccgauaacgagacccagauggccaagcucuacggggacucgaagccccagaaguucacguccagcgccaacggcgugaccacccacuacgugucccagaucggcggguucccgaaccagaccgaggacggcgggcugccccagagcggccggaucgucguggacuacauggugcagaaguccgggaagacgggcaccaucaccuaucagcgcggcauccugcucccccagaaggucuggugcgccucggggcgguccaaggugaucaagggcagccugccccugaucggggaggccgacugccuccacgagaaguacggcgggcugaacaagucgaaguccuacuacaccggcgagcacgcgaaggccaucggcaacugcccgaucugggugaagacgccccugaagcucgccaacgggaccaaguaccgcccgcccgcccaucugagcuacuucugcggcuucuucggggccaucgcgggcuuccuggagggcgggugggagggcaugaucgccggguggaacggcuacaccucccacggggcccacggcgucgccguggucgccgaccucaagucgacccaggaggcgaucaacaagaucacgaagaaccugaauucccugagcgagcucgaggugaagaaccugcagcggcuguccggcgccauggacgagcuccacaacgagauccuggagcuggacgagaagguggacgaccuccgcgccgacaccaucagcucccagaucgagcuggccguccugcucucgaacgaggggaucaucaacuccgaggacgagcaccuccuggcccuggagcggaagcugaagaagaugcugggccccagcgcgguggagaucgggaauggcugcuucgagaccaagcacaagugcaaccagaccugccucgaccgcaucgccgccgggaccuucgacgccggcgaguucucccugcccacguucgacucgcugaacaucaccgcggccucccucaacgaugacggccuggacaaccacaccauccugcucuacuacagcaccgccgccuccucgcuggccgugacgcugaugaucgcgaucuucgucguguacauggugucccgggacaacgucagcugcagcaucugccuguga

SEQ ID NO: 14332 - RNA, 1758 nt, Artificial Sequence
  derived and/or modified CDS sequence (AUadapt) from InfluenzaB__AEA51399__HA
augaaggccaucaucgugcugcucauggucgugaccaguaacgccgaccgcaucugcaccggcaucacggcgucccagagccccaacaucgacaaguccucgacccagggggaggugaacgucaccggcgugaucccgcugaccacgacccccaccaagucccacuucgccaaccugaaggggaccgagacgcggggcaagcucugccccaagugccccaacugcaccgaccuggacguggcccuggggcgcccgaaguguaccggcaagauccccagcgcccgggucuccauccuccacgaggugcgccccgugaccucgggcugcuuccccaucaugcacgaccggacgaagauccgccagcugccgaaccugcuccggggguacgagcacauccgccuguccacccacaacgucaucaacgccgagaacgcgcccggcgggcccuacaagaucggcaccagcggguccugccccaacgugaccaauggcaucggcuucuucgccacgauggccugggccgugccgaagaacgacaagaacaagaccgcgaccaacccccugaccaucgagguccccuacaucugcacggagggggaggaccagaucaccguguggggcuuccacucggacaacgagacccagauggccaagcucuacggggacuccaagccccagaaguucaccaguuccgccaacggcgugacgacccacuacgucucgcagaucggcggguucccgaaccagaccgaggacggcgggcugccccaguccggccggaucgugguggacuacaugguccagaaguccgggaagaccggcacgaucaccuaccagcgcggcauccugcucccccagaagguguggugcgccagcgggcggucgaaggugaucaagggcagccugccccugaucggggaggccgacugccuccacgagaaguacggcgggcugaauaaguccaagucguacuacaccggcgagcacgcgaaggccaucggcaacugcccgaucugggucaagacgccccugaagcucgccaacgggaccaaguaccgcccgcccgcccaccuguccuacuucugcggcuucuucggggccaucgcgggcuuccuggagggcgggugggagggcaugaucgccggguggaacggcuacaccagucacggggcccacggcguggccguggucgccgaccucaaguccacccaggaggcgaucaacaagaucaccaagaaccugaacucgcuguccgagcucgaggugaagaaccugcagcggcugagcggcgccauggacgagcuccacaacgagauccuggagcuggacgagaaggucgacgaccuccgcgccgacacgaucuccucgcagaucgagcuggccgugcugcucuccaacgaggggaucaucaauagcgaggacgagcaccuccuggcccuggagcggaagcugaagaagaugcugggccccuccgcgguggagaucgggaacggcugcuucgagaccaagcacaagugcaaccagaccugccucgaccgcaucgccgccgggaccuucgacgccggcgaguucucgcugcccaccuucgacucccugaauaucacggcggccagccucaacgacgacggccuggacaaccacaccauccugcucuacuacuccaccgccgccucgucccuggccgucacccugaugaucgcgaucuucgugguguacauggucagccgggacaacgugagcugcuccaucugccuguga

SEQ ID NO: 14333 - RNA, 1758 nt, Artificial Sequence
  derived and/or modified CDS sequence (AUadapt) from InfluenzaB__AEG21014__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccacuucgccaaucugaaggggacggagacccggggcaagcucugccccaagugccugcacugcaccgaccuggacguggcccucgggcgccccaagugcaccggcaagaucccguccgcccgggugucgauccugcacgagguccgccccgugacguccggcugcuuccccaucaugcaugaccggaccaagauccgccagcugcccaaccuccugcggggguacgagcacauccgccugagcacccacaacgugaucaacgccgagaacgcgccgggcgggcccuacaagaucggcaccuccgggucgugucccaacgucacgaacggcaacggcuucuucgccaccauggccugggccgugcccaagaacgacaacaacaagaccgcgaccaacucccucacgaucgaggugccguacaucuguaccgagggggaggaccagaucaccgucuggggcuuccacagcgacaacgagacccagauggccaagcuguacggggacuccaagccccagaaguucacgucguccgccaacggcgugaccacccauuacgugagccagaugggcggguuccccaaccagaccgaggacggcgggcugccccaguccggccggaucgucguggacuacauggugcagaaguccgggaagacgggcaccaucaccuaccagcgcggcauccuccugccgcagaaggucuggugcgccuccgggcggagcaaggugaucaagggcucgcugccccucaucggggaggccgauugccugcacgagaaguacggcgggcugaacaaguccaagcccuacuacaccggcgagcacgcgaaggccaucggcaacugccccaucugggugaagacgccgcucaagcuggccaacgggaccaaguaccgcccgcccgccaagcugcucauggagcggggcuuuuucggggccaucgcgggcuuccuggagggcgggugggagggcaugaucgccggguggcacggcuacaccagccacggggcccacggcgucgccguggccgcggaccugaaguccacccaggaggccaucaacaagaucacgaagaaccucaacagucuguccgagcuggaggucaagaaccuccagcgccugagcggcgccauggacgagcugcacaacgagauccucgagcuggacgagaagguggacgaccugcgggccgacaccaucuccucgcagaucgagcucgccgugcugcuguccaacgaggggaucaucaauagcgaggacgagcaccuccuggcgcuggagcgcaagcucaagaagaugcugggccccuccgccgucgagaucgggaacggcugcuucgagaccaagcacaagugcaaccagaccugccuggaccggaucgccgccgggaccuuugacgcgggcgaguucucgcuccccacguucgacucccugaacaucaccgccgccagccugaacgacgacggccucgacaaucacaccauccugcuguacuacuccaccgccgccucgucccuggcggugacgcucaugaucgccaucuucguggucuacauggugagccgcgacaacguguccugcagcaucugccuguga

SEQ ID NO: 14334 - RNA, 1755 nt, Artificial Sequence
  derived and/or modified CDS sequence (AUadapt) from InfluenzaB__AEG21015__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaagagcuacuucgccaaccugaaggggacgcggacccgcggcaagcucugccccgauugccugaacugcaccgaccuggacguggcccucgggcggcccaugugcgugggcaccacgccguccgccaaggccaguauccugcacgagguccgccccgugaccuccggcugcuuccccaucaugcacgaccggaccaagauccgccagcugcccaaccuccugcggggguacgagaauauccgccugagcacccagaacgugaucgacgcggagaaggccccgggcgggcccuaccggcucggcacguccgggagcugccccaaugccaccuccaagaacggcuucuucgccaccauggcgugggccguccccaaggacaacuacaagggcgccaccaauccgaagacgguggaggugcccuacaucugcaccgagggggagggccagaucaccgucuggggguuccacagcgacaauaagccccagaugaagaaccuguacggcgacuccaacccccagaaguucaccagcuccgccagcggcgugacgacccauuacgugucccagaucggggacuucccggaccagaccgaggacggcgggcugccccagagcggccgcaucgucguggauuacaugaugcagaagcccgggaagaccggcacgaucguguaccagcggggcguccuccugccccagaagguguggugcgccuccgggcgcagcaaggugaucaagggcagccugccgcucaucggggaggcggacugucugcacgagaaguacggcgggcugaacaaguccaagcccuacuacaccggcgagcacgccaaggccaucggcaauugccccaucugggucaucacgccccagaagcucgccaacgggaccaccuucagcccgcccgccaagcugcugaaggagcggggcuucuucggggcgaucgccggcuuccucgagggcgggugggagggcaugaucgccggguggcauggcuacaccucccacggggcccacggcguggccgucgcggccgaccugaaguccacccaggaggccaucaacaagaucaccaagaaccugaauucccucagcgagcuggaggugaagaaccugcagcgccucuccggcgccauggacgagcugcacaacgagauccuggagcucgacgagaagguggaugaccugcgggccgacacgaucagcucccagaucgagcuggcgguccuccugagcaacgaggggaucaucaacuccgaggaugagcaccuccuggcccuggagcgcaagcugaagaagaugcucggccccagcgccguggacaucgggaacggcugcuucgagaccaagcacaaguguaaccagaccugccuggaccggaucgccgcggggaccuucaacgccggcgaguucucccugcccaccuuugacagccucaacaucacggccgccucccugaacgacgacggccuggauaaccacaccauccuccuguacuacagcaccgccgcguccagccuggccgugacccugaugcucgccaucuuuaucgucuacauggugucccgcgacaacgugagcugcagcaucugccuguga

SEQ ID NO: 14335 - RNA, 1755 nt, Artificial Sequence
  derived and/or modified CDS sequence (AUadapt) from InfluenzaB__AEG21016__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaaguccuacuucgccaaccugaaggggacgcggacccgcggcaagcucugccccgacugucugaacugcaccgaccuggacguggcccucgggcggcccaugugcgugggcaccacgccguccgccaaggccagcauccugcaugagguccgccccgugaccuccggcugcuuccccaucaugcacgaccggaccaagauccgccagcugcccaaccuccugcggggguacgagaauauccgccugagcacccagaacgugaucgacgcggagaaggccccgggcgggcccuaccggcucggcacguccgggagcugccccaacgccaccuccaagaucggcuuuuucgccaccauggcgugggccguccccaaggacaacuacaagcgcgccaccaacccgaagacgguggaggugcccuacaucuguaccgagggcgaggaccagaucaccgucuggggguuccacagcgacaacaagccccagaugaagaaucccuacggcgacuccaacccgcagaaguucaccagcuccgccagcggggugacgacccauuacgugucccagaucggcgacuuccccgaccagaccgaggacggcgggcugccccagagcggccggaucgucguggauuacaugaugcagaagcccgggaagaccggcacgaucguguaccagcgcgggguccugcucccgcagaagguguggugcgccuccggccggagcaaggugaucaagggcucgcugccccugaucggggaggcggacugccuccaugagaaguacggcgggcugaacaaguccaagcccuacuacaccggcgagcacgccaaggccaucgggaacugucccaucugggucaagaccccgcugaagcucgccaacggcaccaaguaccgcccgcccgccaagcugcugaaggagcggggcuucuucggggcgaucgccggcuuccucgagggcgggugggaggggaugaucgccggcuggcacggcuauacgagccacggggcccacggcguggccgucgcggccgaccugaaguccacccaggaggccaucaacaagaucaccaagaaccugaauagccucuccgagcuggaggugaagaaccugcagcgccucagcggggccauggacgagcugcacaacgagauccuggagcucgaugagaagguggacgaccugcgggccgacaccaucuccagccagaucgagcuggcgguccuccuguccaacgagggcaucaucaacagcgaggaugagcaccuccuggcccuggagcgcaagcugaagaagaugcucggccccuccgccguggacaucgggaacggcugcuucgagacgaagcacaaguguaaccagaccugccuggaccggaucgccgcggggaccuucaacgccggcgaguucagucugcccaccuucgacucccucaacaucaccgccgccagccugaacgacgaugggcuggacaaccacacgauccuccuguacuacuccaccgccgcgagcucccuggccgugacccugaugcucgccaucuuuaucgucuacauggugagccgcgacaacguguccugcagcaucugccuguga

SEQ ID NO: 14336 - RNA, 1755 nt, Artificial Sequence
  derived and/or modified CDS sequence (AUadapt) from InfluenzaB__AEG21017__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacugcaccgaucuggacguggcccucgggcggcccaugugcgugggcaccacgccguccgccaaggccagcauccugcacgagguccgccccgugaccuccggcugcuuccccaucaugcacgaucggaccaagauccgccagcugcccaaccuccugcggggguacgagaacauccgccugagcacccagaacgugaucgacgcggagaaggccccgggcgggcccuaccggcucggcacguccgggucgugucccaacgccaccuccaagaucggcuucuucgccaccauggcgugggccguccccaaggacaacuacaagaacgccaccaauccgcugacgguggaggugcccuacaucugcaccgagggcgaggaccagaucaccgucuggggguuccacagcgacaacaagacccagaugaagaaucuguacggcgacuccaacccccagaaguucacgagcuccgccaacggggugaccacccacuaugugagccagaucggcgacuuccccgaccagaccgaggacggcgggcucccgcaguccggccgcaucgucguggacuacaugaugcagaagcccgggaagacgggcaccaucguguaccagcgcgggguccugcugccccagaagguguggugugccagcggccgguccaaggugaucaagggcagccucccccugaucggggaggcggacugccugcacgagaaguacggcgggcucaacaagaguaagccguccuacaccggcgagcacgccaaggccaucgggaacugccccaucugggucaagacgccccugaagcuggccaacggcaccaaguaccggcccccggccaagcuccugaaggagcgcggcuucuucggggcgaucgccggcuuucuggagggcgggugggaggggaugaucgccggcuggcacggcuacaccagccacggggcccacggcguggccgucgcggccgaccucaaguccacccaggaggccaucaacaagaucaccaagaaucugaacagccuguccgagcucgaggugaagaaccugcagcggcugagcggggccauggacgagcuccacaacgagauccuggagcuggacgagaagguggaugaccuccgcgccgacacgaucuccagccagaucgagcuggcgguccugcucuccaacgagggcaucaucaacucggaggacgagcaucuccuggcccuggagcggaagcugaagaagaugcugggccccuccgccguggacaucgggaacggcugcuucgagaccaagcacaagugcaaccagaccugccucgaucgcaucgccgcggggaccuucaacgccggcgaguucagccugcccaccuucgacucccugaacaucacggccgccagucucaacgacgacgggcuggacaaccacaccauccugcuguacuacuccaccgccgcgaguucccucgccgugacccugaugcuggccaucuucaucgucuacauggugagccgggacaacguguccugcagcaucugccucuga

SEQ ID NO: 14337 - RNA, 1755 nt, Artificial Sequence
  derived and/or modified CDS sequence (AUadapt) from InfluenzaB__AEG21018__HA
augaaggccaucaucgugcugcucauggucgugaccaguaacgccgaccgcaucugcaccggcaucacguccagcaucagcccccugguggacaagaccgcgacccagggggaggucaaugugaccggcgugaucccgcugacgaccacccccaccaagagcuacuucgccaacgucaaggggacgcggacccgcggcaagcucugccccgacugucugaacugcaccgaccuggacguggcccucgggcggcccaugugcgugggcaccacgccguccgccaaggccagcauccugcaugagguccgccccgugaccuccggcugcuuccccaucaugcacgaccggaccaagauccgccagcugcccaaccuccugcggggguacgagaauauccgccugagcacccagaacgugaucgacgcgcagaaggccccgggcgggcccuaccggcucggcacguccgggagcugccccaaugccaccuccaagaucggcuucuucgccaccauggcgugcgccguccccaaggacaacuacaagaaugccaccaacccgcugacgguggaggugcccuacauccgcaccgagggcgaggaccagaucaccgucuggggguuccacagcgauaacaagacccagaugaagaaccuguacggcgacuccaacccgcccaaguucacgaguuccgccaacggggugaccacccacuacgugagccagaccggcgacuuccccgaucagacggaggacggcgggcucccgcccuccggccggaucgucguggacuacaugaugcagaagcccgggaagaccggccccaucgccuaccagcgcggggugcugcugccccagaaggucuggugcgcgagcggccgguccaaggugaucaagggcagucucccccugaucggggaggccgacugccugcacgagaaguacggcgggcucaacaagagcaaguauucccacaccggcgaccacgccaagacccuggggaacugccccaucugggugaagacgccgcugaagcucgccaacggcaccaaguaucgccccagcgccaagcugcugaaggagcggggcuucuucggggcgaucgccggcuuccucgagggcgggugggaggggaugaucgccggcuggcacggcuacaccucccauggggcccacggcgucgccguggcggccgaccugaaguccacccaggaggccaucaacaagaucacgaagaaccugaacucccucagcgagcuggaggucaagaaucugcagcgccucuccggggccauggacgagcugcacaacgagauccuggagcucgacgagaagguggacgaccugcgggccgauaccaucagcucccagaucgagcuggcggugcuccugagcaacgagggcaucaucaacuccgaggacgagcaccuccuggcccuggagcgcaagcugaagaagaugcucggccccagugccgucgacaucgggaacggcugcuucgagaccaagcacaagugcaaucagaccugccuggaccggaucgccgcggggaccuucaacgccggcgaguucucccugcccacguucgauagccucaacaucaccgccgccucccugaacgacgacgggcuggacaaucacaccauccugcucuacuacagcaccgccgcguccagccuggccgugacgcugaugcucgccaucuucaucguguauauggucucccgcgacaacgugagcugcagcaucugccuguga

SEQ ID NO: 14338 - RNA, 1755 nt, Artificial Sequence
  derived and/or modified CDS sequence (AUadapt) from InfluenzaB__AEG21019__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacuguaccgaccuggacguggcccucgggcggcccaugugcgugggcaccacgccguccgccaaggccagcauccugcacgagguccgccccgugaccuccggcugcuuccccaucaugcaugaccggaccaagauccgccagcugcccaaccuccugcggggguacgagaacauccgccugagcacccagaacgugaucgacgcggagaaggccccgggcgggcccuaucggcucggcacguccgggucgugccccaacgccaccuccaagaucggcuucuucgccaccauggcgugggccguccccaaggacaacuauaagaacgccaccaacccgcugacgguggaggugcccuacaucugcaccgagggcgaggaccagaucaccgucuggggguuccacagugacaacaagacccagaugaagaaccuguacggcgacuccaacccccagaaguucacgaguuccgccaacggggugaccacccacuacgugagccagaccggcgacuuccccgaccagacggaggauggcgggcucccgcccuccggccgcaucgucguggacuacaugaugcagaagcccgggaagaccggcaccaucguguaccagcgcgggguccugcugccccagaagguguggugcgccagcggccgguccaaggugaucaagggcagccucccgcugaucggggaggcggacugccugcaugagaaguacggcgggcucaacaagucgaagcccuccuacaccggcgagcacgccaaggccaucgggaacugccccaucugggucaagacgccccugaagcuggccaauggcaccaaguaccggccgagcgccaagcuccugaaggagcgcggcuucuucggggcgaucgccggcuuccuggagggcgggugggaggggaugaucgccggcuggcacggcuacaccucccauggggcccacggcguggccgucgcggccgaccucaagagcacccaggaggccaucaacaagaucacgaagaaccugaacucccugagcgagcucgaggugaagaaucugcagcggcuguccggggccauggacgagcuccacaacgagauccuggagcuggacgagaagguggacgaccuccgcgccgacaccaucaguucccagaucgagcuggcgguccugcucagcaacgagggcaucaucaacuccgaggacgagcaccuccuggcccuggagcggaagcugaagaagaugcugggccccucggccguggacaucgggaauggcugcuucgagaccaagcacaagugcaaccagaccugccucgaccgcaucgccgcggggaccuuuaacgccggcgaguucucccugcccacguucgacagccugaacaucaccgccgccucccucaacgaugacgggcuggacaaccacaccauccugcuguacuacagcaccgccgcguccagucucgccgugacgcugaugcuggccaucuucaucgucuacauggugucccgggacaacgugagcugcagcaucugccucuga

SEQ ID NO: 14339 - RNA, 1758 nt, Artificial Sequence
  derived and/or modified CDS sequence (AUadapt) from InfluenzaB__AEG21021__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccacuucgccaaccugaaggggacggagacccggggcaagcucugucccaagugccugaacugcaccgaccuggacguggcccucgggcgccccaagugcaccggcaagaucccguccgcccgggugucgauccugcacgagguccgccccgugacguccggcugcuuccccauccugcacgaccggaccaagauccgccagcuccccaaucugcugcggggguacgagcacauccgccucagcacccacaacgugaucaacgccgagaacgcgccgggcgggcccuacaagaucggcaccuccgggagcugccccaacaucacgaacggcaacggcuuuuucgccaccauggccugggccguccccaagaacgacaagaacaagaccgcgaccaacccgcuguccaucgaggugcccuacaucugcacggagggggaggaccagaucaccguguggggcuuccacucggacaaugagacccagauggccaagcuguacggggacuccaagccccagaaguucaccagcuccgccaacggcgucgccacgcacuacgugucgcagaucggcggguuccccaaccagaccgaggacggcgggcucccgcaguccggccggaucguggucgacuauauggugcagaaguccgggaagaccggcaccaucacguaccagcgcggcauccugcugccccagaagguguggugcgccuccgggcggagcaaggucaucaagggcagccucccccuguucggggaggcggacugccugcacgagaaguacggcggguucaacaaguccaagcccuacuacaccggcgagcaugccaaggccaucggcaacugcccgaucugggugaagacgccccucaagcuggccaacgggaccaaguaccgcccgcccgccaagcuguucaaggagcggggcuucuucggggcgaucgccggcuuccucgagggcgggugggagggcaugaucgccggguggcacggcuacaccucgcacggggcccauggcguggccgucgcggccgaccugaaguccacccaggaggccaucaacaagaucaccaagaaccugaacagccucuccgagcuggaggugaagaaccugcagcgccucucgggcgccauggacgagcugcacaacgagauccuggagcucgacgagaaggucgacgaucugcgggccgacaccaucuccagccagaucgagcuggcggugcuccuguccaacgaggggaucaucaacagcgaggacgagcaccuccuggcccuggagcgcaagcugaagaagaugcucggccccuccgccguggagaucgggaacggcugcuucgagacgaagcacaagugcaaccagaccugucuggaccggaucgccgcggggaccuucgacgccggcgaguucucgcugcccaccuucgacucccucaacaucaccgccgccagccugaacgacgacggccuggauaaccacacgauccuccuguacuacuccaccgccgcgucgucccuggccgucacccugaugaucgccaucuucgugguguacauggucagccgcgacaacguguccugcagcaucugccucuga

SEQ ID NO: 14340 - RNA, 1758 nt, Artificial Sequence
  derived and/or modified CDS sequence (AUadapt) from InfluenzaB__AEG21022__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaagagccacuucgccaaccugaaggggacggagacccggggcaagcucugccccaagugccugaauugcaccgaccuggacguggcccucgggcgccccaagugcaccggcacgaccccguccgcccgggccucgauccugcacgaggugcgccccgucaccuccggcugcuuucccauccugcacgaccggaccaagauccgccagcuccccaaccugcugcggggguacgagcacauccgccucagcacgcauaacgugaucaacgcggagaacgccccgggcgggcccuacaagaucggcaccuccgggagcugccccaacaucaccaauggcaacggcuucuucgccaccauggccugggcggugcccaagaacgacaagaacaagacggccaccaacccgcuguccgucgaggugcccuauaucugcaccgagggggaggaccagaucaccguguggggcuuccacagcgacaaugagacgcagauggccaagcuguacggggacuccaagccccagaaguucaccucguccgccaacggcgucgccacccacuacgugagucagaucggcggguuccccaaccagaccgaggacggcgggcucccgcaguccggccggaucguggucgacuacauggugcagaaguccgggaagacgggcaccaucaccuaccagcgcggcauccugcugccccagcggggguggugcgcguccggccgcaguaaggugaucaaggggagccucccccuguucggcgaggccgacugccugcacgagaaguacgggggccucaauaaguccaagcccuacuacaccggcgagcacgccaaggccaucgggaacugcccgaucugggucaagacgccccugaagcuggccaacggcaccaaguaccggccgcccgcgaagcuguuuaaggagcgcggguucuucggcgccaucgccggguuccucgagggcggcugggaggggaugaucgccggcuggcacggguacaccagccacggcgcccauggcgugcccguggcggccgaccugaaguccacccaggaggccaucaacaagaucacgaagaaccucaacucgcuguccgagcuggaggucaagaaccuccagcggcugaguggggccauggacgagcugcacaacgagauccucgagcuggacgagaagguggacgaccugcgcgccgacaccaucuccagucagaucgagcucgcgguccugcuguccaacgagggcaucaucaacagcgaggacgagcaccuccuggcccuggagcggaagcucaagaagaugcuggggcccuccgccguggagaucggcaacgggugcuuugagaccaagcacaagugcaaccagaccugccuggaccgcaucgccgcgggcaccuucgaugccggcgaguucucgcuccccacguucgacucccugaacaucaccgccgccagccugaacgaugacgggcucgacaaccacaccauccugcuguacuacuccaccgccgcgagcucccuggccgugacgcucaugaucgccaucuuugucguguacauggugagccgggacaacgucuccugcagcaucugccuguga

SEQ ID NO: 14341 - RNA, 1755 nt, Artificial Sequence
  derived and/or modified CDS sequence (AUadapt) from InfluenzaB__AEG21023__HA
augaaggccaucaucgugcugcucauggucgugaccaguaacgccgaccgcaucugcaccggcaucacguccagcaacagcccccauguggucaagaccgcgacccugggggaggugaacgagaccggcgugaucccgcugacgaccacccccaccaaguccuacuucgccaaccucaaggggacgcggacccgcggcaagcugugccccgacugccugaauugcaccgaccucgacgucgcccuggggcggcccaugugcgugggcaccacgccguccgccaaggccagcauccugcacgaggugcgccccgucaccuccggcugcuuucccaucaugcacgaccggaccaagauccgccagcuccccaaccugcugcggggguacgagaacauccgccucagcacccagaaugugaucgacgcggagaaggccccgggcgggcccuaccggcugggcacguccgggagcugccccaacgccaccuccaagaucggcuucuucgccaccauggcgugggccgugcccaaggauaacuacaagaacgccaccaacccgcugacggucgaggugcccuacaucugcaccgagggcgaggaccagaucaccguguggggguuucacagcgacaacaagacccagaugaagaaccucuacggcgauuccaacccccagaaguucacgucguccgccaacgggguccccacccacuacgugagccagaucggcgauuucccggaccccaccgaggacggcgggcugccccaguccggccgcaucgggguggacuacaugaugcagaagcccggcaagaccgggacgaucgucuaccagcggggcgugcugcucccgcagaagguguggugcgccaguggccgcuccaaggucaucaaggggagccugccccugaucggcgaggcggacugccuccacgagaaguacgggggccugaacaagaguaagcccuacuacaccggggagcacgccaaggccaucggcaacugccccaucugggugaagaccccgcugaagcucgccaacggcaccaaguaccggccgcccgccaagcugcugaaggagcgcggguuuuucggcgcgaucuccggguuccucgagggcgggugggagggcaugaucgccggcuggcacggguacacgagccacggcgcccacgggguggccgucgccgcggaucugaaguccacccaggaggccaucaacaagaucaccaagaaccugaacagccucuccgagcuggaggugaagaaccugcagcggcucagcggcgccauggaugagcugcacaacgagauccuggagcucgacgagaaggucgacgaccugcgcgccgacaccaucuccucgcagaucgagcuggccgugcuccuguccaaugagggcaucaucaacagcgaggacgagcaccuccuggcgcuggagcggaagcugaagaagaugcucgggcccuccgccguggagaucggcaacgggugcuucgagacgaagcauaagugcaaccagaccugcagcgaccgcaucgccgccggcaccuucgaugcgggggaguucucccugcccaccuucgacagccugaacaucaccgccgccucccucaacgacgauggccuggacaaccacacgauccugcuguacuacagcaccgccgccuccagccucgcggucacccugaugaucgccaucuuugugguguacauggucucccgggacaacgugagcugcagcaucugccuguga

SEQ ID NO: 14342 - RNA, 1758 nt, Artificial Sequence
  derived and/or modified CDS sequence (AUadapt) from InfluenzaB__AEG21024__HA
augaaagccaucaucgugcugcucauggucgugaccaguaacgccgaccgcaucugcaccggcaucacguccagcuccagcccccacguggucaagaccgcgacccagggggaggugaacgugaccggcgucaucccgcugacgaccacccccaccaaguccuauuucgccaaccugaaggggacggagacccggggcaagcucugccccgacugccccaacugcaccgaccuggauguggcccuggggcgcccgaacugcuggggcaacauccccagcgcccggguguccauccuccacgagguccgccccgugaccagcggcugcuuccccaucaugcaugaccggacgaagauccgccagcugccgaaccugcuccggggguacgagcacauccgccuguccacccacaacgugaucaacgccgagaacgcgcccggcgggcccuauaagaucggcaccagcggguccugccccaacgucaccaacggcaacggcuucuucgccacgauggccugggccgugccgaaggacgauaagaacaacgcggccacccaccuccugaccaucgaggugcccuucuucugcaccgggggcgagcaccacaucgccgucuggggguuucccagcgacaacgacacgcugauggccaagcuguucggcgacuccaacccccaaauguucaguuccagcgccaacggcaccaccacccacuacgugucccagaucgggggcuucccgaaccagacggaggacgggggccucccccagagcgggcggaucguggucgauuacauggugcagaaguccggcaagaccggcaccaucgcguaccagcgcggggugcugcugccccagaaggucuggugcgccagcggccggagcaaggugaucaaggggucccucccccugaucggcgaggccgacugccugcaugagaaguacgggggccucaacaagagcaagccguacuacaccggcgagcacgccaaagccaucgggaacugccccaucugggugaagacgccccugaagcuggcgaauggcaccaaguaccggcccccggccaagcuccugaaggagcgcggguucuucggcgccaucgccggguuccuggagggcggcugggaggggaugaucgccggcuggcacggguacaccucccacggcgcgcacggcgucgccguggccgccgaucucaagagcacccaggaggccaucaacaagaucacgaagaaccugaacucccugagcgagcucgaggucaagaaccugcagcgccuguccggggcgauggacgagcuccacaaugaaauccuggagcuggacgagaagguggacgaccuccgggccgacaccaucagcucccagaucgagcuggccgugcugcucagcaacgagggcaucaucaacuccgaggaugagcaccuccuggcccuggagcgcaagcugaagaagaugcuggggcccagcgcggucgagaucggcaacgggugcuucgagaccaagcacaagugcaaccagaccugucucgaccggaucgccgccggcacguucgacgccggcgaguucucccugcccaccuucgacagccugaacaucaccgccgcgucccucaaugacgacgggcuggacaaccacaccauccugcuguacuacagcaccgccgccuccagucucgccgugacgcugaugaucgccaucuucguggucuacauggugucccgcgacaacgugagcugcagcaucugccuguga

SEQ ID NO: 14343 - RNA, 1755 nt, Artificial Sequence
  derived and/or modified CDS sequence (AUadapt) from InfluenzaB__AEG21025__HA
augaaggccaucaucgugcugcucauggucgugaccaguaacgccgaccgcaucugcaccggcaucacguccagcaacagcccccauguggucaagaccgcgacccugggggaggugaacgagaccggcgugaucccgcugacgaccacccccaccaaguccuacuucgccaaccucaaggggacgcggacccgcggcaagcugugccccgacugccugaauugcaccgaccucgacgucgcccuggggcggcccaugugcgugggcaccacgccguccgccaaggccagcauccugcacgaggugcgccccgucaccuccggcuguuuccccaucaugcacgaccggaccaagauccgccagcuccccaaccugcugcggggguacgagaacauccgccucagcacccagaaugugaucgacgcggagaaggccccgggcgggcccuaccggcugggcacguccgggagcugccccaacgccaccuccaagaucggcuucuucgccaccauggcgugggccgugcccaaggauaacuacaagaacgccaccaacccgcugacggucgaggugcccuacaucugcaccgagggcgaggaucagaucaccguguggggguuccacagcgacaucaagacccagaugaagaaccucuacggcgacuccaauccccagaaguucacgagcuccgccaacgggguccccacccacuacgugagccagaucggcgacuuuccggaccccaccgaggacggcgggcugccccaguccggccgcaucgggguggacuacaugaugcagaagcccggcaagaccgggacgaucgucuaccagcggggcgugcugcucccgcagaagguguggugcgccaguggccgcuccaaggucaucaaggggagccugccccugaucggcgaggcggacugccuccacgagaaguacgggggccugaacaagucgaagcccuauuacaccggggagcacgccaaggccaucggcaacugccccaucugggugaagaccccgcugaagcucgccaacggcaccaaguaccggccgcccgccaagcugcugaaggagcgcggguuuuucggcgcgaucuccggguuccucgagggcgggugggagggcaugaucgccggcuggcacggguacacgagccacggcgcccacgggguggccgucgccgcggaucugaaguccacccaggaggccaucaacaagaucaccaagaaccugaacagccucuccgagcuggaggugaagaaccugcagcggcucagcggcgccauggacgagcugcauaacgagauccuggagcucgacgagaaggucgacgaccugcgcgccgacaccaucuccagccagaucgagcuggccgugcuccuguccaaugagggcaucaucaacagcgaggacgagcaccuccuggcgcuggagcggaagcugaagaagaugcucgggcccuccgccguggagaucggcaacgggugcuucgagacgaagcauaagugcaaccagaccugcagcgaccgcaucgccgccggcaccuucgacgcgggggaguuuucccugcccaccuucgacagccugaacaucaccgccgccucccucaacgacgauggccuggacaaccacacgauccugcuguacuacagcaccgccgccuccagccucgcggucacccugaugaucgccaucuuugugguguacauggucucccgggacaacgugagcugcagcaucugccuguga

SEQ ID NO: 14344 - RNA, 1758 nt, Artificial Sequence
  derived and/or modified CDS sequence (AUadapt) from InfluenzaB__AEG21026__HA
augaaggccaugauggugcugcucauggucgugaccaguaacgccgaccgcaucugcaccggcaucacguccucgaacucgccccacguggucaagaccgcgacccagggggaggugaacgugaccggcgucaucccgcugacgaucacccccaccaagagccacuucgccaaccugaaggugaaggagacccgggggaagcucugccccaagugccccaacugcacggaccuggacguggcccugggccgcccgaagugcaccgggaagauccccuccgcccgggucucgauccuccacgaggacacccccgugaccuccggcugcauccccaucaugcacgaccgcacgaagauccggcagcugccgaaccugcuccgcggcuacgagcacauccggcugucgacccacaacgugaucaacgccgaguccgcgcccgggggccccuacaagaucgggaccucgggcuccugccccaacgucaccaaugggaucggcuucuucgccacgauggccugggccgugccgaagaacgacaagaacaagaccgcgaccaacccccugaccaucgaggugcccuacaucugcacggagggcgaggaccagaucaccgucuggggguuccacuucgacaacgagacccagauggccaagcucuacggcgacagcaagccccagguguucaccuccucggccaacggggugaacgccgacuucgucucccagauccgcggcuucccgaaccagacggaggacggcgggcugccccagucgggccggaucgugguggacuacaugguccagaaguccgggaagaccggcaccaucaccuaccagcgcgggauccugcucccccagaagguguggugcgccucgggccgguccaaggugaucaaggagagccugccccugaucggcgaggcguacuuccagcaggaggaguacgggggccucaacaagaguaaguccuacuacacggaggagcacgccaaggccaucgggaucugcccgaucugggucaagacgccccugaagcuggccaacaagaccaaguaccgcccgcccgcccaccucucguacuucugcggcuucuucggggcgaucgccggcuuccuggagggcgggugggagggcaugaucgccggguggaacggcuacaccucccacggggcccacggcguggccgucguggcggaccugaaguccacccaggaggccaucaacaagaucaccaagaaccucaacucccugucggagcuggagguggagacccuccagcggcuguccggcgccauggacgagcugcacaacgagauccucgagcuggacgagaaggucgacgaccaccgcgccgacaccaucagcucccagaucgagcugcccgaccagcucucgaacgacggguccaucaauucggaggacgagcaccuccuggcccuggagcggaagcugaagaagaugcugggccccuccaacggggacaagggcucgggcgggaucgagacgaagcacaagugcaaccagaccugccucgaccgcaucgcggccggcaccuucgacgccgggggcuucucccaccccaccuucgacagcaagaacgugaccgccgcgucccugaacgacgacgggcuggacucgggcacgauccuccuguacuacuccaccgacgugucgaaccuggccgucaccgugaugaugggcaucuucgugaaguacauggucucgcgggacaacguguccugcagcaucugccucuga

SEQ ID NO: 14345 - RNA, 1758 nt, Artificial Sequence
  derived and/or modified CDS sequence (AUadapt) from InfluenzaB__AEG21027__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaucacccccaccaagucgcacuucgccaaccugaaggggaccgagacgcggggcaagcucugccccaagugccccaacugcaccgaccuggacguggcccuggggcgcccgaagugcaccggcaagauccccuccgcccgggugucgauccuccacgagguccgccccgugaccuccggcugcuuccccaucaugcacgaccggacgaagauccgccagcugccgaaccugcuccggggguacgagcacauccgccugaguacccacaacgugaucaacgccgagaacgcgcccggcgggcccuacaagaucggcaccuccgggucgugccccaacgucaccaacggcaucggcuucuucgccacgauggccugggccgugccgaagaacgacaagaacaagaccgcgaccaacccccugaccaucgaggugcccuacaucugcacggagggggaggaccagaucaccgucuggggcuuccacuucgacaacgagacccagauggccaagcucuacggggacuccaagccccagaaguucaccagcuccgccaacggcgugaacgccgauuucgugucgcagaucggcggguucccgaaccagacggaggacggcgggcugccccaguccggccggaucgucguggacuacauggugcagaaguccgggaagaccggcaccaucaccuaccagcgcggcauccugcucccccagaaggucuggugcgccuccgggcggucgaaggugaucaaggagucccugccccugaucggcgaggcguacuuccagcaggaggaguacgggggccucaacaagagcaagucguacuacacgggggagcacgccaaggccaucggcaacugcccgaucugggugaagacgccccugaagcuggccaacggcaccaaguaccgcccgcccgcccaccucuccuacuucugcggguucuuuggcgcgaucgccggguuccuggagggcgggugggagggcaugaucgccggcuggaacggguacaccagccacggcgcccacggggucgccguggucgcggaccugaaguccacccaggaggccaucaacaagaucaccaagaaccucaacucgcuguccgagcuggagguggagacccuccagcggcugucgggcgccauggacgagcugcacaacgagauccucgagaucgacgagaagguggacgaccaccgcgccgacaccaucuccagccagaucgagcuggccguccugcucuccaacgagggcaucaucaacucggaggacgagcaccuccuggcgcuggagcggaagcugaagaagaugcuggggcccuccaacggcgacaaggggagcggcgggaucgagacgaagcauaagugcaaccagaccugccucgaccgcaucgccgccggcaccuucgacgccggcgaguucucccugcccaccuucgacucgcugaacaucaccgcggccucccucaacgacgacgggcuggacucgggcacgauccugcucuacuacuccaccgacgugagcaaccuggccgugaccgucaugauggggaucuucgugaaguacauggugucccgggacaacgucucgugcagcaucugccuguga

SEQ ID NO: 14346 - RNA, 1758 nt, Artificial Sequence
  derived and/or modified CDS sequence (AUadapt) from InfluenzaB__AEG21028__HA
augaaggccaucaucgugcugcucauggucgugaccaguaacgccgaccgcaucugcaccggcaucacggcgucccagagccccaacaucgacaaguccucgacccagggggaggugaacgucuccugcgugaucccgcugaccaccacgcccaccaagagccacuucgccaaccugaaggugaaggagacccggggcaagcucugccccaagugccccaacugcaccgaccuggacgucucccuggggcgcccgaagugcacgggcaagauccccagugcccggguguccauccuccacgaggugcgccccgucgccagcgggggcuuccccaucaugcacgaccggaccaagauccgccagcugccgaaccugcuccggggcuacgagcacauccgccuguccacccacaacgugaucaacgccgagaacgcgcccgggggccccuacaagaucgggaccucgggcuccugccccaacgugacgaacgggaucggcuucuucgccaccauggccugggccgucccgaagaacgauaagaacaagaccgcgaccaacccccugacgaucgaggugcccuacaucugcaccgagggcgaggaccagaucaccguguggggguuccacagcgacaacgagacccagauggccaagcucuacggcgacuccaagccccagaaguucacgagcuccgccaacggggucaccacccacuacgccgccaagcggccgugcuuccccaaccagaccgaggauggcggccugccccagucggggcgcaucgugguggacuacaugguccagaaguccggcaagacggggaccaucaccuaccagcggggcauccugcucccccagaagguguggugcgcgagcgggcgcucgaaggugaucaagggcucccugccgcugaucggcgaggccgacugccuccacgagaaguacgggggccugaacaagagcaaguccuacuacaccggggagcacgccaaggccaucggcaacugccccaucugggucaagacgccccugaagcucgccucgcggaccauguccaagacccccgcgcaccugagcuauuucugcggguucuucggcgccaucgccggcuuccuggagggcgggugggaggggaugaucgccggcuggaacggguacaccucccacggcgcccacggcguggcgguggucgccgaccucaagucgacgcaggaggccaucaacaagaucaccaagaaccugaacucccugagcgagcucgaggugaagaaccugcagcgccuguccggggccauggacgagcuccacaacgagauccuggagcuggacgagaaggucgaugaccuccgggccgacaccaucagcucccagaucgagcuggcggugcugcucucgaacgagggcaucaucaacuccgaggacgagcaccuccuggcccuggagcgcaagcugaagaagaugcuggggccgagcgccguggagaucggcaacggcugcuucgagaccaagcacaagugcaaccagacgugccucgaccggaucgccgcggggaccuucgacgccggcgaguucucccugcccaccuuugacucgcugaacaucaccgccgccucccucaacgacgacgggcuggacaaccacaccauccugcucuacuacagcacggccgcgucgucccuggccgucacccugaugaucgccaucuucgugguguacauggucagccgcgacaacguguccugcagcaucugccuguga

SEQ ID NO: 14347 - RNA, 1758 nt, Artificial Sequence
  derived and/or modified CDS sequence (AUadapt) from InfluenzaB__AEG21029__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccauuucgccaaccugaaggggacggagacccggggcaagcucugccccaagugccccaacugcaccgaccuggacguggcccuggggcgcccgaagugcaccggcaagauccccuccgcccgggugaguauccuccacgagguccgccccgugacguccggcugcuuccccaucaugcacgaccggaccaagauccgccagcugccgaaccugcuccggggguacgagcacauccgccugagcacccauaacgugaucaacgccgagaacgcgcccggcgggcccuacaagaucggcaccuccgggagcugccccaacgucacgaacggcaucggcuucuuugccaccauggccugggccgugccgaagaacgacaagaacaagaccgcgaccaacccccugacgaucgaggugcccuacaucugcaccgagggggaggaccagaucaccgucuggggcuuccacuccgauucggagacccagauggccaagcucuacggggacuccaagccccagaaguucacgagcuccgccaacggcgugaccacccacuacgugucgcagaucggcggguuuccgaaccagaccgaggacggcgggcugccccaguccggccggaucgucguggacuacauggugcagaaguccgggaagacgggcaccaucaccuaccagcgcggcauccugcucccccagaaggucuggugcgccuccgggcggagcaaggugaucaagggcagccugccccugaucggggaggccgacugccuccaugagaaguacggcgggcugaacaaguccaagccguacuacaccggcgagcacgcgaaggccaucggcaacugccccaucugggugaagacgccccugaagcucgccaacgggaccaaguaccggcccccggccaagcugcugaaggagcgcggcuuuuucggggccaucgcgggcuuccucgagggcgggugggagggcaugaucgccggguggcacggcuacaccucgcacggggcccacggcgucgccguggccgcggaccugaaguccacccaggaggccaucaacaagaucacgaagaaucugaacagccucuccgagcuggaggucaagaaccugcagcgccucucgggcgccauggacgagcugcacaacgagauccuggagcucgacgagaagguggacgaucugcgggccgacaccaucuccagccagaucgagcuggccgugcuccuguccaacgaggggaucaucaacagcgaggacgagcaccuccuggcgcuggagcgcaagcugaagaagaugcucggccccuccgccgucgagaucgggaacggcugcuuugagaccaagcacaagugcaaccagaccugccuggaccggaucgccgccgggaccuucgacgcgggcgaguucucgcugcccacguuugacucccucaacaucaccgccgccagccugaacgacgacggccuggacaaccacaccauccuccuguauuacuccaccgccgccucgucccuggcggugacgcugaugaucgccaucuucguggucuacauggugagccgcgacaacguguccugcagcaucugccucuga

SEQ ID NO: 14348 - RNA, 1758 nt, Artificial Sequence
  derived and/or modified CDS sequence (AUadapt) from InfluenzaB__AEO80052__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuuugccaaccugaaggggacggagacccggggcaagcucugccccaagugccccaacugcaccgaccuggacguggcccuggggcgcccgaagugcaccggcaagauccccuccgcccgggugagcauccuccacgagguccgccccgugacguccggcuguuuccccaucaugcacgaccggaccaagauccgccagcugccgaaccugcuccggggguacgagcacauccgccugucgacccacaacgugaucaacgccgagaaugcgcccggcgggcccuacaagaucggcaccuccgggagcugccccaacgucacgaacggcaacggcuucuucgccaccauggccugggccgugccgaagaacgacaagaauaagaccgcgaccaacccccugacgaucgaggugcccuacaucugcaccgagggggaggaccagaucaccgucuggggcuuccacuccgacaacgagacccagauggccaagcucuacggggacaguaagccccagaaguucacguccagcgccaacggcgugaccacccacuacgugucccagaucggcggguucccgaaccagaccgaggacggcgggcugccccagucgggccggaucgucguggacuauauggugcagaaguccgggaagacgggcaccaucaccuaccagcgcggcauccugcucccccagaaggucuggugcgccagcgggcgguccaaggugaucaagggcucgcugccccugaucggggaggccgacugccuccacgagaaguacggcgggcugaacaagagcaagccguauuacaccggcgagcacgcgaaggccaucggcaacugccccaucugggugaagacgccccugaagcucgccaacgggaccaaguaccggcccccggccaagcugcugaaggagcgcggcuucuucggggccaucgcgggcuuccucgagggcgggugggagggcaugaucgccggguggcacggcuauaccucccacggggcccacggcgucgccguggccgcggaccugaaguccacccaggaggccaucaacaagaucacgaagaaccugaacucccucucggagcuggaggucaagaaccugcagcgccucuccggcgccauggacgagcugcacaaugagauccuggagcucgacgagaagguggacgaccugcgggccgacaccaucagcucccagaucgagcuggccgugcuccugucgaacgaggggaucaucaacuccgaggacgagcaccuccuggcgcuggagcgcaagcugaagaagaugcucggccccagugccgucgagaucgggaacggcugcuucgagaccaagcacaagugcaaccagaccugccuggaccggaucgccgccgggaccuucgacgcgggcgaguuuucccugcccacguucgacucgcucaacaucaccgccgccucccugaacgacgacggccuggacaaccacaccauccuccuguauuacagcaccgccgccuccucgcuggcggugacgcugaugaucgccaucuucguggucuacauggugucccgcgacaacgugagcugcuccaucugccucuga

SEQ ID NO: 14349 - RNA, 1758 nt, Artificial Sequence; identical to SEQ ID NO: 14254
  derived and/or modified CDS sequence (AUadapt) from InfluenzaB__AEO80067__HA

SEQ ID NO: 14350 - RNA, 1755 nt, Artificial Sequence
  derived and/or modified CDS sequence (AUadapt) from InfluenzaB__AEO80078__HA
augaaggagaucaucgugcugcucauggucgugaccaguaacgccgaccgcaucugcaccggcaucacguccagcaacagcccccacguggucaagaccgccacccagggggaggugaaugugaccggcgucaucccgcugacgaccacccccaccaaguccuacuucgcgaaccugaaggggacgcggacccgcggcaagcucugccccgacugccugaacugcaccgaucuggacguggcccucgggcggcccaugugcgugggcaccacgccguccgccaaggccagcauccugcacgagguccgccccgugaccuccggcugcuuccccaucaugcacgaucggaccaagauccgccagcuggccaaccuccugcggggguacgagaacauccgccugucgacccagaacgugaucgacgcggagaaggcccccggcgggccguaccggcucggcacguccgggagcugucccaacgccaccuccaagagcggcuucuucgccaccauggcgugggccguccccaaggacaacaacaagaaugccaccaacccccugacgguggaggugccguacaucugcaccgagggcgaggaccagaucaccgucuggggguuccacuccgacaacaagacccagaugaagaaucuguacggcgacagcaacccccagaaguucacguccucggccaacggggugaccacccauuacgugucccagaucggcggcuuccccgaccagaccgaggacgggggccucccccagagcgggcgcaucgucguggacuacaugaugcagaagccgggcaagacggggaccaucguguaccagcggggcguccugcugccccagaagguguggugugccuccggccgcagcaaggugaucaaggggagccucccccugaucggcgaggcggacugccugcacgagaaguacgggggccucaacaaguccaagcccuauuacaccggggagcacgccaaggccaucggcaacugcccgaucugggucaagacgccccugaagcuggccaacggcaccaaguaccggccgcccgccaagcuccugaaggagcgcggguucuucggcgcgaucgccggguuucuggagggcgggugggagggcaugaucgccggcuggcacggguacaccagccacggcgcccacgggguggccgucgcggccgaccucaaguccacccaggaggccaucaacaagaucaccaagaaucugaacucgcuguccgagcucgaggugaagaaccugcagcggcugagcggcgccauggacgagcuccacaacgagauccuggagcuggacgagaagguggaugaccuccgcgccgacacgaucuccagccagaucgagcuggcgguccugcucuccaacgagggcaucaucaacagcgaggacgagcaucuccuggcccuggagcggaagcugaagaagaugcuggggcccuccgccguggacaucggcaacgggugcuucgagaccaagcacaagugcaaccagaccugccucgaucgcaucgccgcgggcaccuucaacgccggggaguucucgcugcccaccuucgacucccugaacaucacggccgccagucucaacgacgacggccuggacaaccacaccauccugcuguacuacuccaccgccgcgaguucccucgccgugacccugaugcuggccaucuucaucgucuacauggugagccgggacaacguguccugcagcaucugccucuga

SEQ ID NO: 14351 - RNA, 1758 nt, Artificial Sequence
  derived and/or modified CDS sequence (AUadapt) from InfluenzaB__AEO80086__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaauaucccguccgccaaggugucgauccugcacgagguccggcccgugacguccggcugcuuccccaucaugcacgaccgcaccaagauccggcagcugcccaaccuccugcgcggguacgagcacauccggcugucgacccacaacgugaucaacgccgagaaggcgccgggcgggcccuacaagaucggcaccuccgggucgugccccaacgucacgaacggcaacggcuucuuugccaccauggccugggccgugcccaagaacgacaacaacaagaccgcgaccaacucccucacgaucgaggugccguacaucugcaccgagggggaggaccagaucaccaucuggggcuuccacagcgacaacgagacccagauggccaagcuguacggggacuccaagccccagaaguucacgucguccgccaacggcgucaccacccacuacgugagucagaucggcggguuccccaaccagaccgaggacggcgggcugccccaguccggccgcaucguggucgacuacauggugcagaaguccgggaagacgggcaccaucaccuaccagcggggcauccuccugccgcagaagguguggugcgccuccgggcgcagcaaggucaucaagggcucgcugccccucaucggggaggccgacugccugcacgagaaguacggcgggcugaacaaguccaagcccuacuacaccggcgagcacgcgaaggccaucggcaacugccccaucugggugaagacgccgcucaagcuggccaaugggaccaaguaccggccgcccgccaagcugcucaaggagcgcggcuucuucggggccaucgcgggcuuccuggagggcgggugggagggcaugaucgccggguggcacggcuacaccucgcacggggcccacggcguggccgucgccgcggaccugaaguccacccaggaggccaucaacaagaucacgaagaaccucaacucgcuguccgagcuggaggugaagaaccuccagcggcugagcggcgccauggacgagcugcacaacgagauccucgagcuggacgagaaggucgaugaccugcgcgccgacaccaucuccucgcagaucgagcucgccgugcugcuguccaacgaggggaucaucaacucggaggacgagcaccuccuggcgcuggagcggaagcucaagaagaugcugggccccuccgccguggagaucgggaacggcugcuucgagaccaagcacaagugcaaccagaccugccuggaccgcaucgccgccgggaccuucgacgcgggcgaguucucgcuccccacguuugacucccugaacaucaccgccgccagccugaacgacgacggccucgacaaccacaccauccugcuguacuacuccaccgccgccucgucccuggcggucacgcucaugaucgccaucuucgugguguacauggucucgcgggacaacguguccugcagcaucugccuguga

SEQ ID NO: 14352 - RNA, 1755 nt, Artificial Sequence
  derived and/or modified CDS sequence (AUadapt) from InfluenzaB__AEO80097__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaagucccacuucgccaaccugaaggggacgcggacccgcggcaagcucugccccgacugccugaauugcaccgaccuggacguggcccucgggcggcccaugugcgugggcaccacgccguccgccaaggccagcauccugcacgagguccgccccgugaccuccggcuguuuccccaucaugcacgaccggaccaagauccgccagcuggcgaaccuccugcggggguacgagaacauccgccugagcacccagaaugugaucgacgccgagaaggcccccggcgggccguaccggcucggcacguccgggucgugccccaacgccaccuccaagagcggcuucuuugcgaccauggccugggccguccccaaggacaacaacaagaacgccaccaacccccugacgguggaggugccguacaucuguaccgagggcgaggaccagaucaccgucuggggguuccacuccgacaacaagacccagaugaagaaccuguacggcgauagcaacccccagaaguucacguccagcgccaacggggugaccacccacuacgugucccagaucggcggcuuucccgaccagaccgaggacgggggccucccccagagcgggcgcaucgucguggacuacaugaugcagaagccgggcaagacggggaccaucguguaccagcggggcguccugcugccccagaagguguggugugcguccggccgcagcaaggugaucaaggggucgcucccccugaucggcgaggccgacugccugcacgagaaguacgggggccucaacaaguccaagcccuauuacaccggggagcacgccaaggccaucggcaacugcccgaucugggucaagacgccccugaagcuggccaacggcaccaaguaccggccgcccgcgaagcuccugaaggagcgcggguuuuucggcgccaucgccggguuccuggagggcgggugggagggcaugaucgccggcuggcacggguacaccagccacggcgcccacgggguggcggucgccgccgaucucaaguccacccaggaggccaucaacaagaucaccaagaaccugaacagccuguccgagcucgaggugaagaaccugcagcggcugagcggcgccauggacgagcuccauaacgagauccuggagcuggacgagaagguggacgaccuccgcgcggacacgaucuccagccagaucgagcuggccguccugcucuccaaugagggcaucaucaacucggaggacgagcaccuccuggcccuggagcggaagcugaagaagaugcuggggcccuccgccguggacaucggcaacgggugcuuugagaccaagcacaagugcaaccagaccugccucgaccgcaucgcggccggcaccuucaacgccggggaguuuagccugcccaccuucgacucccugaacaucacggccgccagccucaacgaugacggccuggacaaccacaccauccugcuguacuacuccaccgcggccagcucccucgccgugacccugaugcuggccaucuuuaucgucuacauggugagccgggacaacguguccugcagcaucugccucuga

SEQ ID NO: 14353 - RNA, 1755 nt, Artificial Sequence; identical to SEQ ID NO: 14166
  derived and/or modified CDS sequence (AUadapt) from InfluenzaB__AEO80108__HA

SEQ ID NO: 14354 - RNA, 1758 nt, Artificial Sequence; identical to SEQ ID NO: 14254
  derived and/or modified CDS sequence (AUadapt) from InfluenzaB__AEO80145__HA

SEQ ID NO: 14355 - RNA, 1758 nt, Artificial Sequence; identical to SEQ ID NO: 14313
  derived and/or modified CDS sequence (AUadapt) from InfluenzaB__AEO80154__HA

SEQ ID NO: 14356 - RNA, 1758 nt, Artificial Sequence
  derived and/or modified CDS sequence (AUadapt) from InfluenzaB__AEO80183__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccacuucgccaaccugaaggggacggagacccggggcaagcucugucccaagugccugaacugcaccgaccuggacguggcccucgggcgccccaagugcaccggcaacaucccguccgcccgggugucgauccugcacgagguccgccccgugacguccggcugcuuccccaucaugcacgaucggaccaagauccgccagcugcccaaccuccugcggggguacgagcacauccgccugagcacccacaacgugaucaacgccgagaacgcgccgggcgggcccuacaagaucggcaccuccgggucgugccccaacgucacgaauggcaacggcuucuucgccaccauggccugggccgugcccaagaacgacaacaacaagaccgcgaccaacucccucacgaucgaggugccguacaucugcaccgagggggaggaccagaucaccgucuggggcuuccauagcgacaucgagacccagauggccaagcuguacggggacuccaagccccagaaguucacgucguccgccaacggcgugaccacccacuacgugagccagaucggcggguuccccaaccagaccgaggauggcgggcugccccaguccggccggaucgucguggacuacauggugcagaaguccgggaagacgggcaccaucaccuaccagcgcggcauccuccugccgcagaaggucuggugcgccuccgggcggucgaaggugaucaagggcagccugccccucaucggggaggccgacugccugcacgagaaguacggcgggcugaacaaguccaagcccuacuacaccggcgagcaugcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccucgcacggggcccacggcgucgccguggccgcggaucugaaguccacccaggaggccaucaacaagaucacgaagaaccucaacagccuguccgagcuggaggucaagaaccuccagcgccugucgggcgccauggacgagcugcacaacgagauccucgagcuggacgagaagguggacgaccugcgggccgauaccaucuccagccagaucgagcucgccgugcugcuguccaacgaggggaucaucaacucggaggacgagcaccuccuggcgcuggagcgcaagcucaagaagaugcugggccccuccgccgucgagaucgggaacggcugcuucgagaccaagcacaagugcaaccagaccugucuggaccggaucgccgccgggaccuucgacgcgggcgaguucagccuccccacguucgacucccugaacaucaccgccgccucgcugaacgacgacggccucgauaaccacaccauccugcuguacuacuccaccgccgccagcucccuggcggugacgcucaugaucgccaucuucguggucuacauggugucgcgcgacaacguguccugcagcaucugccuguga

SEQ ID NO: 14357 - RNA, 1758 nt, Artificial Sequence
  derived and/or modified CDS sequence (AUadapt) from InfluenzaB__AEO80194__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaucugaaggggacggagacccggggcaagcucugccccaagugccugaacugcaccgaccuggacguggcccucgggcgccccaagugcaccggcaacaucccguccgcccgggugagcauccugcacgagguccgccccgugacguccggcugcuuucccaucaugcacgaccggaccaagauccgccagcugcccaaccuccugcggggguacgagcacauccgccugucgacccacaacgugaucaacgccgagaacgcgccgggcgggcccuacaagaucggcaccuccgggaguugccccaacgucacgaacggcaacggcuucuucgccaccauggccugggccgugcccaagaacgacaacaacaagaccgcgaccaacucccucacgaucgaggugccguauaucugcaccgagggggaggaccagaucaccgucuggggcuuccacucggacaacgaggcccagauggccaagcuguacggggacuccaagccccagaaguucaccagcuccgccaauggcgugacgacccacuacgugucgcagaucggcggguuccccaaccagaccgaggacggcgggcugccccaguccggccggaucgucguggacuacauggugcagaaguccgggaagaccggcacgaucaccuaccagcgcggcauccuccugccgcagaaggucuggugcgcccgggggcgcuccaaggugaucaagggcagccugccccucaucggggaggcggauugccugcacgagaaguacggcgggcugaacaagucgaagcccuacuacaccggcgagcacgccaaggccaucggcaacugccccaucugggugaagaccccgcucaagcuggccaacgggacgaaguaucggccgcccgccaagcugcucaaggagcgcggcuucuucggggcgaucgccggcuuccuggagggcgggugggagggcaugaucgccggguggcacggcuacaccucccacggggcccacggcgucgccguggcggccgaccucaagagcacccaggaggccaucaacaagaucaccaagaaccugaauucccugucggagcuggaggucaagaaccuccagcggcuguccggcgccauggacgagcugcacaacgagauccucgagcuggacgagaagguggacgaccugcgcgccgacacgaucagcucccagaucgagcucgcggugcugcugucgaaugaggggaucaucaacuccgaggacgagcaccuccuggcccuggagcggaagcucaagaagaugcugggccccagcgccgucgagaucgggaacggcugcuucgagaccaagcacaagugcaaccagaccugccuggaucgcaucgccgcggggaccuucgacgccggcgaguucucccuccccaccuucgacucgcugaacaucacggccgccucccugaacgacgacggccucgacaaucacaccauccugcuguacuacagcaccgccgcguccucgcuggccgugacccucaugaucgccaucuucguggucuacaugaucucccgggacaacgugagcugcuccaucugccuguga

SEQ ID NO: 14358 - RNA, 1758 nt, Artificial Sequence; identical to SEQ ID NO: 14305
  derived and/or modified CDS sequence (AUadapt) from InfluenzaB__AEO80205__HA

SEQ ID NO: 14359 - RNA, 1758 nt, Artificial Sequence; identical to SEQ ID NO: 14305
  derived and/or modified CDS sequence (AUadapt) from InfluenzaB__AEO80216__HA

SEQ ID NO: 14360 - RNA, 1755 nt, Artificial Sequence
  derived and/or modified CDS sequence (AUadapt) from InfluenzaB__AEO80227__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacugcaccgaucuggacguggcccucgggcggcccaugugcgugggcaccacgccguccgccaaggccagcauccugcacgagguccgccccgugaccuccggcugcuuccccaucaugcacgaucggaccaagauccgccagcuggcgaaccuccugcggggguacgagaacauccgccugagcacccagaacgugaucgacgccgagaaggcccccggcgggccguaccggcucggcacguccgggucgugucccaacgccaccuccaagagcggcuucuucgcgaccauggccugggccguccccaaggacaacaacaagaaugccaccaacccccugacgguggaggugccguacaucugcaccgagggcgaggaccagaucaccgucuggggguuccacuccgacaacaagauccagaugaagaaucuguacggcgacagcaacccccagaaguucaccuccagcgccaacggggugacgacccauuacgugucccagaucggcggcuuccccgaccagaccgaggacgggggccucccccagagcgggcgcaucgucguggacuacaugaugcagaagccgggcaagaccgggacgaucguguaccagcggggcguccugcugccccagaagguguggugugcguccggccgcagcaaggugaucaaggggucgcucccccugaucggcgaggccgacugccugcacgagaaguacgggggccucaacaaguccaagcccuauuacaccggggagcacgccaaggccaucggcaacugcccgaucugggucaagacgccccugaagcuggccaacggcaccaaguaccggccgcccgcgaagcuccugaaggagcgcggguucuucggcgccaucgccggguuucuggagggcgggugggagggcaugaucgccggcuggcacggguacaccagccacggcgcccacgggguggcggucgccgccgaccucaaguccacccaggaggccaucaacaagaucaccaagaaucugaacagccuguccgagcucgaggugaagaaccugcagcggcugagcggcgccauggacgagcuccacaacgagauccuggagcuggacgagaagguggaugaccuccgcgcggacaccaucuccagccagaucgagcuggccguccugcucuccaacgagggcaucaucaacucggaggacgagcaucuccuggcccuggagcggaagcugaagaagaugcuggggcccuccgccguggacaucggcaacgggugcuucgagacgaagcacaagugcaaccagaccugccucgaucgcaucgcggccggcaccuucaacgccggggaguucagccugcccaccuucgacucccugaacaucaccgccgccagucucaacgacgacggccuggacaaccacacgauccugcuguacuacuccaccgcggccaguucccucgccgugacccugaugcuggccaucuucaucgucuacauggugagccgggacaacguguccugcagcaucugccucuga

SEQ ID NO: 14361 - RNA, 1758 nt, Artificial Sequence; identical to SEQ ID NO: 14322
  derived and/or modified CDS sequence (AUadapt) from InfluenzaB__AEO80238__HA

SEQ ID NO: 14362 - RNA, 1758 nt, Artificial Sequence
  derived and/or modified CDS sequence (AUadapt) from InfluenzaB__AEP20178__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucuccaaccugaaggggacggagacccggggcaagcucugccccaagugucugaacugcaccgaccuggacguggcccucgggcgccccaagugcaccggcaacaucccgagcgcccggguguccauccugcacgagguccgccccgugacgucgggcugcuuccccaucaugcacgaccggaccaagauccgccagcugcccaaccuccugcggggguaugagcacauccgccuguccacccacaacgugaucaacgccgagaacgccccgggcgggcccuacaagaucggcaccagcggguccugccccaacgucacgaacggcaacggcuucuucgcgaccauggccugggccgugcccaagaacgauaacaacaagaccgccaccaacucgcucacgaucgaggugccguacaucugcaccgagggggaggaccagaucaccgucuggggcuuccacuccgacaacgagacccagauggcgaagcuguacggggacaguaagccccagaaguucacguccagcgccaacggcgugaccacccacuacgugucccagaucggcggguuccccaaccagaccgaggacggcgggcugccccagucgggccggaucgucguggacuacauggugcagaaguccgggaagacgggcaccaucaccuaccagcgcggcauccuccugccgcagaaggucuggugcgccagcgggcggaguaaggugaucaagggcucccugccccucaucggggaggccgacugccugcacgagaaguacggcgggcugaacaagagcaagcccuacuacaccggcgagcacgccaaggcgaucggcaacugccccaucugggugaagacgccgcucaagcuggccaacgggaccaaguaccgcccgcccgccaagcugcucaaggagcggggcuucuuuggggccaucgccggcuuccuggagggcgggugggagggcaugaucgcgggguggcacggcuacaccucccacggggcccacggcgucgccguggccgccgaccugaaguccacccaggaggcgaucaacaagaucacgaagaaccucaacucccugucggagcuggaggucaagaaccuccagcgccuguccggcgccauggacgagcugcacaaugagauccucgagcuggacgagaagguggacgaccugcgggccgacaccaucucgucccagaucgagcucgccgugcugcugagcaacgaggggaucaucaacuccgaggacgagcaccuccuggcccuggagcgcaagcucaagaagaugcugggccccucggcggucgagaucgggaacggcugcuucgagaccaagcauaagugcaaccagaccugccuggaccggaucgccgccgggaccuucgacgccggcgaguucucccuccccacguucgacagccugaacaucaccgcggccucccugaacgacgacggccucgauaaccacaccauccugcuguacuacucgaccgccgccuccagccuggccgugacgcucaugaucgcgaucuucguggucuacauggugucccgcgacaacgugucgugcagcaucugccuguga

SEQ ID NO: 14363 - RNA, 1758 nt, Artificial Sequence
  derived and/or modified CDS sequence (AUadapt) from InfluenzaB__AEP20189__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccacuucgccaaucugaaggggacggagacccggggcaagcucugccccaagugccugaacugcaccgaccuggacguggcccucgggcgccccaagugcaccggcaacaucccguccgcccgggugucgauccugcacgagguccgccccgugacguccggcugcuuucccaucaugcacgaccggaccaagauccgccagcugcccaaccuccugcggggguacgagcacauccgccugagcacccacaacgugaucaacgccgagaacgcgccgggcgggcccuacaagaucggcaccuccgggaguugccccaacgucacgaacggcaacggcuucuucgccaccauggccugggccgugcccaagaacgacaacaacaagaccgcgaccaacucccucacgaucgaggugccguauaucugcaccgagggggaggaccagaucaccgucuggggcuuccacagcgacaacgagacccagauggccaagcuguacggggacuccaagccccagaaguucacgucguccgccaauggcgugaccacccacuacgugagccagaucggcggguuccccaaccagaccgaggacggcgggcugccccaguccggccggaucgucguggacuacauggugcagaaguccgggaagacgggcaccaucaccuaccagcgcggcauccuccugccgcagaaggucuggugcgccuccgggcggucgaaggugaucaagggcagccugccccucaucggggaggccgauugccugcacgagaaguacggcgggcugaacaaguccaagcccuacuacaccggcgagcacgcgaaggccaucggcaacugccccaucugggugaagacgccgcucaagcuggccaacgggaccaaguaccgcccgcccgccaagcugcucaaggagcggggcuuuuucggggccaucgcgggcuuccuggagggcgggugggagggcaugaucgccggguggcacggcuacaccucgcacggggcccacggcgucgccguggccgcggaccugaaguccacccaggaggccaucaacaagaucacgaagaaccucaacagucuguccgagcuggaggucaagaaccuccagcgccugucgggcgccauggacgagcugcacaacgagauccucgagcuggacgagaagguggacgaccugcgggccgacaccaucuccagccagaucgagcucgccgugcugcuguccaacgaggggaucaucaauucggaggacgagcaccuccuggcgcuggagcgcaagcucaagaagaugcugggccccuccgccgucgagaucgggaacggcugcuucgagaccaagcacaagugcaaccagaccugccuggaccggaucgccgccgggaccuuugacgcgggcgaguucagccuccccacguucgacucccugaacaucaccgccgccucgcugaacgacgacggccucgacaaucacaccgugcugcuguacuacuccaccgccgccagcucccuggcggugacgcucaugaucgccaucuucgucguguacauggugucgcgcgacaacgucuccugcagcaucugccuguga

SEQ ID NO: 14364 - RNA, 1758 nt, Artificial Sequence; identical to SEQ ID NO: 14254
  derived and/or modified CDS sequence (AUadapt) from InfluenzaB__AEP20200__HA

SEQ ID NO: 14365 - RNA, 1755 nt, Artificial Sequence; identical to SEQ ID NO: 14145
  derived and/or modified CDS sequence (AUadapt) from InfluenzaB__AEP20211__HA

SEQ ID NO: 14366 - RNA, 1755 nt, Artificial Sequence
  derived and/or modified CDS sequence (AUadapt) from InfluenzaB__AEP20222__HA
augaaggccaucaucgugcugcucauggucgugaccaguaacgccgaccgcaucugcaccggcaucacguccagcaacucgccccacguggucaagaccgcgacccagggggaggugaacgugaccggcgccaucccgcugacgaccacccccaccaagagucacuucgccaaccugaaggggacgaagacccggggcaagcucugcccgaccugcuucaacugcaccgaucuggacgucgcccuggggcgccccaugugcgugggcaucacgcccuccgccaaggcgagcauccuccacgaggugcggcccgucaccuccggcugcuuccccaucaugcacgaccgcaccaagauccggcagcugcccaaccugcuccgcggguaugagaagauccggcugucgacccagaacgugaucgacgccgagaaggccccgggcgggcccuaccgccugggcacguccgggagcugccccaacgccaccuccaagucgggcuuuuucgcgaccauggccugggccgugccccgggacaacaacaagaccgccacgaacccgcucaccgucgaggugcccaacaucugcaccaaggaggaggaccagaucaccguguggggcuuccauuccgacaacaagacgcagaugaagaaccuguacggggaccccaacccccagaaguucaccagcuccgccaauggcaucaccacccacuacgucagccagaucgggggcuucccggaccagacggaggacggcgggcugccccaguccggccgcaucgugguggacuacaugguccagaagcccgggaagaccggcaccaucguguaccagcgggggauccuccugccccagaagguguggugugcgucgggccgcuccaaggucaucaagggcagccugccgcucaucggggaggccgacugccugcacgagaaguacggcgggcugaacaagagcaagcccuauuacaccggcgagcacgccaaggccaucgggaacugccccaucugggugaagacgccccucaagcuggccaacggcaccaaguaccggccgcccgcgaagcugcucaaggagcgcggcuucuucggggccaucgccggcuuccuggagggcgggugggaggggaugaucgccggcuggcauggcuacaccucccacggggcccacggcguggcggucgccgccgaccugaaguccacccaggaggccaucaacaagaucacgaagaaccucaacucccugucggagcuggaggugaagaaucuccagcggcuguccggggccauggacgagcugcacaacgagauccucgagcuggacgagaaggucgacgaccugcgcgcggacaccaucagcucccagaucgagcucgccgugcugcugucgaaugagggcaucaucaacuccgaggacgagcaccuccuggcccuggagcggaagcucaagaagaugcugggccccagcgccguggacaucgggaacggcugcuucgagaccaagcauaagugcaaccagaccugccuggaccgcaucgcggccgggaccuucaacgccggcgaguucucccuccccacguucgacagucugaacaucaccgccgccucccugaacgacgacgggcucgacaaccacaccauccugcuguacuauucgaccgcggccuccagccuggccgucacgcucaugaucgccaucuucaucguguacaugaucucccgggacaacgugagcugcuccaucugccuguga

SEQ ID NO: 14367 - RNA, 1755 nt, Artificial Sequence; identical to SEQ ID NO: 14251
  derived and/or modified CDS sequence (AUadapt) from InfluenzaB__AEP20233__HA

SEQ ID NO: 14368 - RNA, 1755 nt, Artificial Sequence
  derived and/or modified CDS sequence (AUadapt) from InfluenzaB__AEP20244__HA
augaaggccaucaucgugcugcucauggucgugaccaguaacgccgaccgcaucugcaccggcaucacguccagcaacucgccccacguggucaagaccgcgacccagggggaggugaacgugaccggcgccaucccgcugacgaccacccccaccaagucccauuucgccaaccugaaggggacgaagacccggggcaagcucugcccgaccugcuucaacugcaccgaccuggaugucgcccuggggcgccccaugugcaugggcaucacgcccuccgccaaggcgagcauccuccacgaggugcggcccgugaccuccggcugcuuccccaucaugcacgaccgcaccaagauccggcagcugcccaaccugcuccgcggguacgagaagauccggcugaguacccagaacgucaucgacgccgagaaggccccgggcgggcccuaccgccugggcacguccgggucgugccccaacgccaccuccaagagcggcuucuuugcgaccauggccugggccgugccccggggcaacaacaagaccgccacgaacccgcucaccguggaggucccccacaucugcaccaaggaggaggaccagaucaccguguggggguuccacuccgacaauaagacgcagaugaagaaccuguacggcgacagcaacccccagaaguucaccuccucggccaacgggaucaccacccauuacgugucccagaucggcggcuuccccgaccagacggaggacgggggccugccgcagagcgggcgcaucgucguggacuacauggugcagaagcccggcaagaccgggaccaucgucuaccagcggggcauccuccugccccagaagguguggugcgcguccggccgcaguaaggugaucaaggggucgcugccccucaucggcgaggccgacugccugcacgagaaguacgggggccugaacaaguccaagccguacuacaccggggagcaugccaaggccaucggcaacugccccaucugggucaagacgccccucaagcuggccaacggcaccaaguaccggcccccggcgaagcugcucaaggagcgcggguucuucggcgccaucgccggguuccuggagggcgggugggagggcaugaucgccggcuggcacggguacaccagucacggcgcccacgggguggcgguggccgccgaccugaaguccacccaggaggccaucaacaagaucacgaagaaccucaacucgcuguccgagcuggaggucaagaaccuccagcggcugaguggcgccauggacgagcugcacaacgagauccucgagcuggacgagaagguggacgaccugcgcgcggacaccaucuccagccagaucgagcucgccguccugcuguccaacgagggcaucaucaauucggaggacgagcaccuccuggcccuggagcggaagcucaagaagaugcuggggcccuccgccguggacaucggcaacgggugcuucgagaccaagcacaaguguaaccagaccugccuggaccgcaucgcggccggcaccuucaacgccggggaguucagccuccccacguucgacucccugaauaucaccgccgccagccugaacgacgacggccucgacaaccacaccauccugcuguacuauuccaccgcggccucgucccuggccgugacgcucaugaucgccaucuucaucgucuacaugaucagccgggacaacguguccugcagcaucugccuguga

SEQ ID NO: 14369 - RNA, 1758 nt, Artificial Sequence; identical to SEQ ID NO: 14159
  derived and/or modified CDS sequence (AUadapt) from InfluenzaB__AEP20255__HA

SEQ ID NO: 14370 - RNA, 1758 nt, Artificial Sequence
  derived and/or modified CDS sequence (AUadapt) from InfluenzaB__AEP20277__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaauaucccguccgccgaggugucgauccugcacgagguccggcccgugacguccggcugcuuccccaucaugcacgaccgcaccaagauccggcagcugcccaaccuccugcgcggguacgagcacauccggcugucgacccacaacgugaucaacgccgagaaggcgccgggcgggcccuacaagaucggcaccuccgggucgugccccaacgucacgaacggcaacggcuucuuugccaccauggccugggccgugcccaagaacgacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgucguccgccaacggcgugaccacccacuacgugagucagaucggcggguuccccaaccagaccgaggacggcgggcugccccaguccggccgcaucgucguggacuacauggugcagaaguccgggaagacgggcaccaucaccuaccagcggggcauccuccugccgcagaaggucuggugcgccuccgggcgcagcaaggugaucaagggcucgcugccccucaucggggaggccgacugccugcacgagaaguacggcgggcugaacaaguccaagcccuacuacaccggcgagcacgcgaaggccaucggcaacugccccaucugggugaagacgccgcucaagcuggccaaugggaccaaguaccggccgcccgccaagcugcucaaggagcgcggcuucuucggggccaucgcgggcuuccuggagggcgggugggagggcaugaucgccggguggcacggcuacaccucgcacggggcccacggcgucgccguggccgcggaccugaaguccacccaggaggccaucaacaagaucacgaagaaccucaacucgcuguccgagcuggaggucaagaaccuccagcggcugagcggcgccauggacgagcugcacaacgagauccucgagcuggacgagaagguggaugaccugcgcgccgacaccaucuccucgcagaucgagcucgccgugcugcuguccaacgaggggaucaucaacucggaggacgagcaccuccuggcgcuggagcggaagcucaagaagaugcugggccccuccgccgucgagaucgggaacggcugcuucgagaccaagcacaagugcaaccagaccugccuggacaagaucgccgccgggaccuucgacgcgggcgaguucucgcuccccacguuugacucccugaacaucaccgccgccagccugaacgacgacggccucgacaaccacaccauccugcuguacuacuccaccgccgccucgucccuggcggugacgcucaugaucgccaucuucguggucuacauggugucgcgcgacaacguguccugcagcaucugccuguga

SEQ ID NO: 14371 - RNA, 1755 nt, Artificial Sequence
  derived and/or modified CDS sequence (AUadapt) from InfluenzaB__AEP20299__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacugcaccgaucuggacguggcccucgggcggcccaugugcgugggcaccacgccguccgccaaggccagcauccugcacgagguccgccccgugaccuccggcugcuuccccaucaugcacgaucggaccaagauccgccagcuggcgaaccuccugcggggguacgagaacauccgccugucgacccagaacgugaucgacgccgagaaggcccccggcgggccguaccggcucggcacguccgggagcugucccaacgccaccuccaagagcggcuucuucgcgaccauggccugggccguccccaagaacaacaacaagaaugccaccaacccccugacgguggaggugccguacaucugcaccgagggcgaggaccagaucaccgucuggggguuccacuccgacaacaagacccagaugaagaaucuguacggcgacagcaacccccagaaguucacguccucggccaacggggugaccacccauuacgugucccagaucggcggcuuccccgaccagaccgaggacgggggccucccccagagcgggcgcaucgucguggacuacaugaugcagaagccgggcaagacggggaccaucguguaccagcggggcguccugcugccccagaagguguggugugcguccggccgcagcaaggugaucaaggggagccucccccugaucggcgaggccgacugccugcacgagaaguacgggggccucaacaaguccaagcccuauuacaccggggagcacgccaaggccaucggcaacugcccgaucugggucaagacgccccugaagcuggccaacggcaccaaguaccggccgcccgcgaagcuccugaaggagcgcggguucuucggcgccaucgccggguuucuggagggcgggugggagggcaugaucgccggcuggcacggguacaccagccacggcgcccacgggguggcggucgccgccgaccucaaguccacccaggaggccaucaacaagaucaccaagaaucugaacucgcuguccgagcucgaggugaagaaccugcagcggcugagcggcgccauggacgagcuccacaacgagauccuggagcuggacgagaagguggaugaccuccgcgcggacacgaucuccagccagaucgagcuggccguccugcucuccaacgagggcaucaucaacagcgaggacgagcaucuccuggcccuggagcggaagcugaagaagaugcuggggcccuccgccguggacaucggcaacgggugcuucgagaccaagcacaagugcaaccagaccugccucgaucgcaucgcggccggcaccuucaacgccggggaguucucgcugcccaccuucgacucccugaacaucacggccgccagucucaacgacgacggccuggacaaccacaccauccugcuguacuacuccaccgcggccaguucccucgccgugacccugaugcuggccaucuucaucgucuacauggugagccgggacaacguguccugcagcaucugccucuga

SEQ ID NO: 14372 - RNA, 1755 nt, Artificial Sequence
  derived and/or modified CDS sequence (AUadapt) from InfluenzaB__AEP20310__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaaguccuacuucgccaaccugaaggggacgcggacccgcggcaagcucugccccgacugccugaauugcaccgaccuggacguggcccucgggcggcccaugugcgugggcaccacgccguccgccaaggccagcauccugcacgagguccgccccgugaccuccggcuguuuccccaucaugcacgaccggaccaagauccgccagcugcccaaccuccugcggggguacgagaacauccgccugagcacccagaaugugaucgacgcggagaaggccccgggcgggcccuaccggcucggcacguccgggagcugccccaacgccaccuccaagagcggcuucuuugccaccauggcgugggccguccccaaggacaacaacaagaacgccaccaacccgcugacgguggaggugcccuacaucuguaccgagggcgaggaccagaucaccgucuggggguuccacuccgacaacaagacccagaugaagaaccuguacggcgauucgaacccccagaaguucacguccagcgccaacggggugaccgcccacuacgugucccagaucggcggcuuucccgaccagaccgaggacgggggccucccgcagagcgggcgcaucgucguggacuacaugaugcagaagcccggcaagaccgggacgaucguguaccagcggggcguccugcugccccagaagguguggugugcguccggccgcagcaaggugaucaaggggagccucccccugaucggcgaggccgacugccugcacgagaaguacgggggccucaacaaguccaagccguauuacaccggggagcacgccaaggccaucggcaacugccccaucugggucaagacgccccugaagcuggccaacggcaccaaguaccggcccccggcgaagcuccugaaggagcgcggguuuuucggcgccaucgccggguuccuggagggcgggugggagggcaugaucgccggcuggcacggguacaccagccacggcgcccacgggguggcggucgccgccgaucucaaguccacccaggaggccaucaacaagaucaccaagaaccugaacagccuguccgagcucgaggugaagaaccugcagcggcugucgggcgccauggacgagcuccauaacgagauccuggagcuggacgagaagguggacgaccuccgcgcggacaccaucuccagccagaucgagcuggccguccugcucuccaaugagggcaucaucaacagcgaggacgagcaccuccuggcccuggagcggaagcugaagaagaugcuggggcccuccgccguggacaucggcaacgggugcuuugagacgaagcacaagugcaaccagaccugccucgaccgcaucgcggccggcaccuucaacgccggggaguuuagccugcccaccuucgacucccugaacaucaccgccgccagccucaacgaugacggccuggacaaccacacgauccugcuguacuacuccaccgcggccagcucccucgccgugacccugaugcuggccaucuuuaucgucuacauggugagccgggacaacguguccugcagcaucugccucuga

SEQ ID NO: 14373 - RNA, 1758 nt, Artificial Sequence
  derived and/or modified CDS sequence (AUadapt) from InfluenzaB__AEP20332__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacgaagacccggggcaagcucugccccaagugucugaacugcaccgaccuggacguggcccucgggcgccccaagugcaccggcaacaucccguccgccgaggugucgauccugcacgagguccggcccgugacguccggcugcuuccccaucaugcacgaccgcaccaagauccggcagcugcccaaccuccugcgcggguaugagcacauccggcugagcacccacaacgugaucaacgccgagaaggcgccgggcgggcccuacaagaucggcaccuccgggucgugccccaacgucacgaacggcaacggcuucuucgccaccauggccugggccgugcccaagaacgauaacaacaagaccgcgaccaacccgcucacgaucgaggugcccuacaucugcaccgagggggaggaccagaucaccgucuggggcuuccacuccgacaacgagacccagauggccaagcuguacggggacagcaagccccagaaguuuacguccucggccaacggcgugaccacccacuacgugucccagaucggcggguuccccaaccagaccgaggacggcgggcugccgcagucgggccgcaucgucguggacuacauggugcagaaguccgggaagacgggcaccaucaccuaccagcggggcauccuccugccccagaaggucuggugcgccagcgggcgcuccaaggugaucaagggcucgcugccccucaucggggaggccgauugccugcacgagaaguacggcgggcugaacaagucgaagcccuacuacaccggcgagcacgcgaaggccaucggcaacugcccgaucugggugaagacgccccucaagcuggccaacgggaccaaguaccggccgcccgccaagcugcucaaggagcgcggcuucuuuggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagcgagcuggaggucaagaaccuccagcggcuguccggcgccauggacgagcugcacaaugagauccucgagcuggacgagaagguggacgaccugcgcgccgacaccaucucgucccagaucgagcucgccgugcugcugagcaacgaggggaucaucaacuccgaggacgagcaccuccuggcgcuggagcggaagcucaagaagaugcugggccccucggccgucgagaucgggaacggcugcuucgagaccaagcauaagugcaaccagaccugccuggaccgcaucgccgccgggaccuucgacgcgggcgaguucucccuccccacguucgacucgcugaacaucaccgccgccucccugaacgacgauggccucgacaaccacaccauccugcuguacuacagcaccgccgccuccucgcuggcggugacgcucaugaucgccaucuucguggucuacauggugucccgggacaacgugagcugcuccaucugccuguga

SEQ ID NO: 14374 - RNA, 1755 nt, Artificial Sequence; identical to SEQ ID NO: 14166
  derived and/or modified CDS sequence (AUadapt) from InfluenzaB__AEP20343__HA

SEQ ID NO: 14375 - RNA, 1755 nt, Artificial Sequence; identical to SEQ ID NO: 14166
  derived and/or modified CDS sequence (AUadapt) from InfluenzaB__AEP20354__HA

SEQ ID NO: 14376 - RNA, 1755 nt, Artificial Sequence; identical to SEQ ID NO: 14166
  derived and/or modified CDS sequence (AUadapt) from InfluenzaB__AEP20365__HA

SEQ ID NO: 14377 - RNA, 1755 nt, Artificial Sequence; identical to SEQ ID NO: 14166
  derived and/or modified CDS sequence (AUadapt) from InfluenzaB__AEP20376__HA

SEQ ID NO: 14378 - RNA, 1758 nt, Artificial Sequence
  derived and/or modified CDS sequence (AUadapt) from InfluenzaB__AEP20398__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggauguggcccucgggcgccccaagugcaccggcaacaucccguccgccgaggugucgauccugcacgagguccggcccgugacguccggcugcuuccccaucaugcacgaccgcaccaagauccggcagcugcccaaccuccugcgcggguacgagcacauccggcugucgacccacaacgugaucaacgccgagaaggcgccgggcgggcccuacaagaucggcaccuccgggagcugucccaacgucacgaacggcaacggcuucuucgccaccauggccugggccgugcccaagaacgacaacaacaagaccgcgaccaacucccucacgaucgaggugccguacaucugcaccgagggggaggaccagaucaccaucuggggcuuccacucggacaaugagacccagauggccaagcuguacggggacuccaagccccagaaguucacgucguccgccaacggcgucaccacccacuacgugagccagaucggcggguuccccaaccagaccgaggacggcgggcugccccaguccggccgcaucguggucgacuacauggugcagaaguccgggaagacgggcaccaucaccuaccagcggggcauccuccugccgcagaagguguggugcgccuccgggcgcucgaaggucaucaagggcucgcugccccucaucggggaggccgauugccugcacgagaaguacggcgggcugaacaaguccaagcccuacuacaccggcgagcacgcgaaggccaucggcaacugccccaucugggugaagacgccgcucaagcuggccaacgggaccaaguaccggccgcccgccaagcugcucaaggagcgcggcuucuucggggccaucgcgggcuuccuggagggcgggugggagggcaugaucgccggguggcacggcuacaccagccauggggcccacggcguggccgucgccgcggaccugaaguccacccaggaggccaucaacaagaucacgaagaaccucaacucgcuguccgagcuggaggugaagaaccuccagcggcugucgggcgccauggacgagcugcacaacgagauccucgagcuggacgagaaggucgacgaccugcgcgccgacaccaucuccagccagaucgagcucgccgugcugcuguccaacgaggggaucaucaauucggaggacgagcaccuccuggcgcuggagcggaagcucaagaagaugcugggccccuccgccguggagaucgggaacggcugcuucgagaccaagcacaagugcaaccagaccugccuggaccgcaucgccgccgggaccuucgacgcgggcgaguucucgcuccccacguucgacucccugaauaucaccgccgccagccugaacgacgacggccucgacaaccacaccauccugcuguacuacuccaccgccgccucgucccuggcggucacgcucaugaucgccaucuucgugguguacauggucucgcgggacaacguguccugcagcaucugccuguga

SEQ ID NO: 14379 - RNA, 1758 nt, Artificial Sequence; identical to SEQ ID NO: 14348
  derived and/or modified CDS sequence (AUadapt) from InfluenzaB__AEP20409__HA

SEQ ID NO: 14380 - RNA, 1758 nt, Artificial Sequence; identical to SEQ ID NO: 14348
  derived and/or modified CDS sequence (AUadapt) from InfluenzaB__AEP20420__HA

SEQ ID NO: 14381 - RNA, 1758 nt, Artificial Sequence; identical to SEQ ID NO: 14348
  derived and/or modified CDS sequence (AUadapt) from InfluenzaB__AEP20431__HA

SEQ ID NO: 14382 - RNA, 1758 nt, Artificial Sequence; identical to SEQ ID NO: 14348
  derived and/or modified CDS sequence (AUadapt) from InfluenzaB__AEP20442__HA

SEQ ID NO: 14383 - RNA, 1758 nt, Artificial Sequence; identical to SEQ ID NO: 14348
  derived and/or modified CDS sequence (AUadapt) from InfluenzaB__AEP20453__HA

SEQ ID NO: 14384 - RNA, 1755 nt, Artificial Sequence; identical to SEQ ID NO: 14166
  derived and/or modified CDS sequence (AUadapt) from InfluenzaB__AEQ39027__HA

SEQ ID NO: 14385 - RNA, 1758 nt, Artificial Sequence; identical to SEQ ID NO: 14118
  derived and/or modified CDS sequence (AUadapt) from InfluenzaB__AEQ39260__HA

SEQ ID NO: 14386 - RNA, 1758 nt, Artificial Sequence; identical to SEQ ID NO: 14118
  derived and/or modified CDS sequence (AUadapt) from InfluenzaB__AEQ39271__HA

SEQ ID NO: 14387 - RNA, 1758 nt, Artificial Sequence
  derived and/or modified CDS sequence (AUadapt) from InfluenzaB__AEQ39282__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuuugccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuucccaucaugcacgaccggaccaagauccgccagcugcccaaccuccugcggggguacgagcacauccgccugucgacccacaacgugaucaacgccgagaacgcgccgggcgggcccuacaagaucggcaccuccgggaguugccccaacgucacgaacggcaacggcuucuucgccaccauggccugggccgugcccaagaacgacaagaacaagaccgcgaccaacccgcucacgaucgaggugcccuacaucuguaccgagggggaggaccagaucaccgucuggggcuuccacuccgacaacgagacccagauggccaagcuguacggggacucgaagccccagaaguucacguccagcgccaacggcgugaccacccauuacgugucccagaucggcggguuccccaaccagaccgaggacggcgggcugccgcagucgggccggaucgucguggacuacauggugcagaaguccgggaagacgggcaccaucaccuaccagcgcggcauccuccugccccagaaggucuggugcgccagcgggcgguccaaggugaucaagggcucgcugccccucaucggggaggccgauugccugcacgagaaguacggcgggcugaacaagagcaagcccuacuacaccggcgagcacgcgaaggccaucggcaacugcccgaucugggugaagacgccccucaagcuggccaaugggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaauucccugucggagcuggaggucaagaaccuccagcgccuguccggcgccauggacgagcugcacaacgagauccucgagcuggacgagaagguggacgaccugcgggccgacaccaucagcucccagaucgagcucgccgugcugcugucgaaugaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggaucggaucgccgccgggaccuucgacgcgggcgaguucucccuccccacguucgacucgcugaacaucaccgccgccucccugaacggcgacgagcucgacaaccauaccauccugcuguacuacagcaccgccgccuccucgcuggcggugacgcucaugaucgccaucuucguggucuacauggugucccgcgacaacgugagcugcuccaucugccuguga

SEQ ID NO: 14388 - RNA, 1758 nt, Artificial Sequence
  derived and/or modified CDS sequence (AUadapt) from InfluenzaB__AEQ39315__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccauuucgccaaccugaaggggacggagacccggggcaagcucugccccaagugccugaacugcaccgaccuggacguggcccucgggcgccccaagugcaccggcaagaucccguccgcccgggugucgauccugcaugagguccgccccgugacguccggcugcuuccccaucaugcacgaccggaccaagauccgccagcugcccaaccuccugcggggguacgagcacauccgccugagcacccacaacgugaucaaugccgagaacgcgccgggcgggcccuacaagaucggcaccuccgggucgugccccaacgucacgaacggcaacggcuucuucgccaccauggccugggccgugcccaagaacgauaagaacaagaccgcgaccaacccgcucacgaucgaggugcccuacaucugcaccgagggggaggaccagaucaccgucuggggcuuccacuccgacaacgagacccagauggccaagcuguacggggauagcaagccccagaaguucacguccucggccaacggcgugaccacccacuacgugucccagaucggcggguuccccaaccagaccgaggacggcgggcugccgcagagcggccggaucgucguggauuacauggugcagaaguccgggaagacgggcaccaucaccuaccagcgcggcauccuccugccccagaaggucuggugcgccucggggcgguccaaggugaucaagggcagccugccccucaucggggaggccgacugccugcacgagaaguacggcgggcugaacaagaguaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcauggcuacaccucccacggggcccacggcgucgccguggccgcggaccugaaguccacccaggaggccaucaacaagaucacgaagaaccucaacucccugagcgagcuggaggucaagaaccuccagcgccuguccggcgccauggacgagcugcauaacgagauccucgagcuggacgagaagguggacgaccugcgggccgacaccaucucgucccagaucgagcucgccgugcugcugagcaacgaggggaucaucaacuccgaggacgagcaucuccuggcgcuggagcgcaagcucaagaagaugcugggccccucggccgucgagaucgggaacggcugcuucgagaccaagcacaagugcaaccagaccugccuggaccggaucgccgccgggaccuucgaugcgggcgaguucucccuccccacguucgacagccugaacaucaccgccgccucccugaacggcgacgggcucgacaaccacaccauccugcuguauuacucgaccgccgccuccagccuggcggugacgcucaugaucgccaucuucguggucuacauggugucccgcgacaacgugagcugcuccaucugccuguga

SEQ ID NO: 14389 - RNA, 1758 nt, Artificial Sequence; identical to SEQ ID NO: 14388
  derived and/or modified CDS sequence (AUadapt) from InfluenzaB__AEQ39326__HA

SEQ ID NO: 14390 - RNA, 1758 nt, Artificial Sequence
  derived and/or modified CDS sequence (AUadapt) from InfluenzaB__AEQ39337__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuuugccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuucccaucaugcacgaccggaccaagauccgccagcugcccaaccuccugcggggguacgagcacauccgccugucgacccacaacgugaucaacgccggcaacgcgcccgggggccccuacaagaucgggaccuccggcaguugccccaacgucacgaacggcaacggguucuucgccaccauggccugggccgugcccaagaacgacaagaacaagaccgcgaccaacccgcucacgaucgaggugcccuacaucuguaccgagggcgaggaccagaucaccgucuggggguuccacuccgacaacgagacccagauggccaagcuguacggcgacucgaagccccagaaguucacguccagcgccaacggcgugaccacccauuacgugucccagaucgggggcuuccccaaccagaccgaggacgggggccugccgcagucggggcggaucgucguggacuacauggugcagaaguccggcaagacgggcaccaucaccuaccagcgcgggauccuccugccccagaaggucuggugcgccagcggccgguccaaggugaucaaggggucgcugccccucaucggcgaggccgauugccugcacgagaaguacgggggccugaacaagagcaagcccuacuacaccggcgagcacgcgaaggccaucgggaacugcccgaucugggugaagaagccccucaagcuggccaacggcacgaaguaucgcccgcccgccaagcugcucaaggagcggggguucuucggcgccaucgcgggguuccuggagggcggcugggaggggaugaucgccggcuggcacggguacaccucccacggcgcccacggcgucgccguggccgcggaccugaaguccacccaggaggccaucaacaagaucaccaagaaccucaacucccugagugagcuggaggucaagaaccuccagcgccuguccggggccauggacgagcugcacaacgagauccucgagcuggacgagaagguggacgaccugcgggccgacacgaucagcucccagaucgagcucgccgugcugcugucgaacgagggcaucaucaauuccgaggacgagcaccuccuggcgcuggagcgcaagcucaagaagaugcuggggccgagcgccgucgagaucggcaacgggugcuucgagaccaagcacaagugcaaccagaccugccuggaccggaucgccgccggcaccuuugacgcgggcgaguucucccuccccaccuucgacucgcugaacaucacggccgccucccugaacgacgacgggcucgacaaccauaccauccugcuguacuacagcaccgccgccuccucgcuggcggugacccucaugaucgccaucuucguggucuacauggugucccgcgacaacgugagcugcuccaucugccuguga

SEQ ID NO: 14391 - RNA, 1758 nt, Artificial Sequence
  derived and/or modified CDS sequence (AUadapt) from InfluenzaB__AEQ39348__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugucccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaucuccugcggggguacgagcacauccgccugucgacccacaacgugaucaacgccgagaacgcgccgggcgggcccuacaagaucggcaccuccgggagcugccccaacgucacgaacggcaauggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaaugagacccagauggccaagcuguacggggacucgaagccccagaaguucacguccagcgccaacggcgugaccacccacuacgugucccagaucggcggguuccccaaccagaccgaggacggcgggcugccgcagucgggccggaucgucguggauuacauggugcagaaguccgggaagacgggcaccaucaccuaccagcgcggcauccuccugccccagaaggucuggugcgccagcgggcgguccaaggugaucaagggcucgcugccccucaucggggaggccgacugccugcacgagaaguacggcgggcugaacaagagcaagcccuacuauaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaucugaaguccacccaggaggccaucaacaagaucacgaagaaccucaacucccugucggagcuggaggucaagaaccuccagcgccuguccggcgccauggacgagcugcacaacgagauccucgagcuggacgagaagguggacgaccugcgggccgacaccaucaguucccagaucgagcucgccgugcugcugucgaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugucuggaccggaucgccgccgggaccuucgacgcgggcgaguucucccuccccacguucgacucgcugaacaucaccgccgccucccugaacgacgacggccucgacaaucacaucauccugcuguacuacagcaccgccgccuccucgcuggcggugacccucaugaucgccaucuucguggucuacauggugucccgcgacaacgugagcugcuccaucugccuguga

SEQ ID NO: 14392 - RNA, 1758 nt, Artificial Sequence; identical to SEQ ID NO: 14388
  derived and/or modified CDS sequence (AUadapt) from InfluenzaB__AEQ39359__HA

SEQ ID NO: 14393 - RNA, 1758 nt, Artificial Sequence
  derived and/or modified CDS sequence (AUadapt) from InfluenzaB__AEQ39370__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccacuucgccaaucugaaggggacggagacccggggcaagcucugccccaagugccugaacugcaccgaccuggacguggcccucgggcgccccaagugcaccggcaacaucccguccgcccgggugucgauccugcacgagguccgccccgugacguccggcugcuuucccaucaugcacgaccggaccaagauccgccagcugcccaaccuccugcggggguacgagcacauccgccugagcacccacaacguggucaacgccgagaacgcgccgggcgggcccuacaagaucggcaccuccgggaguugccccaacgugacgaacggcaacggcuucuucgccaccauggccugggccgugcccaagaacgacaacaacaagaccgcgaccaacucccucacgaucgaggucccguauaucugcaccgagggggaggaccagaucaccguguggggcuuccacagcgacaacgagacccagauggccaagcuguacggggacuccaagccccagaaguucacgucguccgccaauggcgugaccacccacuacgucagccagaucggcggguuccccaaccagaccgaggacggcgggcugccccaguccggccggaucgugguggacuacaugguccagaaguccgggaagacgggcaccaucaccuaccagcgcggcauccuccugccgcagaagguguggugcgccuccgggcggucgaaggugaucaagggcagccugccccucaucggggaggccgauugccugcacgagaaguacggcgggcugaacaaguccaagcccuacuacaccggcgagcacgcgaaggccaucggcaacugccccaucugggucaagacgccgcucaagcuggccaacgggaccaaguaccgcccgcccgccaagcugcucaaggagcggggcuuuuucggggccaucgcgggcuuccuggagggcgggugggagggcaugaucgccggguggcacggcuacaccucgcacggggcccacggcguggccgucgccgcggaccugaaguccacccaggaggccaucaacaagaucacgaagaaccucaacagucuguccgagcuggaggugaagaaccuccagcgccugucgggcgccauggacgagcugcacaacgagauccucgagcuggacgagaagguggacgaccugcgggccgacaccaucuccagccagaucgagcucgccguccugcuguccaacgaggggaucaucaauucggaggacgagcaccuccuggcgcuggagcgcaagcucaagaagaugcugggccccuccgccguggagaucgggaacggcugcuucgagaccaagcacaagugcaaccagaccugccuggaccggaucgccgccgggaccuuugacgcgggcgaguucagccuccccacguucgacucccugaacaucaccgccgccucgcugaacgacgacggccucgacaaucacaccauccugcuguacuacuccaccgccgccagcucccuggcggugacgcucaugaucgccaucuucgucguguacauggugucgcgcgacaacgucuccugcagcaucugccuguga

SEQ ID NO: 14394 - RNA, 1755 nt, Artificial Sequence; identical to SEQ ID NO: 14166
  derived and/or modified CDS sequence (AUadapt) from InfluenzaB__AEQ39392__HA

SEQ ID NO: 14395 - RNA, 1755 nt, Artificial Sequence; identical to SEQ ID NO: 14166
  derived and/or modified CDS sequence (AUadapt) from InfluenzaB__AEQ39429__HA

SEQ ID NO: 14396 - RNA, 1755 nt, Artificial Sequence; identical to SEQ ID NO: 14166
  derived and/or modified CDS sequence (AUadapt) from InfluenzaB__AEQ39440__HA

SEQ ID NO: 14397 - RNA, 1755 nt, Artificial Sequence; identical to SEQ ID NO: 14166
  derived and/or modified CDS sequence (AUadapt) from InfluenzaB__AEQ39451__HA

SEQ ID NO: 14398 - RNA, 1758 nt, Artificial Sequence; identical to SEQ ID NO: 14378
  derived and/or modified CDS sequence (AUadapt) from InfluenzaB__AEQ39462__HA

SEQ ID NO: 14399 - RNA, 1758 nt, Artificial Sequence; identical to SEQ ID NO: 14118
  derived and/or modified CDS sequence (AUadapt) from InfluenzaB__AEQ39484__HA

SEQ ID NO: 14400 - RNA, 1755 nt, Artificial Sequence; identical to SEQ ID NO: 14145
  derived and/or modified CDS sequence (AUadapt) from InfluenzaB__AEQ39506__HA

SEQ ID NO: 14401 - RNA, 1758 nt, Artificial Sequence
  derived and/or modified CDS sequence (AUadapt) from InfluenzaB__AEQ39517__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaauaucccguccgccgaggugucgauccugcacgagguccggcccgugacguccggcugcuuccccaucaugcacgaccgcaccaagauccggcagcugcccaaccuccugcgcggguacgagcacauccggcugucgacccacaacgugaucaacgccgagaaggcgccgggcgggcccuacaagaucggcaccuccgggucgugccccaacgucacgaacggcaacggcuucuuugccaccauggccugggccgugcccaagaacgacaacaacaagaccgcgaccaacucccucacgaucgaggugccguacaucugcaccgagggggaggaccagaucaccaucuggggcuuccacagcgacaacgagacccagauggccaagcuguacggggacuccaagccccagaaguucacgucguccgccaacggcgucaccacccacuacgugagucagaucggcggguuccccaaccagaccgaggacggcgggcugccccaguccggccgcaucguggucgacuacauggugcagaaguccgggaagacgggcaccaucaccuaccagcggggcauccuccugccgcagaagguguggugcgccuccgggcgcagcaaggucaucaagggcucgcugccccucaucggggaggccgacugccugcacgagaaguacggcgggcugaacaaguccaagcccuacuacaccggcgagcacgcgaaggccaucggcaacugccccaucugggugaagacgccgcucaagcuggccaaugggaccaaguaccggccgcccgccaagcugcucaaggagcgcggcuucuucggggccaucgcgggcuuccuggagggcgggugggagggcaugaucgccggguggcacggcuacaccucgcacggggcccacggcguggccgucgccgcggaccugaaguccacccaggaggccaucaacaagaucacgaagaaccucaacucgcuguccgagcuggaggugaagaaccuccagcggcugagcggcgccauggacgagcugcacaacgagauccucgagcuggacgagaaggucgaugaccugcgcgccgacaccaucuccucgcagaucgagcucgccgugcugcuguccaacgaggggaucaucaacucggaggacgagcaccuccuggcgcuggagcggaagcucaagaagaugcugggccccuccgccguggagaucgggaacggcugcuucgagaccaagcacaagugcaaccagaccugccuggaccgcaucgccgccgggaccuucgacgcgggcgaguucucgcuccccacguuugacucccugaacaucaccgccgccagccugaacgacaacggccucgacaaccacaccauccugcuguacuacuccaccgccgccucgucccuggcggucacgcucaugaucgccaucuucgugguguacauggucucgcgggacaacguguccugcagcaucugccuguga

SEQ ID NO: 14402 - RNA, 1758 nt, Artificial Sequence
  derived and/or modified CDS sequence (AUadapt) from InfluenzaB__AER27038__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugucccaagugccccaacugcaccgaccuggacguggcccuggggcgcccgaagugcaccggcaagauccccuccgcccgggugucgauccuccacgagguccgccccgugacguccggcugcuuccccaucaugcacgaccggaccaagauccgccagcugccgaaucugcuccggggguacgagcacauccgccugagcacccacaacgugaucaacgccgagaacgcgcccggcgggcccuacaagaucggcaccuccgggucgugccccaacgucacgaacggcaauggcuucuucgccaccauggccugggccgugccgaagaacgacaagaacaagaccgcgaccaacccccugacgaucgaggugcccuacaucugcaccaagggggaggaccagaucaccgucuggggcuuccacuccgacaaugagacccagauggccaagcucuacggggacagcaagccccagaaguucacguccucggccaacggcgugaccacccacuacgugucccagaucggcggguucccgaaccagaccgaggacggcgggcugccccagucgggccggaucgucguggauuacauggugcagaaguccgggaagacgggcaccaucaccuaccagcgcggcauccugcucccccagaaggucuggugcgccagcgggcgguccaaggugaucaagggcucgcugccccugaucggggaggccgacugccuccacgagaaguacggcgggcugaacaagucgaagccguacuauaccggcgagcacgcgaaggccaucggcaacugccccaucugggugaagacgccccugaagcucgccaacgggaccaaguaccggcccccggccaagcugcugaaggagcgcggcuucuucggggccaucgcgggcuuccucgagggcgggugggagggcaugaucgccggguggcacggcuacaccucccacggggcccacggcaucgccgucgccgcggaucugaaguccacccaggaggccaucaacaagaucacgaagaaccugaacucccucagcgagcuggaggugaagaaccugcagcgccucuccggcgccauggacgagcugcacaacgagauccuggagcucgacgagaaggucgacgaccugcgggccgacaccaucaguucccagaucgagcuggccgugcuccugagcaacgaggggaucaucaacuccgaggacgagcaccuccuggcgcuggagcgcaagcugaagaagaugcucggccccucggccguggagaucgggaacggcugcuucgagaccaagcacaagugcaaccagaccugucuggaccggaucgccgccgggaccuucgacgcgggcgaguucucccugcccacguucgacucgcucaacaucaccgccgccucccugaacgacgacggccuggacaaucacaccauccuccuguacuacagcaccgccgccuccucgcuggcggucacgcugaugaucgccaucuucgugguguacauggucucccgcgacaacgugagcugcuccaucugccucuga

SEQ ID NO: 14403 - RNA, 1758 nt, Artificial Sequence; identical to SEQ ID NO: 14348
  derived and/or modified CDS sequence (AUadapt) from InfluenzaB__AER27060__HA

SEQ ID NO: 14404 - RNA, 1758 nt, Artificial Sequence
  derived and/or modified CDS sequence (AUadapt) from InfluenzaB__AET10061__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugucccaagugccugaacugcaccgaccuggacguggcccucgggcgccccaagugcaccggcaacaucccguccgcccgggugagcauccugcacgagguccgccccgugacguccggcugcuuccccaucaugcacgaucggaccaagauccgccagcugcccaaccuccugcggggguacgagcacauccgccugucgacccacaacgugaucaacgccaagaacgcgccgggcgggcccuacaagaucggcaccuccgggagcugccccaacgucacgaauggcaacggcuucuucgccaccauggccugggccgugcccaagaacgacaagaaccggaccgcgaccaacucccucacgaucgaggugccguacaucugcaaggagggggaggaccagaucaccgucuggggcuuccacagugacaacgagacccagauggccaagcuguacggggacuccaagccccagaaguucaccagcuccgccaacggcgugacgacccacuacgugucgcagaucggcggguuccccaaccagaccgaggauggcgggcugccccaguccggccgcaucgucguggacuacauggugcagaaguccgggaagaccggcacgaucaccuaccagcggggcauccuccugccgcagaaggucuggugcgccuccgggcgcagcaaggugaucaagggcucgcugccccucaucggggaggccgacugccugcacgagaaguacggcgggcugaacaaguccaagcccuacuacaccggcgagcaugcgaaggccaucggcaacugccccaucugggugaagaccccgcucaagcuggccaacgggacgaaguaccggccgcccgccaagcugcucaaggagcgcggcuucuucggggccaucgcgggcuuccuggagggcgggugggagggcaugaucgccggguggcacggcuacaccucgcacggggcccacggcgucgccguggccgcggaucugaaguccacccaggaggccaucaacaagaucaccaagaaccucaacagccuguccgagcuggaggucaagaaccuccagcggcugucgggcgccauggacgagcugcacaacgagauccucgagcuggacgagaagguggacgaccugcgcgccgauacgaucuccagccagaucgagcucgccgugcugcuguccaacgaggggaucaucaacucggaggacgagcaccuccuggcgcuggagcggaagcucaagaagaugcugggccccuccgccgucgagaucgggaacggcugcuucgagaccaagcacaagugcaaccagaccugucuggaccgcaucgccgccgggaccuucgacgcgggcgaguucagccuccccaccuucgacucccugaacaucacggccgccucgcugaacgacgacggccucgauaaccacaccauccugcuguacuacuccaccgccgccagcucccuggcggugacccucaugaucgccaucuucguggucuacauggugucgcgggacaacguguccugcagcaucugccuguga

SEQ ID NO: 14405 - RNA, 1755 nt, Artificial Sequence
  derived and/or modified CDS sequence (AUadapt) from InfluenzaB__AET10062__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaucacccccaccaaguccuacuuugccaaccugaaggggacccggacgcgcggcaagcucugccccgacugccugaacugcaccgaccuggacguggcccucgggcggcccaugugcgugggcaccaccccguccgccaaggccaguauccugcacgagguccgccccgugacguccggcugcuuccccaucaugcacgaccggaccaagauccgccagcugcccaaccuccugcggggguacgagaacauccgccugucgacccagaacgugaucgaugcggagaaggccccgggcgggcccuaccggcucggcaccuccgggagcugccccaacgccacguccaagaucggcuucuucgccaccauggcgugggccguccccaaggacaacuacaagaaugccaccaacccgcugaccguggaggugcccuacaucugcaaggagggcgaggaccagaucacggucuggggguuccacagcgacaacaagacccagaugaagaaucuguacggcgacuccaacccccagaaguucaccagcuccgccaacggggugaccacgcacuacgugucgcagaucggcgacuuucccgaccagaccgaggacggcgggcucccgcaguccggccgcaucgucguggacuacaugaugcagaagcccgggaagaccggcaccaucguguaccagcgcgggguccugcugccccagaagguguggugcgccagcggccgguccaaggugaucaagggcagccucccccugaucggggaggcggacugucugcacgagaaguacggcgggcucaacaagagcaagccguacuacacgggcgagcacgccaaggccaucgggaacugccccaucugggucaagacgccccugaagcuggccaauggcaccaaguaccggcccccggccaagcuccugaaggagcgcggcuucuucggggcgaucgccggcuuccuggagggcgggugggaggggaugaucgccggcuggcacggcuacaccucccacggggcccacggcguggccgucgcggccgaccucaagucgacccaggaggccaucaauaagaucaccaagaaccugaacucccugagcgagcucgaggugaagaaccugcagcggcuguccggggccauggacgagcuccacaacgagauccuggagcuggacgagaagguggacgaucuccgcgccgacaccaucagcucccagaucgagcuggcgguccugcucagcaacgagggcaucaucaacuccgaggacgagcaccuccuggcccuggagcggaagcugaagaagaugcugggccccucggccguggacaucgggaauggcugcuucgagaccaagcacaagugcaaccagacgugccucgaccgcaucgccgcggggaccuucaacgccggcgaguucucccugcccaccuuugacagccugaacaucaccgccgccucccucaacgacgacgggcuggacaaccacaccauccugcuguauuacagcacggccgcguccagccucgccgugacccugaugcuggccaucuucaucgucuacauggugucccgggacaacgugagcugcuccaucugccucuga

SEQ ID NO: 14406 - RNA, 1755 nt, Artificial Sequence
  derived and/or modified CDS sequence (AUadapt) from InfluenzaB__AET10064__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuauuucgccaaccugaaggggacgcggacccgcggcaagcucugccccgacugccugaacugcaccgaccuggacguggcccucgggcggcccaugugugugggcaccacgccguccgccaaggccagcauccugcacgagguccgccccgugaccuccggcugcuuccccaucaugcacgaccggaccaagauccgccagcugcccaaccuccugcggggguacgagaacauccgccugaguacccagaacgugaucgacgcggagaaggccccgggcgggcccuaccggcucggcacguccgggagcugccccaacgccaccuccaagaucggcuucuucgccaccauggcgugggccguccccaaggauaacuacaagaacgccaccaacccgcugacgguggaggugcccuacaucugcaccgagggcgaggaccagaucaccaucuggggguuccacagugacaacaagacccagaugaagaaccuguacggcgacuccaacccccagaaguucacgagcuccgccaacggggucaccacccauuacgugucgcagaucggcgacuuccccgaccagaccgaggacggcgggcucccgcaguccggccgcaucguggucgacuacaugaugcagaagcccgggaagacgggcaccaucguguaucagcgcggggugcugcugccccagaaggucuggugcgccagcggccgguccaaggugaucaagggcagccucccccugaucggggaggcggacugccugcacgagaaguacggcgggcucaacaagagcaagccguauuacaccggcgagcacgccaaggccaucgggaacugccccaucugggugaagacgccccugaagcuggccaacggcaccaaguaccggcccccggccaagcuccugaaggagcgcggcuucuucggggcgaucgccggcuuccuggagggcgggugggaggggaugaucgccggcuggcauggcuacaccucccacggggcccacggcgucgccguggcggccgaccucaagucgacccaggaggccaucaacaagaucaccaagaaccugaacucccugagugagcucgaggucaagaaccugcagcggcuguccggggccauggacgagcuccacaacgagauccuggagcuggacgagaagguggacgaccuccgcgccgacacgaucagcucccagaucgagcuggcggugcugcucaguaacgagggcaucaucaacuccgaggacgagcaccuccuggcccuggagcggaagcugaagaagaugcugggccccucggccgucgacaucgggaacggcugcuucgagaccaagcauaagugcaaccagaccugccucgaccgcaucgccgcggggaccuucaacgccggcgaguucucccugcccaccuucgauagccugaacaucacggccgccucccucaacgacgacgggcuggacaaccacaccauccugcuguacuauagcaccgccgcguccagccucgccgugacccugaugcuggccaucuucaucguguacauggucucccgggacaacgugagcugcuccaucugccucuga

SEQ ID NO: 14407 - RNA, 1755 nt, Artificial Sequence
  derived and/or modified CDS sequence (AUadapt) from InfluenzaB__AET10065__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuauuucgccaaccugaaggggacgcggacccgcggcaagcucugccccgacugccugaacugcaccgaccuggacguggcccucgggcggcccaugugugugggcaccacgccguccgccaaggccagcauccugcacgagguccgccccgugaccuccggcugcuuccccaucaugcacgaccggaccaagauccgccagcugcccaaccuccugcggggguacgagaacauccgccugaguacccagaacgugaucgacgcggagaaggccccgggcgggcccuaccggcucggcacguccgggagcugccccaacgccaccuccaagaucggcuucuucgccaccauggcgugggccguccccaaggauaacuacaagaacgccaccaacccgcugacgguggaggugcccuacaucugcaaggagggcgaggaccagaucaccgucuggggguuccacagugacaacaagacccagaugaagaaccuguacggcgacuccaacccccagaaguucaccagcuccgccaacggggugacgacccauuacgugucgcagaucggcgacuuccccgaccagaccgaggacggcgggcucccgcaguccggccgcaucgucguggacuacaugaugcagaagcccgggaagaccggcacgaucguguaucagcgcgggguccugcugccccagaagguguggugcgccagcggccgguccaaggugaucaagggcagccucccccugaucggggaggcggacugccugcacgagaaguacggcgggcucaacaagagcaagccguauuacaccggcgagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcauggcuacaccucccacggggcccacggcguggccgucgcggccgaccucaagucgacccaggaggccaucaacaagaucaccaagaaccugaacucccugagugagcucgaggugaagaaccugcagcggcuguccggggccauggacgagcuccacaacgagauccuggagcuggacgagaagguggacgaccuccgcgccgacaccaucagcucccagaucgagcuggcgguccugcucaguaacgagggcaucaucaacuccgaggacgagcaccuccuggcccuggagcggaagcugaagaagaugcugggccccucggccguggacaucgggaacggcugcuucgagacgaagcauaagugcaaccagaccugccucgaccgcaucgccgcggggaccuucaacgccggcgaguucucccugcccaccuucgauagccugaacaucaccgccgccucccucaacgacgacgggcuggacaaccacacgauccugcuguacuauagcaccgccgcguccagccucgccgugacccugaugcuggccaucuucaucgucuacauggugucccgggacaacgugagcugcuccaucugccucuga

SEQ ID NO: 14408 - RNA, 1755 nt, Artificial Sequence; identical to SEQ ID NO: 14407
  derived and/or modified CDS sequence (AUadapt) from InfluenzaB__AET10066__HA

SEQ ID NO: 14409 - RNA, 1755 nt, Artificial Sequence
  derived and/or modified CDS sequence (AUadapt) from InfluenzaB__AET10067__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacggccacccccaccaaguccuauuucgccaaccugaaggggacccggacgcgcggcaagcucugccccgacugccugaacugcaccgaccuggauguggcccucgggcggcccaugugcgugggcaccaccccguccgccaaggcgagcauccugcacgagguccgccccgugacguccggcugcuuccccaucaugcacgaccggaccaagauccgccagcugcccaaccuccugcggggguaugagaacauccgccugagcacccagaacgugaucgacgccgagaaggccccgggcgggcccuaccggcucggcaccuccgggucgugccccaacgccacguccaagaucggcuuuuucgcgaccauggccugggccguccccaaggacaacuacaagaacgccaccaacccgcugaccguggaggugcccuacaucugcaaggagggcgaggaucagaucacggucuggggguuccacagcgacaacaagacccagaugaagaaccuguacggcgacuccaauccccagaaguucaccagcuccgccaacggggugaccacgcacuacgugagccagaucggcgacuuccccgaucagaccgaggacggcgggcucccgcaguccggccgcaucgucguggacuacaugaugcagaagcccgggaagaccggcaccaucguguaccagcgcgggguccugcugccccagaagguguggugcgcgagcggccgguccaaggugaucaagggcucgcucccccugaucggggaggccgacugucugcacgagaaguacggcgggcucaacaagagcaagccguacuacacgggcgagcacgccaaggccaucgggaacugucccaucugggucaagacgccccugaagcuggccaacggcaccaaguaccggcccccggcgaagcuccugaaggagcgcggcuucuucggggccaucgccggcuuccuggagggcgggugggaggggaugaucgccggcuggcacggcuacaccucccacggggcccauggcguggcggucgccgccgaccucaagagcacccaggaggccaucaacaagaucaccaagaaccugaacucccugagcgagcucgaggugaagaaccugcagcggcuguccggggccauggacgagcuccauaacgagauccuggagcuggacgagaagguggacgaccuccgcgcggacaccaucagcucccagaucgagcuggccguccugcucucgaacgagggcaucaucaauuccgaggacgagcaccuccuggcccuggagcggaagcugaagaagaugcugggccccagcgccguggacaucgggaacggcugcuucgagaccaagcacaaguguaaccagacgugccucgaccgcaucgcggccgggaccuucaacgccggcgaguucucccugcccaccuucgacagucugaacaucaccgccgccucccucaacgacgacgggcuggacaaccacaccauccugcuguacuauagcacggcggccuccagccucgccgugacccugaugcuggccaucuucaucgucuacauggugucccgggacaacgugagcugcuccaucugccucuga

SEQ ID NO: 14410 - RNA, 1755 nt, Artificial Sequence
  derived and/or modified CDS sequence (AUadapt) from InfluenzaB__AET10068__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccgcccccaccaaguccuacuucgccaaccugaaggggacccggacgcgcggcaagcucugccccgacugccugaacugcaccgaucuggacguggcccucgggcggcccaugugcgccggcaccaccccguccgcgaaggccagcauccugcacgaggugcgccccgucacguccggcugcuuccccaucaugcacgaucggaccaagauccgccagcugcccaaccuccugcggggguacgagaacauccgccugagcacccagaacgugaucgacgccgagaaggccccgggcgggcccuaccggcucggcaccuccgggucgugucccaacgcgacguccaagaucggcuucuucgccaccauggccugggccgugcccaaggacaacuacaagaacgccaccaauccgcugaccgucgaggugcccuacaucugcaaggagggcgaggaccagaucacgguguggggguuccacagcgacaacaagacccagaugaagaaucuguacggcgacuccaacccccagaaguucaccagcuccgcgaacggggucaccacgcacuaugugagccagaucggcgacuuccccgaccagaccgaggacggcgggcucccgcaguccggccgcaucguggucgacuacaugaugcagaagcccgggaagaccggcaccaucguguaccagcgcggggugcugcugccccagaaggucuggugugccagcggccgguccaaggugaucaagggcucgcucccccugaucggggaggccgacugccugcacgagaaguacggcgggcucaacaagaguaagccguacuacacgggcgagcacgccaaggccaucgggaacugccccaucugggugaagacgccccugaagcuggcgaacggcaccaaguaccggcccccggccaagcuccugaaggagcgcggcuucuuuggggccaucgccggcuuccuggagggcgggugggaggggaugaucgccggcuggcacggcuacaccucccacggggcgcacggcgucgccguggccgccgaccucaagagcacccaggaggccaucaauaagaucaccaagaaccugaacucccugagcgagcucgaggucaagaaccugcagcggcuguccggggcgauggacgagcuccacaacgagauccuggagcuggacgagaagguggaugaccuccgcgccgacaccaucagcucccagaucgagcuggccgugcugcucucgaacgagggcaucaucaacuccgaggacgagcaucuccuggcccuggagcggaagcugaagaagaugcugggccccagcgcggucgacaucgggaacggcugcuucgagaccaagcacaagugcaaccagacgugucucgaccgcaucgccgccgggaccuucaacgccggcgaguucucccugcccaccuucgacagccugaauaucaccgccgcgucccucaacgacgacgggcuggacaaccacaccauccugcuguacuacaguacggccgccuccagccucgccgugacccugaugcuggccaucuucaucguguacauggucucccgggacaacgugagcugcuccaucugccucuga

SEQ ID NO: 14411 - RNA, 1755 nt, Artificial Sequence; identical to SEQ ID NO: 14407
  derived and/or modified CDS sequence (AUadapt) from InfluenzaB__AET10069__HA

SEQ ID NO: 14412 - RNA, 1758 nt, Artificial Sequence
  derived and/or modified CDS sequence (AUadapt) from InfluenzaB__AET10070__HA
augaaggccaucaucgugcugcucauggucgugaccaguaacgccgaccgcaucugcaccggcaucacguccucgaacagcccccacguggucaagaccgcgacccagggggaggugaaggugaccggcgucaucccgcugacgaccacccccaccaagucgcacuuugccaaccugaaggggacggagacccggggcaagcucugccccaagugccccaacugcaccgaccuggacguggcccuggggcgcccgaagugcaccggcaagauccccuccgcccgggugagcauccuccacgagguccgccccgugacguccggcuguuuccccaucaugcacgaccggaccaagauccgccagcugccgaaccugcuccggggguacgagcacauccgccugucgacccacaacgugaucaacgccgagaaugcgcccggcgggcccuacaagaucggcaccuccgggagcugccccaacgucacgaacggcaacggcuucuucgccaccauggccugggccgugccgaagaacgacaagaauaagaccgcgaccaacccccugacgaucgaggugcccuacaucugcaccgagggggaggaccagaucaccgucuggggcuuccacuccgacaacgagacccagauggccaagcucuacggggacaguaagccccagaaguucacguccagcgccaacggcgugaccacccacuacgugucccagaucggcggguucccgaaccagaccgaggacggcgggcugccccagucgggccggaucgucguggacuauauggugcagaaguccgggaagacgggcaccaucaccuaccagcgcggcauccugcucccccagaaggucuggugcgccagcgggcgguccaaggugaucaagggcucgcugccccugaucggggaggccgacugccuccacgagaaguacggcgggcugaacaagagcaagccguauuacaccggcgagcacgcgaaggccaucggcaacugccccaucugggugaagacgccccugaagcucgccaacgggaccaaguaccggcccccggccaagcugcugaaggagcgcggcuucuucggggccaucgcgggcuuccucgagggcgggugggagggcaugaucgccggguggcacggcuauaccucccacggggcccacggcgucgccguggccgcggaccugaaguccacccaggaggccaucaacaagaucacgaagaaccugaacucccucucggagcuggaggucaagaaccugcagcgccucuccggcgccauggacgagcugcacaaugagauccuggagcucgacgagaagguggacgaccugcgggccgacaccaucagcucccagaucgagcuggccgugcuccugucgaacgaggggaucaucaacuccgaggacgagcaccuccuggcgcuggagcgcaagcugaagaagaugcucggccccagugccgucgagaucgggaacggcugcuucgagaccaagcacaagugcaaccagaccugccuggaccggaucgccgccgggaccuucgacgcgggcgaguuuucccugcccacguucgacucgcucaacaucaccgccgccucccugaacgacgacggccuggacaaccacaccauccuccuguauuacagcaccgccgccuccucgcuggcggugacgcugaugaucgccaucuucguggucuacauggugucccgcgacaacgugagcugcuccaucugccucuga

SEQ ID NO: 14413 - RNA, 1758 nt, Artificial Sequence; identical to SEQ ID NO: 14348
  derived and/or modified CDS sequence (AUadapt) from InfluenzaB__AET10071__HA

SEQ ID NO: 14414 - RNA, 1758 nt, Artificial Sequence; identical to SEQ ID NO: 14348
  derived and/or modified CDS sequence (AUadapt) from InfluenzaB__AET10072__HA

SEQ ID NO: 14415 - RNA, 1755 nt, Artificial Sequence
  derived and/or modified CDS sequence (AUadapt) from InfluenzaB__AET10073__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuauuucgccaaccugaaggggacgcggacccgcggcaagcucugccccgacugccugaacugcaccgaccuggauguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcgggggugugagaacauccgccugagcacccagaacgugaucgacgcggagaaggccccgggcgggcccuaccggcucggcacguccgggucgugccccaacgccaccuccaagaucggcuuuuucgccaccauggcgugggccguccccaaggacaacuacaagaacgccaccaacccgcugacgguggaggugcccuacaucugcaaggagggcgaggaucagaucaccgucuggggguuccacagcgacaacaagacccagaugaagaaccuguacggcgacuccaauccccagaaguucaccagcuccgccaacggggugacgacccacuacgugagccagaucggcgacuuccccgaucagaccgaggacggcgggcucccgcaguccggccgcaucgucguggacuacaugaugcagaagcccgggaagaccggcacgaucguguaccagcgcgggguccugcugccccagaagguguggugcgccagcggccgguccaaggugaucaagggcucgcucccccugaucggggaggcggacugucugcacgagaaguacggcgggcucaacaagagcaagccguacuacaccggcgagcacgccaaggccaucgggaacugucccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccucccacggggcccauggcguggccgucgcggccgaccucaagagcacccaggaggccaucaacaagaucaccaagaaccugaacucccugagcgagcucgaggugaagaaccugcagcggcuguccggggccauggacgagcuccauaacgagauccuggagcuggacgagaagguggacgaccuccgcgccgacaccaucagcucccagaucgagcuggcgguccugcucucgaacgagggcaucaucaauuccgaggacgagcaccuccuggcccuggagcggaagcugaagaagaugcugggccccagcgccguggacaucgggaacggcugcuucgagacgaagcacaaguguaaccagaccugccucgaccgcaucgccgcggggaccuucaacgccggcgaguucucccugcccaccuucgacagucugaacaucaccgccgccucccucaacgacgacgggcuggacaaccacacgauccugcuguacuauagcaccgccgcguccagccucgccgugacccugaugcuggccaucuucaucgucuacauggugucccgggacaacgugagcugcuccaucugccucuga

SEQ ID NO: 14416 - RNA, 1758 nt, Artificial Sequence
  derived and/or modified CDS sequence (AUadapt) from InfluenzaB__AET10074__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccacccggucgcacuucgccaaccugaaggggacggagacccgcggcaagcucugccccaagugccccaauugcaccgaccuggacguggcccuggggcggccgaagugcaccggcaagauccccuccgcccgcgugagcauccuccacgagguccggcccgugacguccggcugcuuucccaucaugcacgaccgcaccaagauccggcagcugccgaaccugcuccgcggguacgagcacauccggcugagcacccacaaugugaucaacgccgagaacgcgcccggcgggcccuacaagaucggcaccuccgggagcugccccaacgucacgaacggcaauggcuucuucgccaccauggccugggccgugccgaagaacgacaagaacaagaccgcgaccaacccccugacgaucgaggugcccuacaucuguaccgagggggaggaccagaucaccgucuggggcuuccacuccgacaacgagacccagauggccaagcucuacggggacaguaagccccagaaguucacguccagcgccaacggcgugaccacccacuacgugucccagaucggcggguucccgaaccagaccgaggauggcgggcugccccagagcggccgcaucgucguggacuacauggugcagaaguccgggcggacgggcaccaucaccuaccagcgcggcauccugcucccccagaaggucuggugcgccucggggcgguccaaggugaucaagggcagccugccccugaucggggaggccgauugccuccacgagaaguacggcgggcugaacaagagcaagccguacuacaccggcgagcaugcgaaggccaucggcaacugccccaucugggugaagacgccccugaagcucgccaacgggaccaaguaccggcccccggccaagcugcugaaggagcgcggcuucuucggggccaucgcgggcuuccucgagggcgggugggagggcaugaucgccggguggcauggcuacaccucccacggggcccacggcgucgccguggccgcggaccugaaguccacccaggaggccaucaacaagaucacgaagaaccugaacucccucagugagcuggaggucaagaaccugcagcgccucuccggcgccauggacgagcugcacaacgagauccuggagcucgacgagaagguggacgaccugcgggccgauaccaucucgucccagaucgagcuggccgugcuccugagcaacgaggggaucaucaacuccgaggacgagcaccuccuggcgcuggagcgcaagcugaagaagaugcucggccccagcgccgucgagaucgggaauggcugcuucgagaccaagcacaagugcaaccagaccugccuggaccggaucgccgccgggaccuuugacgcgggcgaguucucccugcccacguucgacucgcucaacaucaccgccgccucccuggacgaugacggccuggacaaccacaccauccuccuguacuacagcaccgccgccuccagucuggcggugacgcugaugaucgccaucuucguggucuacauggugucccgcgacaacgugagcugcuccaucugccucuga

SEQ ID NO: 14417 - RNA, 1758 nt, Artificial Sequence; identical to SEQ ID NO: 14348
  derived and/or modified CDS sequence (AUadapt) from InfluenzaB__AET10076__HA

SEQ ID NO: 14418 - RNA, 1758 nt, Artificial Sequence; identical to SEQ ID NO: 14348
  derived and/or modified CDS sequence (AUadapt) from InfluenzaB__AET10077__HA

SEQ ID NO: 14419 - RNA, 1758 nt, Artificial Sequence
  derived and/or modified CDS sequence (AUadapt) from InfluenzaB__AET10078__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccauuucgccaaccugaaggggacggagacccggggcaagcucugccccaagugccugaacugcaccgaccuggacguggcccucgggcgccccaagugcaccggcaagaucccguccgcccgggugucgguccugcaugaggugcgccccgugacguccggcugcuuccccaucaugcacgaccggaccaagauccgccagcugcccaaccuccugcggggguacgagcacauccgccugagcacccacaacgucaucaaugccgagaacgcgccgggcgggcccuacaagaucggcaccuccgggucgugccccaacgugacgaacggcaacggcuucuucgccaccauggccugggccgugcccaagaacgauaagaacaagaccgcgaccaacccgcucacgaucgagguccccuacaucugcaccgagggggaggaccagaucaccguguggggcuuccacuccgacaacgagacccagauggccaagcuguacggggauagcaagccccagaaguucacguccucggccaacggcgugaccacccacuacgucucccagaucggcggguuccccaaccagaccgaggacggcgggcugccgcagagcggccggaucgugguggauuacaugguccagaaguccgggaagacgggcaccaucaccuaccagcgcggcauccuccugccccagaagguguggugcgccucggggcgguccaaggugaucaagggcagccugccccucaucggggaggccgacugccugcacgagaaguacggcgggcugaacaagaguaagcccuacuacaccggcgagcacgcgaaggccaucggcaacugcccgaucugggucaagacgccccucaagcuggccaacgggaccaaguaccgcccgcccgccaagcugcucaaggagcggggcuucuucggggccaucgcgggcuuccuggagggcgggugggagggcaugaucgccggguggcauggcuacaccucccacggggcccacggcguggccgucgccgcggaccugaaguccacccaggaggccaucaacaagaucacgaagaaccucaacucccugagcgagcuggaggugaagaaccuccagcgccuguccggcgccauggacgagcugcauaacgagauccucgagcuggacgagaagguggacgaccugcgggccgacaccaucucgucccagaucgagcucgccguccugcugagcaacgaggggaucaucaacuccgaggacgagcaucuccuggcgcuggagcgcaagcucaagaagaugcugggccccucggccguggagaucgggaacggcugcuucgagaccaagcacaagugcaaccagaccugccuggaccggaucgccgccgggaccuucaaugcgggcgaguucucccuccccacguucgacagccugaacaucaccgccgccucccugaacgaggacggccucgacaaccacgccauccugcuguauuacucgaccgccgcguccagccuggccgugacccucaugaucgccaucuucgucguguacauggugucccgcgacaacgucagcugcuccaucugccuguga

SEQ ID NO: 14420 - RNA, 1758 nt, Artificial Sequence
  derived and/or modified CDS sequence (AUadapt) from InfluenzaB__AET10079__HA
augaaggccaucaucgugcugcucauggucgugaccaguaacgccgacggcaucugcaccgggaucacguccucgaacagcccccacguggucaagaccgcgacccagggcgaggugaacgugaccggggucaucccgcugacgaccacccccaccaagucgcacuuugccaaccugaagggcacggagacccgcgggaagcucugccccaagugccccaacugcaccgaccuggacguggcccugggccggccgaagugcaccggcaagauccccuccgcccgcgugagcauccuccacgagguccggcccgugacguccggguguuuccccaucaugcacgaccgcaccaagauccggcagcugccgaaccugcuccgcggcuacgagcacauccggcugucgacccacaacgugaucaacgccgagaaugcgcccgggggccccuacaagaucgggaccuccggcagcugccccaacgucacgaacggcaacggguucuucaccaccauggccugggccgugccgaagaacgacaagaauaagaccgccacgaacccccugaccaucgaggugcccuacaucugcaccgagggcgaggaccagaucaccgucuggggguuccacuccgacaacgagacgcagauggcgaagcucuacggcgacaguaagccccagaaguucaccuccagcgccaacggcgugaccacccacuacgugucccagaucgggggcuucccgaaccagacggaggacgggggccugccccagucggggcgcaucgucguggacuauauggugcagaaguccggcaagaccggcaccaucaccuaccagcgggggauccugcucccccagaaggucuggugcgccagcggccgcuccaaggugaucaaggggucgcugccccugaucggcgaggccgacugccuccacgagaaguacgggggccugaacaagagcaagccguauuacacgggcgagcacgccaaggcgaucgggaacugccccaucugggugaagacgccccugaagcucgccaacggcaccaaguaccggcccccggccaagcugcugaaggagcgcggguucuucggcgccaucgccggguuccucgagggcggcugggaggggaugaucgcgggcuggcacggguauaccucccacggcgcccacggcgucgccguggccgccgaccugaaguccacccaggaggcgaucaacaagaucaccaagaaccugaacucccucucggagcuggaggucgagaaccugcagcggcucuccggggccauggacgagcugcacaaugagauccuggagcucgacgagaagguggacgaccugcgcgccgacaccaucagcucccagaucgagcuggccgugcuccugucgaacgagggcaucaucaacuccgaggacgagcaccuccuggcccuggagcggaagcugaagaagaugcucgggcccagugcggucgagaucggcaacgggugcuucgagaccaagcacaagugcaaccagaccugccuggaccgcaucgccgccggcacguucgacgccggcgaguuuucccugcccaccuucgacucgcucaacaucaccgcggccucccugaacgacgacgggcuggacaaccacaccauccuccuguauuacagcacggccgccuccucgcuggccgugacccugaugaucgcgaucuucguggucuacauggugucccgggacaacgugagcugcuccaucugccucuga

SEQ ID NO: 14421 - RNA, 1758 nt, Artificial Sequence; identical to SEQ ID NO: 14348
  derived and/or modified CDS sequence (AUadapt) from InfluenzaB__AET10080__HA

SEQ ID NO: 14422 - RNA, 1758 nt, Artificial Sequence; identical to SEQ ID NO: 14348
  derived and/or modified CDS sequence (AUadapt) from InfluenzaB__AET10081__HA

SEQ ID NO: 14423 - RNA, 1758 nt, Artificial Sequence
  derived and/or modified CDS sequence (AUadapt) from InfluenzaB__AET10082__HA
augaaggccaucaucgugcugcucauggucgugaccaguaacgccgaccgcaucugcaccggcaucacguccucgaacagcccccacaucgugaagaccgcgacccagggggaggucaacgugaccggcgugaucccgcugacgaccacccccaccaagucgcacuucgccaaccugaaggggacggagacccggggcaagcucugccccaagugucugaacugcaccgaccuggacgucgcccucgggcgccccaagugcaccggcaagaucccguccgcccgggugucgauccugcacgaggugcgccccgucacguccggcugcuuccccaucaugcacgaccggaccaagauccgccagcugcccaaccuccugcggggguacgagcauauccgccugagcacccacaacgugaucaacgccgagaacgcgccgggcgggcccuacaagaucggcaccuccgggucgugccccaacaucacgaacggcaacggcuucuucgccaccauggccugggccgugcccaagaaugacaagaacaagaccgcgaccaacccgcucacgaucgagguccccuacaucugcaccgagggggaggaccagaucaccguguggggcuuccacuccgacaacgagacccagauggccaagcuguacggggacagcaagccccagaaguucacguccagugccaacggcgugaccacccacuacgucucccagaucggcggguuccccaaccagaccgaggacggcgggcugccgcagucgggccggaucgugguggacuacaugguccagaaguccgggaagacgggcaccaucaccuaccagcgcggcauccuccugccccagaagguguggugcgccagcgggcgguccaaggugaucaagggcucgcugccccucaucggggaggccgauugccugcacgagaaguacggcgggcugaacaagucgaagcccuacuacaccggcgagcacgcgaaggccaucggcaacugcccgaucugggucaagacgccccucaagcuggccaacgggaccaaguaccgcccgcccgccaagcugcucaaggagcggggcuucuuuggggccaucgcgggcuuccuggagggcgggugggagggcaugaucgccggguggcacggcuacaccucccacggggcccacggcguggccguggccgcggaccugaaguccacccaggaggccaucaacaagaucacgaagaaccucaacucccugagcgagcuggaggucaagaaccuccagcgccuguccggcgccauggacgagcugcacaacgagauccucgagcuggaugagaagguggacgaccugcgggccgacaccaucucgucccagaucgagcucgccguccugcugagcaacgaggggaucaucaacuccgaggacgagcaccuccuggcgcuggagcgcaagcucaagaagaugcugggccccucggccguggagaucgggaacggcugcuucgagaccaagcauaagugcaaccagaccugccuggaccggaucgccgccgggaccuucgacgcgggcgaguucucccuccccacguucgacucgcugaacaucaccgccgccucccugaacgacgauggccucgacaaccacaccauccugcuguacuacagcaccgccgccuccucgcuggcggugacgcucaugaucgccaucuucgucguguacauggugucccgcgacaacgucagcugcuccaucugccuguga

SEQ ID NO: 14424 - RNA, 1758 nt, Artificial Sequence
  derived and/or modified CDS sequence (AUadapt) from InfluenzaB__AET10083__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuuugccaaccugaaggggacggagacccggggcaagcucugccccaagugccugaacugcaccgaccuggacguggcccucgggcgccccaagugcaccggcaaggugccguccgcccgggucagcauccugcacgaggugcgccccgugacguccggcugcuuucccaucaugcacgaccggaccaagauccgccagcugcccaaccuccugcggggguacgagcacauccgccugucgacccacaacgucaucaacgccgagaacgcgccgggcgggcccuacaagaucggcaccuccgggaguugccccaacaucacgaacggcaacggcuucuucgccaccauggccugggccgugcccaagaacgacaagaacaagaccgcgaccaacccgcucacgaucgaggugcccuacaucuguaccgagggggaggaccagaucaccgucuggggcuuccacuccgacaacgagacccagauggccaagcuguacggggacucgaagccccagaaguucacguccagcgccaacggcgugaccacccauuacgugucccagaucggcggguuccccaaccagaccgaggacggcgggcugccgcagucgggccggaucgucguggacuacauggugcagaaguccgggaagacgggcaccaucaccuaccagcgcggcauccuccugccccagaaggucuggugcgccagcgggcgguccaaggugaucaagggcucgcugccccucaucggggaggccgauugccugcacgagaaguacggcgggcugaacaagagcaagcccuacuacaccggcgagcacgcgaaggccaucggcaacugcccgaucugggugaagacgccccucaagcuggccaacgggaccaaguaucgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagugagcuggaggucaagaaccuccagcgccuguccggcgccauggacgagcugcacaacgagauccucgagcuggacgagaagguggacgaccugcgggccgacaccaucagcucccagaucgagcucgccgugcugcugucgaacgaggggaucaucaauuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuuugacgcgggcgaguucucccuccccacguucgacucgcugaacaucaccgccgccucccugaacgacgacggccucgacaaccauaccauccugcuguacuacagcaccgccgccuccucgcuggcggugacgcucaugaucgccaucuucguggucuacauggugucccgcgacaacgugagcugcuccaucugccuguga

SEQ ID NO: 14425 - RNA, 1758 nt, Artificial Sequence; identical to SEQ ID NO: 14118
  derived and/or modified CDS sequence (AUadapt) from InfluenzaB__AET10084__HA

SEQ ID NO: 14426 - RNA, 1758 nt, Artificial Sequence; identical to SEQ ID NO: 14348
  derived and/or modified CDS sequence (AUadapt) from InfluenzaB__AET10085__HA

SEQ ID NO: 14427 - RNA, 1758 nt, Artificial Sequence; identical to SEQ ID NO: 14388
  derived and/or modified CDS sequence (AUadapt) from InfluenzaB__AET43124__HA

SEQ ID NO: 14428 - RNA, 1758 nt, Artificial Sequence; identical to SEQ ID NO: 14388
  derived and/or modified CDS sequence (AUadapt) from InfluenzaB__AET43135__HA

SEQ ID NO: 14429 - RNA, 1758 nt, Artificial Sequence; identical to SEQ ID NO: 14388
  derived and/or modified CDS sequence (AUadapt) from InfluenzaB__AET43146__HA

SEQ ID NO: 14430 - RNA, 1758 nt, Artificial Sequence; identical to SEQ ID NO: 14388
  derived and/or modified CDS sequence (AUadapt) from InfluenzaB__AET43157__HA

SEQ ID NO: 14431 - RNA, 1758 nt, Artificial Sequence
  derived and/or modified CDS sequence (AUadapt) from InfluenzaB__AET43168__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugucccaagugccugaacugcaccgaccuggacgugacccucgggcgccccaagugcacgggcaagaucccguccgcccgggugagcauccugcacgagguccgccccgugaccuccggcugcuuccccaucaugcacgaccggaccaagauccgccagcugcccaaucuccugcggggguacgagcacauccgccugucgacccacaacgugaucaacgccgagaacgccccgggcgggcccuacaagaucggcacguccgggagcugccccaacgucaccaacggcaauggcuucuucgcgaccauggccugggccgugcccaagaacgacaagaacaagaccgccacgaacccgcucaccaucgaggugcccuacaucugcaccgagggggaggaccagaucaccgucuggggcuuccacuccgacaaugagacgcagauggcgaagcuguacggggacucgaagccccagaaguucaccuccucggccaacggcgugaccacccacuacgugucccagaucggcggguuccccaaccagacggaggacggcgggcugccgcagagcggccggaucgucguggauuacauggugcagaaguccgggaagaccggcaccaucaccuaccagcgcggcauccuccugccccagaaggucuggugcgccucggggcgguccaaggugaucaagggcagccugccccucaucggggaggccgacugccugcacgagaaguacggcgggcugaacaagucgaagcccuacuauacgggcgagcacgccaaggcgaucggcaacugcccgaucugggugaagacgccccucaagcuggccaacgggaccaaguaccgcccgcccgccaagcugcucaaggagcggggcuucuucggggccaucgccggcuuccuggagggcgggugggagggcaugaucgcgggguggcacggcuacaccucccacggggcccacggcgucgccguggccgccgaucugaaguccacccaggaggcgaucaacaagaucaccaagaaccucaacucccugagcgagcuggaggucaagaaccuccagcgccuguccggcgccauggacgagcugcacaacgagauccucgagcuggacgagaagguggacgaccugcgggccgacaccaucaguucccagaucgagcucgccgugcugcugucgaacgaggggaucaucaacuccgaggacgagcaccuccuggcccuggagcgcaagcucaagaagaugcugggccccagcgcggucgagaucgggaacggcugcuucgagaccaagcacaagugcaaccagaccugucuggaccggaucgccgccgggacguucgacgccggcgaguucucccuccccaccuucgacucgcugaacaucaccgcggccucccugaacgacgacggccucgacaaucacaccauccugcuguacuacagcacggccgccuccucgcuggccgugacccucaugaucgcgaucuucguggucuacauggugucccgcgacaacgugagcugcuccaucugccuguga

SEQ ID NO: 14432 - RNA, 1758 nt, Artificial Sequence; identical to SEQ ID NO: 14388
  derived and/or modified CDS sequence (AUadapt) from InfluenzaB__AET43179__HA

SEQ ID NO: 14433 - RNA, 1758 nt, Artificial Sequence; identical to SEQ ID NO: 14388
  derived and/or modified CDS sequence (AUadapt) from InfluenzaB__AET43190__HA

SEQ ID NO: 14434 - RNA, 1758 nt, Artificial Sequence
  derived and/or modified CDS sequence (AUadapt) from InfluenzaB__AET43201__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccacuuugccaaccugaaggggacggagacccggggcaagcucugccccaagugccugaacugcaccgaccuggacguggcccucgggcgccccaagugcaccggcaagaucccguccgcccgggugucgauccugcacgagguccgccccgugacguccggcuguuuccccaucaugcacgaccggaccaagauccgccagcugcccaaccuccugcggggguacgagcacauccgccugagcacccacaacgugaucaacgccggcaaugcgcccgggggccccuacaagaucgggaccuccggcucgugccccaacgucacgaacggcaacggguucuucgccaccauggccugggccgugcccaagaacgacaagaauaagaccgcgaccaacccgcucacgaucgaggugcccuacaucugcaccgagggcgaggaccagaucaccgucuggggguuccacuccgacaacgagacccagauggccaagcuguacggcgacaguaagccccagaaguucacguccucggccaacggcgugaccacccacuacgugucccagaucgggggcuuccccaaccagaccgaggacgggggccugccgcagagcgggcggaucgucguggacuauauggugcagaaguccggcaagacgggcaccaucaccuaccagcgcgggauccuccugccccagaaggucuggugcgccucgggccgguccaaggugaucaaggggagccugccccucaucggcgaggccgacugccugcacgagaaguacgggggccugaacaagucgaagcccuauuacaccggcgagcacgcgaaggccaucgggaacugcccgaucugggugaagacgccccucaagcuggccaacggcaccaaguaccgcccgcccgccaagcugcucaaggagcggggguucuucggcgccaucgcgggguuccuggagggcggcugggaggggaugaucgccggcuggcacggguauaccucccacggcgcccacggcgucgccguggccgcggaccugaaguccacccaggaggccaucaacaagaucacgaagaaccucaacucccugagcgagcuggaggucaagaaccuccagcgccuguccggggccauggacgagcugcacaaugagauccucgagcuggacgagaagguggacgaccugcgggccgacaccaucucgucccagaucgagcucgccgugcugcugagcaacgagggcaucaucaacuccgaggacgagcaccuccuggcgcuggagcgcaagcucaagaagaugcuggggccgagugccgucgagaucggcaacgggugcuucgagaccaagcacaagugcaaccagaccugccuggaccggaucgccgccggcaccuucgacgcgggcgaguuuucccuccccacguucgacagccugaacaucaccgccgccucccugaacgacgacgggcucgacaaccacaccauccugcuguauuacucgaccgccgccuccagccuggcggugacgcucaugaucgccaucuucguggucuacauggugucccgcgacaacgugagcugcuccaucugccuguga

SEQ ID NO: 14435 - RNA, 1758 nt, Artificial Sequence; identical to SEQ ID NO: 14388
  derived and/or modified CDS sequence (AUadapt) from InfluenzaB__AET43212__HA

SEQ ID NO: 14436 - RNA, 1758 nt, Artificial Sequence; identical to SEQ ID NO: 14388
  derived and/or modified CDS sequence (AUadapt) from InfluenzaB__AET43223__HA

SEQ ID NO: 14437 - RNA, 1758 nt, Artificial Sequence; identical to SEQ ID NO: 14434
  derived and/or modified CDS sequence (AUadapt) from InfluenzaB__AET50943__HA

SEQ ID NO: 14438 - RNA, 1758 nt, Artificial Sequence; identical to SEQ ID NO: 14388
  derived and/or modified CDS sequence (AUadapt) from InfluenzaB__AET50954__HA

SEQ ID NO: 14439 - RNA, 1758 nt, Artificial Sequence; identical to SEQ ID NO: 14388
  derived and/or modified CDS sequence (AUadapt) from InfluenzaB__AET50965__HA

SEQ ID NO: 14440 - RNA, 1758 nt, Artificial Sequence; identical to SEQ ID NO: 14388
  derived and/or modified CDS sequence (AUadapt) from InfluenzaB__AET50976__HA

SEQ ID NO: 14441 - RNA, 1758 nt, Artificial Sequence; identical to SEQ ID NO: 14388
  derived and/or modified CDS sequence (AUadapt) from InfluenzaB__AET74255__HA

SEQ ID NO: 14442 - RNA, 1758 nt, Artificial Sequence; identical to SEQ ID NO: 14434
  derived and/or modified CDS sequence (AUadapt) from InfluenzaB__AET74277__HA

SEQ ID NO: 14443 - RNA, 1758 nt, Artificial Sequence; identical to SEQ ID NO: 14388
  derived and/or modified CDS sequence (AUadapt) from InfluenzaB__AET74288__HA

SEQ ID NO: 14444 - RNA, 1758 nt, Artificial Sequence
  derived and/or modified CDS sequence (AUadapt) from InfluenzaB__AET74299__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugucccaagugccugaacugcaccgaccuggacgugacccucgggcgccccaagugcacgggcaagaucccguccgcccgggugagcauccugcacgagguccgccccgugaccuccggcugcuuccccaucaugcacgaccggaccaagauccgccagcugcccaaucuccugcggggguacgagcacauccgccugucgacccacaacgugaucaacgccgagaacgccccgggcgggcccuacaagaucggcacguccgggagcugccccaacgucaccaacggcaauggcuucuucgcgaccauggccugggccgugcccaagaacgacaagaacaagaccgccacgaacccgcucaccaucgaggugcccuacaucugcaccgagggggaggaccagaucaccgucuggggcuuccacuccgacaaugagacgcagauggcgaagcuguacggggacucgaagccccagaaguucaccuccucggccaacggcgugaccacccacuacgugucccagaucggcggguuccccaaccagacggaggacggcgggcugccgcagagcggccggaucgucguggauuacauggugcagaaguccgggaagaccggcaccaucaccuaccagcgcggcauccuccugccccagaaggucuggugcgccucggggcgguccaaggugaucaagggcagccugccccucaucggggaggccgacugccugcacgagaaguacggcgggcugaacaagucgaagcccuacuauacgggcgagcacgccaaggcgaucggcaacugcccgaucugggugaagacgccccucaagcuggccaacgggaccaaguaccgcccgcccgccaagcugcucaaggagcggggcuucuucggggccaucgccggcuuccuggagggcgggugggagggcaugaucgcgggguggcacggcuacaccucccacggggcccacggcgucgccguggccgccgaucugaaguccacccaggaggcgaucaacaagaucaccaacaaccucaacucccugagcgagcuggaggucaagaaccuccagcgccuguccggcgccauggacgagcugcacaacgagauccucgagcuggacgagaagguggacgaccugcgggccgauaccaucucgucccagaucgagcucgccgugcugcugucgaacgaggggaucaucaacuccgaggacgagcaccuccuggcccuggagcgcaagcucaagaagaugcugggccccagcgcggucgagaucgggaacggcugcuucgagaccaagcacaagugcaaucagaccugccuggaccggaucgccgccgggacguucgacgccggcgaguucucccuccccaccuucgacucgcugaacaucaccgcggccucccugaacgacgacggccucgauaaccacaccauccugcuguacuacagcacggccgccuccucgcuggccgugacccucaugaucgcgaucuucguggucuacauggugucccgcgacaacgugagcugcuccaucugccuguga

SEQ ID NO: 14445 - RNA, 1758 nt, Artificial Sequence; identical to SEQ ID NO: 14388
  derived and/or modified CDS sequence (AUadapt) from InfluenzaB__AET74329__HA

SEQ ID NO: 14446 - RNA, 1758 nt, Artificial Sequence; identical to SEQ ID NO: 14388
  derived and/or modified CDS sequence (AUadapt) from InfluenzaB__AET74340__HA

SEQ ID NO: 14447 - RNA, 1758 nt, Artificial Sequence; identical to SEQ ID NO: 14388
  derived and/or modified CDS sequence (AUadapt) from InfluenzaB__AET74351__HA

SEQ ID NO: 14448 - RNA, 1758 nt, Artificial Sequence; identical to SEQ ID NO: 14118
  derived and/or modified CDS sequence (AUadapt) from InfluenzaB__AEY69077__HA

SEQ ID NO: 14449 - RNA, 1758 nt, Artificial Sequence; identical to SEQ ID NO: 14118
  derived and/or modified CDS sequence (AUadapt) from InfluenzaB__AFB77676__HA

SEQ ID NO: 14450 - RNA, 1758 nt, Artificial Sequence
  derived and/or modified CDS sequence (AUadapt) from InfluenzaB__AFB77677__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugucccaagugcuucaacugcaccgaccuggacguggcccuggggcgccccaagugcaccggcaagaucccguccgcccgggugagcauccuccacgagguccgccccgugacguccggcugcuuccccaucaugcacgaucggaccaagauccgccagcugcccaaccugcuccggggguacgagcacauccgccugucgacccacaacgugaucaacgccgagaacgcgccgggcgggcccuacaagaucggcaccuccgggagcugccccaacgucacgaauggcaacggcuucuucgccaccauggccugggccgugcccaagaacgacaagaacaagaccgcgaccaacccgcugacgaucgaggugcccuacaucugcaccgagggggaggaccagaucaccgucuggggcuuccacuccgauaacgagacccagauggccaagcucuacggggacucgaagccccagaaguucacguccagcgccaacggcgugaccacccacuacgugucccagaucggcggguuccccaaccagaccgaggacggcgggcugccgcagaguggccggaucgucguggacuacauggugcagaaguccgggaagacgggcaccaucaccuaccagcgcggcauccugcucccccagaaggucuggugcgccagcgggcgguccaaggugaucaagggcucgcugccccugaucggggaggccgacugccuccacgagaaguacggcgggcugaacaagagcaagcccuauuacaccggcgagcacgcgaaggccaucggcaacugcccgaucugggugaagacgccccugaagcucgccaacgggaccaaguaccgcccgcccgccaagcugcugaaggagcggggcuucuucggggccaucgcgggcuuccucgagggcgggugggagggcaugaucgccggguggcacggcuacaccucccacggggcccauggcgucgccguggccgcggaccugaaguccacccaggaggccaucaacaagaucacgaagaaccugaacucccucucggagcuggaggucaagaaccugcagcgccucuccggcgccauggacgagcugcacaacgagauccuggagcucgacgagaagguggacgaccugcgggccgauaccaucagcucccagaucgagcuggccgugcuccugucgaacgaggggaucaucaacuccgaggacgagcaccuccuggcgcuggagcgcaagcugaagaagaugcucggccccagcgccgucgagaucgggaacggcugcuucgagaccaagcacaagugcaaucagaccugccuggaccggaucgccgccgggaccuucgacgcgggcgaguucucccugcccacguucgacucgcucaacaucaccgccgccucccugaacgacgacggccuggauaaccacaccauccuccuguacuacagcaccgccgccuccucgcuggcggugacgcugaugaucgccaucuucguggucuacauggugucccgcgacaacgugagcugcuccaucugccucuga

SEQ ID NO: 14451 - RNA, 1758 nt, Artificial Sequence; identical to SEQ ID NO: 14118
  derived and/or modified CDS sequence (AUadapt) from InfluenzaB__AFB77678__HA

SEQ ID NO: 14452 - RNA, 1758 nt, Artificial Sequence; identical to SEQ ID NO: 14118
  derived and/or modified CDS sequence (AUadapt) from InfluenzaB__AFB77679__HA

SEQ ID NO: 14453 - RNA, 1758 nt, Artificial Sequence
  derived and/or modified CDS sequence (AUadapt) from InfluenzaB__AFB77680__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugucccaagugccugaacugcaccgaccuggacguggcccucgggcgccccaagugcaccggcaagaucccguccgcccgggugagcauccugcacgagguccgccccaucacguccggcugcuuccccaucaugcacgaccggaccaagauccgccagcugcccaaucuccugcggggguacgagcacauccgccugucgacccacaacgugaucaacgccgagaacgcgccgggcgggcccuacaagaucggcaccuccgggagcugccccaacgugacgaacggcaauggcuucuucgccaccauggccugggccguccccaagaacgacaagaacaagaccgcgaccaacccgcucacgaucgaggugcccuacaucugcaccgagggggaggaccagaucaccguguggggcuuccacuccgacaaugagacccagauggccaagcuguacggggacucgaagccccagaaguucacguccucggccaacggcgucaccacccacuacgugucccagaucggcggguuccccaaccagaccgaggacggcgggcugccgcagagcggccggaucguggucgauuacauggugcagaaguccgggaagacgggcaccaucaccuaccagcgcggcauccuccugccccagaagguguggugcgccucggggcgguccaaggucaucaagggcagccugccccucaucggggaggccgacugccugcacgagaaguacggcgggcugaacaagucgaagcccuacuauaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcguggccgucgccgcggaucugaaguccacccaggaggccaucaacaagaucacgaagaaccucaacucccugagcgagcuggaggugaagaaccuccagcgccuguccggcgccauggacgagcugcacaacgagauccucgagcuggacgagaaggucgacgaccugcgggccgacaccaucaguucccagaucgagcucgccgugcugcugucgaacgaggggaucaucaacuccgaggacgagcaccuccuggcgcuggagcgcaagcucaagaagaugcugggccccagcgccguggagaucgggaacggcugcuucgagaccaagcacaagugcaaccagaccugucuggaccggaucgccgccgggaccuucgacgcgggcgaguucucccuccccacguucgacucgcugaacaucaccgccgccucccugaacgacgacggccucgacaaucacaccauccugcuguacuacagcaccgccgccuccucgcuggcggucacgcucaugaucgccaucuucgugguguacauggucucccgcgacaacgugagcugcuccaucugccuguga

SEQ ID NO: 14454 - RNA, 1758 nt, Artificial Sequence; identical to SEQ ID NO: 14118
  derived and/or modified CDS sequence (AUadapt) from InfluenzaB__AFB77681__HA

SEQ ID NO: 14455 - RNA, 1758 nt, Artificial Sequence
  derived and/or modified CDS sequence (AUadapt) from InfluenzaB__AFB77682__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuuugccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuucccaucaugcacgaccggaccaagauccgccagcugcccaaccuccugcggggguacgagcacauccgccugucgacccacaacgugaucaacgccgagaacgcgccgggcgggcccuacaagaucggcaccuccgggaguugccccaacaucacgaacggcaacggcuucuucgccaccauggccugggccguccccaagaacgacaagaacaagaccgcgaccaacccgcucacgaucgaggugcccuacaucuguaccgagggggaggaccagaucaccguguggggcuuccacuccgacaacgagacccagauggccaagcuguacggggacucgaagccccagaaguucacguccagcgccaacggcgucaccacccauuacgugucccagaucggcggguuccccaaccagaccgaggacggcgggcugccgcagucgggccggaucguggucgacuacauggugcagaaguccgggaagacgggcaccaucaccuaccagcgcggcauccuccugccccagaagguguggugcgccagcgggcgguccaaggucaucaagggcucgcugccccucaucggggaggccgauugccugcacgagaaguacggcgggcugaacaagagcaagcccuacuacaccggcgagcacgcgaaggccaucggcaacugcccgaucugggugaagacgccccucaagcuggccaacgggaccaaguaucgcccgcccgccaagcugcucaaggagcggggcuucuucggggccaucgcgggcuuccuggagggcgggugggagggcaugaucgccggguggcacggcuacaccucccacggggcccacggcguggccgucgccgcggaccugaaguccacccaggaggccaucaacaagaucacgcagaaccucaacucccugagugagcuggaggugaagaaccuccagcgccuguccggcgccauggacgagcugcacaacgagauccucgagcuggacgagaaggucgacgaccugcgggccgacaccaucagcucccagaucgagcucgccgugcugcugucgaacgaggggaucaucaauuccgaggacgagcaccuccuggcgcuggagcgcaagcucaagaagaugcugggccccagcgccguggagaucgggaacggcugcuucgagaccaagcacaagugcaaccagaccugccuggaccggaucgccgccgggaccuuugacgcgggcgaguucucccuccccacguucgacucgcugaacaucaccgccgccucccugaacgacgacggccucgacaaccauaccauccugcuguacuacagcaccgccgccuccucgcuggcggucacgcucaugaucgccaucuucgugguguacauggucucccgcgacaacgugagcugcuccaucugccuguga

SEQ ID NO: 14456 - RNA, 1758 nt, Artificial Sequence; identical to SEQ ID NO: 14118
  derived and/or modified CDS sequence (AUadapt) from InfluenzaB__AFB77683__HA

SEQ ID NO: 14457 - RNA, 1758 nt, Artificial Sequence; identical to SEQ ID NO: 14118
  derived and/or modified CDS sequence (AUadapt) from InfluenzaB__AFB77684__HA

SEQ ID NO: 14458 - RNA, 1758 nt, Artificial Sequence
  derived and/or modified CDS sequence (AUadapt) from InfluenzaB__AFB77685__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugccccaagugucugaacugcaccgaccuggacguggcccucgggcgccccaagugcaccggcaagacgccguccgcccgggugucgauccugcacgagguccgccccgugaccuccggcugcuuccccaucaugcacgaccggaccaagauccgccagcugcccaaccuccugcggggguacgagcauauccgccugagcacccacaacgugaucaacgccgagaacgcgccgggcgggcccuacaagaucggcacguccgggucgugccccaacaucaccaacggcaacggcuucuucgccaccauggccugggccguccccaagaaugacaagaacaagaccgcgacgaacccgcucaccaucgaggugcccuacaucugcaccgagggggaggaccagaucaccguguggggcuuccacuccgacaacgagacgcagauggccaagcuguacggggacucgaagccccagaaguucaccuccagugccaacggcgucaccacccacuacaucucccagaucggcggguuccccaaccagacggaggacggcgggcugccgcagucgggccggaucgugguggacuacaugguccagaaguccgagaagaccgggaccaucaccuaccagcgcggcauccuccugccccagaagguguggugcgccucgggccgguccaaggugaucaaggggagccugccccucaucggcgaggccgauugccugcacgagaaguacgggggccugaacaagucgaagcccuacuacacgggggagcacgcgaaggccaucggcaacugcccgaucugggucaagacgccccucaagcuggccaacggcaccaaguaccgcccgcccgccaagcugcucaaggagcggggguucuuuggcgccaucgcgggguuccuggagggcgggugggagggcaugaucgccggcuggcacggguacaccucccacggcgcccacgggguggccguggccgcggaccugaaguccacccaggaggccaucaacaagaucaccaagaaccucaacucccugucggagcuggaggucaagaaccuccagcgccuguccggcgccauggacgagcugcacaacgagauccucgagcuggaugagaagguggacgaccugcgggccgacaccaucagcucccagaucgagcucgccguccugcugucgaacgagggcaucaucaacuccgaggacgagcaccuccuggcgcuggagcgcaagcucaagaagaugcuggggcccucggccguggagaucggcaacgggugcuucgagaccaagcauaagugcaaccagaccugccuggaccggaucgccgccggcacguucgacgcgggggaguucucccuccccaccuucgacagccugaacaucaccgccgccucccugaacgacgauggccucgacaaccacaccauccugcuguacuacucgacggccgccuccucgcuggcggugacccucaugaucgccaucuucgucguguacauggugucccgcgacaacgucagcugcuccaucugccuguga

SEQ ID NO: 14459 - RNA, 1758 nt, Artificial Sequence
  derived and/or modified CDS sequence (AUadapt) from InfluenzaB__AFB77686__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugucccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaucuccugcggggguacgagcacauccgccugucgacccacaacgugaucaacgccgagaacgcgccgggcgggcccuacaagaucggcaccuccgggagcugccccaacaucacgaacggcaauggcuucuucgccaccauggccugggccguccccaagaacgacaagaacaagaccgcgaccaacccgcucacgaucgaggugcccuacaucugcaccgagggggaggaccagaucaccguguggggcuuccacuccgacaaugagacccagauggccaagcuguacggggacucgaagccccagaaguucacguccagcgccaacggcgucaccacccacuacgugucccagaucucgggcuuccccaaccagaccgaggacgggggccugccgcaguccgggcggaucguggucgauuacauggugcagaaguccggcaagacggggaccaucaccuaccagcgcggcauccuccugccccagaagguguggugcgccuccggccggagcaaggucaucaaggggucgcugccccucaucggcgaggccgacugccugcacgagaaguacgggggccugaacaaguccaagcccuacuacaccggggagcaugcgaaggccaucggcaacugcccgaucugggugaagacgccccucaagcuggccaacggcaccaaguaccgcccgcccgccaagcugcucaaggagcggggguucuucggcgccaucgcgggguuccuggagggcgggugggagggcaugaucgccggcuggcacggguacaccucgcacggcgcccacgggguggccgucgccgcggaucugaaguccacccaggaggccaucaacaagaucacgcagaaccucaacagccuguccgagcuggaggugaagaaccuccagcgccugucgggcgccauggacgagcugcacaacgagauccucgagcuggacgagaaggucgacgaccugcgggccgauaccaucuccagccagaucgagcucgccgugcugcuguccaacgagggcaucaucaacucggaggacgagcaccuccuggcgcuggagcgcaagcucaagaagaugcuggggcccuccgccguggagaucggcaacgggugcuucgagaccaagcacaagugcaaccagaccugucuggaccggaucgccgccggcaccuucgacgcgggggaguucagccuccccacguucgacucccugaacaucaccgccgccucgcugaacgacgacggccucgauaaccacaccauccugcuguacuacuccaccgccgccagcucccuggcggucacgcucaugaucgccaucuucgugguguacauggucucgcgcgacaacguguccugcagcaucugccuguga

SEQ ID NO: 14460 - RNA, 1758 nt, Artificial Sequence
  derived and/or modified CDS sequence (AUadapt) from InfluenzaB__AFB77687__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugccccaagugucugaacugcaccgaccuggacguggcccucgggcgccccaagugcaccggcaagaucccguccgcccgggugucgauccugcacgagguccgccccgugacguccggcugcuuccccaucaugcacgaccggaccaagauccgccagcugcccaaccuccugcggggguacgagcauaucaagcugagcacccacaacgugaucaacgccgagaacgcgccgggcgggcccuacaagaucggcaccuccgggucgugccccaacgucacgaacggcaacggcuucuucgccaccauggccugggccgugcccaagaaugacaagaacaagaccgcgaccaacccgcucacgaucgaggugcccuacaucugcaccgagggggaggaccagaucaccgucuggggcuuccacuccgacaacgagacccagauggccaagcuguacggggacagcaagccccagaaguucacguccagugccaacggcgugaccacccacuacgugucccagaucggcggguuccccaaccagaccgaggacggcgggcugccgcagucgggccgcaucgucguggacuacauggugcagaaguccgggaagacgggcaccaucaccuaccagcggggcauccuccugccccagaaggucuggugcgccagcgggcgcuccaaggugaucaagggcucgcugccccucaucggggaggccgauugccugcacgagaaguacggcgggcugaacaagucgaagcccuacuacaccggcgagcacgcgaaggccaucggcaacugcccgaucugggugaagacgccccucaagcuggccaacgggaccaaguaccggccgcccgccaagcugcucaaggagcgcggcuucuuuggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagcgagcuggaggucaagaaccuccagcggcuguccggcgccauggacgagcugcacaacgagauccucgagcuggaugagaagguggacgaccugcgcgccgacaccaucucgucccagaucgagcucgccgugcugcugagcaacgaggggaucaucaacuccgaggacgagcaccuccuggcgcuggagcggaagcucaagaagaugcugggccccucggccgucgagaucgggaacggcugcuucgagaccaagcauaagugcaaccagaccugccuggaccgcaucgccgccgggaccuucgacgcgggcgaguucucccuccccacguucgacucgcugaacaucaccgccgccucccugaacgacgauggccucgacaaccacaccauccugcuguacuacagcaccgccgccuccucgcuggcggugacgcucaugaucgccaucuucguggucuacauggugucccgggacaacgugagcugcuccaucugccuguga

SEQ ID NO: 14461 - RNA, 1758 nt, Artificial Sequence
  derived and/or modified CDS sequence (AUadapt) from InfluenzaB__AFB77688__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccacuuugccaaccugaaggggacggagacccggggcaagcucugccccaagugccugaacugcaccgaccuggacguggcccucgggcgccccaagugcaccggcaagaucccguccgcccgggugucgauccugcacgagguccgccccgugacguccggcuguuuccccaucaugcacgaccggaccaagauccgccagcugcccaaccuccugcggggguacgagcacauccgccugagcacccacaacgugaucaacgccgagaaugcgccgggcgggcccuacaagaucggcaccuccgggucgugccccaacgucacgaacggcaacggcuucuucgccaccauggccugggccgugcccaagaacgacaagaauaagaccgcgaccaacccgcucacgaucgaggugcccuacaucugcaccgagggggaggaccagaucaccgucuggggcuuccacuccgacaacgagacccagauggccaagcuguacggggacaguaagccccagaaguucacguccucggccaacggcgugaccacccacuacgugucccagaucggcggguuccccaaccagaccgaggacggcgggcugccgcagagcggccggaucgucguggacuauauggugcagaaguccgggaagacgggcaccaucaccuaccagcgcggcauccuccugccccagaaggucuggugcgccucggggcgguccaaggugaucaagggcagccugccccucaucggggaggccgacugccugcacgagaaguacggcgggcugaacaagucgaagcccuauuacaccggcgagcacgcgaaggccaucggcaacugcccgaucugggugaaggcgccccucaagcuggccaacgggacgaaguaccgcccgcccgccaagcugcucaaggagcggggcuucuucggggccaucgccggcuuccuggagggcgggugggagggcaugaucgccggguggcacggcuauaccucccacggggcccacggcgucgccguggcggccgaccugaaguccacccaggaggccaucaacaagaucaccaagaaccucaacucccugagcgagcuggaggucaagaaccuccagcgccuguccggcgccauggacgagcugcacaaugagauccucgagcuggacgagaagguggacgaccugcgggccgacacgaucucgucccagaucgagcucgcggugcugcugagcaacgaggggaucaucaacuccgaggacgagcaccuccuggcccuggagcgcaagcucaagaagaugcugggccccagugccgucgagaucgggaacggcugcuucgagaccaagcacaagugcaaccagaccugccuggaccggaucgccgcggggaccuucgacgccggcgaguuuucccuccccaccuucgacagccugaacaucacggccgccucccugaacgacgacggccucgacaaccacaccauccugcuguauuacucgaccgccgcguccagccuggccgugacccucaugaucgccaucuucguggucuacauggugucccgcgacaacgugagcugcuccaucugccuguga

SEQ ID NO: 14462 - RNA, 1758 nt, Artificial Sequence; identical to SEQ ID NO: 14118
  derived and/or modified CDS sequence (AUadapt) from InfluenzaB__AFB77689__HA

SEQ ID NO: 14463 - RNA, 1758 nt, Artificial Sequence; identical to SEQ ID NO: 14118
  derived and/or modified CDS sequence (AUadapt) from InfluenzaB__AFB77690__HA

SEQ ID NO: 14464 - RNA, 1758 nt, Artificial Sequence; identical to SEQ ID NO: 14423
  derived and/or modified CDS sequence (AUadapt) from InfluenzaB__AFE00360__HA

SEQ ID NO: 14465 - RNA, 1758 nt, Artificial Sequence; identical to SEQ ID NO: 14423
  derived and/or modified CDS sequence (AUadapt) from InfluenzaB__AFF18534__HA

SEQ ID NO: 14466 - RNA, 1758 nt, Artificial Sequence; identical to SEQ ID NO: 14423
  derived and/or modified CDS sequence (AUadapt) from InfluenzaB__AFF18543__HA

SEQ ID NO: 14467 - RNA, 1758 nt, Artificial Sequence; identical to SEQ ID NO: 14118
  derived and/or modified CDS sequence (AUadapt) from InfluenzaB__AFG48978__HA

SEQ ID NO: 14468 - RNA, 1758 nt, Artificial Sequence; identical to SEQ ID NO: 14118
  derived and/or modified CDS sequence (AUadapt) from InfluenzaB__AFG48997__HA

SEQ ID NO: 14469 - RNA, 1758 nt, Artificial Sequence
  derived and/or modified CDS sequence (AUadapt) from InfluenzaB__AFG48998__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuuugccaaccugaaggggacggagacccggggcaagcucugccccaagugccccaacugcaccgaccuggacguggcccuggggcgcccgaagugcaccggcaagauccccuccgcccgggugagcauccuccacgagguccgccccgugacguccggcugcuuucccaucaugcacgaccggaccaagauccgccagcugccgaaccugcuccggggguacgagcacauccgccugucgacccacaacgugaucaacgccgagaacgcgcccggcgggcccuacaagaucggcaccuccgggaguugccccaacgucacgaacggcaacggcuucuucgagaccauggccugggccgugccgaagaacgacaagaacaagaccgccaccaacccccugacgaucgaggugcccuacaucuguaccgagggggaggaccagaucaccgucuggggcuuccacuccgacaacgagacccagauggcgaagcucuacggggacucgaagccccagaaguucacguccucggccaacggcgugaccacccauuacgugucccagaucggcggguucccgaaccagaccgaggacggcgggcugccccagagcggccggaucgucguggacuacauggugcagaaguccgggaagacgggcaccaucaccuaccagcgcggcauccugcucccccagaaggucuggugcgccucggggcgguccaaggugaucaagggcagccugccccugaucggggaggccgauugccuccacgagaaguacggcgggcugaacaagucgaagccguacuacaccggcgagcacgccaaggcgaucggcaacugccccaucugggugaagacgccccugaagcucgccaacgggaccaaguaucggcccccggccaagcugcugaaggagcgcggcuucuucggggccaucgccggcuuccucgagggcgggugggagggcaugaucgcgggguggcacggcuacaccucccacggggcccacggcgucgccguggccgccgaccugaaguccacccaggaggcgaucaacaagaucacgaagaaccugaacucccucagugagcuggaggucaagaaccugcagcgccucuccggcgccauggacgagcugcacaacgagauccuggagcucgacgagaagguggacgaccugcgggccgacaccaucucgucccagaucgagcuggccgugcuccugucgaacgaggggaucaucaauuccgaggacgagcaccuccuggcccuggagcgcaagcugaagaagaugcucggccccagcgcggucgagaucgggaacggcugcuucgagaccaagcacaagugcaaccagaccugccuggaccggaucgccgccgggaccuuugacgccggcgaguucucccugcccacguucgacucgcucaacaucaccgcggccucccugaacgacgacggccuggacaaccauaccauccuccuguacuacagcaccgccgccuccucgcuggccgugacgcugaugaucgcgaucuucguggucuacauggugucccgcgacaacgugagcugcuccaucugccucuga

SEQ ID NO: 14470 - RNA, 1755 nt, Artificial Sequence
  derived and/or modified CDS sequence (AUadapt) from InfluenzaB__AFG49012__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuacuucgccaaucugaaggggacgaagacccggggcaagcucugccccgacugccugaacugcaccgaccuggacguggcccucgggcgccccaugugcgugggcaccacgccguccgccaaggccucgauccugcacgagguccggcccgugaccuccggcuguuuccccaucaugcacgaccgcaccaagauccggcagcugcccaaccuccugcgcggguacgagaacauccggcugagcacccagaacgugaucgacgcggagaaggccccgggcgggcccuaccgccucggcacguccgggaguugccccaacgccaccuccaagaucggcuucuucgccaccauggcgugggccguccccaaggacaacuacaagaacgccaccaacccgcugacgguggaggugcccuacaucuguaccgagggcgaggaccagaucaccgucuggggguuccacucggacaacaagacccagaugaagaaccuguacggcgacuccaacccccagaaguucacgaguuccgccaacggggugaccacccacuacgugagccagaucggcgacuuccccgaccagaccgaggacggcgggcucccgcaguccggccggaucgucguggacuacaugaugcagaagcccgggaagacgggcaccaucguguaucagcgcgggguccugcugccccagaagguguggugcgccucgggccgguccaaggugaucaagggcagccucccccugaucggggaggcggacugccugcacgagaaguacggcgggcucaacaagagcaagccguacuauaccggcgagcacgccaaggccaucgggaacugccccaucugggucaagacgccccugaagcuggccaacggcaccaaguaccggcccccggccaagcuccugaaggagcgcggcuucuucggggcgaucgccuccuuccuggagggcgggugggagggcaugaucgccggguggcacggcuacaccagucacggcgcccacgggguggccgucgcggccgaccucaaguccacccaggaggccaucaacaagaucaccaagaaccugaacagccuguccgagcucgaggugaagaaccugcagcgccugagcggcgccauggacgagcuccacaaugagauccuggagcuggacgagaagguggacgaccuccgggccgacacgaucuccucgcagaucgagcuggcgguccugcucuccaacgaggggaucaucaacagcgaggacgagcaccuccuggcccuggagcgcaagcugaagaagaugcugggccccuccgccguggauaucggcaacgggugcuucgagaccaagcacaagugcaaccagaccugccucgaccggaucgccgcgggcaccuucaacgccggggaguuuagccugcccaccuucgacucccugaacaucacggccgccucgcucaacgacgacggccuggacaaccauaccauccugcuguacuacuccaccgccgcgagcucccucgccgugacccugaugcuggccaucuucaucgucuacauggugagccgcgacaacguguccugcagcaucugccucuga

SEQ ID NO: 14471 - RNA, 1755 nt, Artificial Sequence
  derived and/or modified CDS sequence (AUadapt) from InfluenzaB__AFG49013__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuauuucgccaaccugaaggggacgaagacccggggcaagcucugccccgacugccugaacugcaccgaccuggauguggcccucgggcgccccaugugcgugggcaccacgccguccgccaaggccucgauccugcacgagguccggcccgugaccuccggcugcuuccccaucaugcacgaccgcaccaagauccggcagcuggcgaaccuccugcgcggguaugagaacauccggcugagcacccagaacgugaucgacgccgagaaggcccccggcgggccguaccgccucggcacguccgggagcugccccaacgccaccuccaagaguggcuucuucgcgaccauggccugggccguccccaaggacaacaacaagaacgccaccaacccccugacgguggaggugccguacaucuguaccgagggcgaggaccagaucaccgucuggggguuccacuccgacaacaagacccagaugaagaaccuguacggcgacaguaacccccagaaguucacguccagcgccaacggggugaccacccacuacgugucccagaucggcggcuuccccgaccagaccgaggaugggggccucccccagagcgggcggaucgucguggacuacaugaugcagaagccgggcaagacggggaccaucguguaccagcgcggcguccugcugccccagaagguguggugcgcguccggccggagcaaggugaucaaggggucgcucccccugaucggcgaggccgacugucugcacgagaaguacgggggccucaacaaguccaagcccuacuacaccggggagcacgccaaggccaucggcaacugcccgaucugggucaagacgccccugaagcuggccaauggcaccaaguaccgcccgcccgcgaagcuccugaaggagcggggguucuucggcgccaucgccggguuccuggagggcgggugggagggcaugaucgccggcuggcacggguacaccagccacggcgcccaugggguggcggucgccgccgaccucaaguccacccaggaggccaucaacaagaucaccaagaaccugaacagccuguccgagcucgaggugaagaaccugcagcgccugucgggcgccauggacgagcuccauaacgagauccuggagcuggacgagaagguggacgaccuccgggcggacacgaucuccagccagaucgagcuggccguccugcucuccaacgagggcaucaucaacagugaggacgagcaccuccuggcccuggagcgcaagcugaagaagaugcuggggcccuccgccguggacaucggcaacgggugcuucgagaccaagcacaagugcaaucagaccugccucgaccggaucgcggccggcaccuucaacgccggggaguucagccugcccaccuucgacucccugaauaucacggccgccucgcucaacgacgacggccuggacaaccacaccauccugcuguacuauuccaccgcggccagcucccucgccgugacccugaugcuggccaucuucaucgucuacauggugagccgcgacaacguguccugcagcaucugccucuga

SEQ ID NO: 14472 - RNA, 1755 nt, Artificial Sequence
  derived and/or modified CDS sequence (AUadapt) from InfluenzaB__AFH57865__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaaguccuacuucgccaaccugaaggggacgcggacccgcggcaagcucugccccgacugccugaauugcaccgaccuggacguggcccucgggcggcccaugugcgugggcaccacgccguccgccaaggccagcauccugcacgagguccgccccgugaccuccggcuguuuccccaucaugcacgaccggaccaagauccgccagcugcccaaccuccugcggggguacgagaacauccgccugagcacccagaaugugaucgacgcggagaaggccccgggcgggcccuaccggcucggcacguccgggagcugccccaacgccaccuccaagagcggcuucuuugccaccauggcgugggccguccccaaggacaacaacaagaacgccaccaacccgcugacgguggaggugcccuacaucuguaccgagggcgaggaccagaucaccgucuggggguuccacuccgacaacaagacccccaugaagaaccuguacggcgauucgaacccccagaaguucacguccagcgccaacggggugaccacccacuacgugucccagaucggcggcuuuccggaccagaccgaggacgggggccucccccagagcgggcgcaucgucguggacuacaugaugcagaagcccggcaagacggggaccaucguguaccagcggggcguccugcugccccagaagguguggugugccuccggccgcagcaaggugaucaaggggagccucccgcugaucggcgaggcggacugccugcacgagaaguacgggggccucaacaaguccaagcccuauuacaccggggagcacgccaaggccaucggcaacugccccaucugggucaagacgccccugaagcuggccaacggcaccaaguaccggccgcccgccaagcuccugaaggagcgcggguuuuucggcgcgaucgccggguuccuggagggcgggugggagggcaugaucgccggcuggcacggguacaccagccacggcgcccacgggguggccgucgcggccgaucucaaguccacccaggaggccaucaacaagaucaccaagaaccugaacagccuguccgagcucgaggugaagaaccugcagcggcugucgggcgccauggacgagcuccauaacgagauccuggagcuggacgagaagguggacgaccuccgcgccgacacgaucuccagccagaucgagcuggcgguccugcucuccaaugagggcaucaucaacagcgaggacgagcaccuccuggcccuggagcggaagcugaagaagaugcuggggcccuccgccguggacaucggcaacgggugcuuugagaccaagcacaagugcaaccagaccugccucgaccgcaucgccgcgggcaccuucaacgccggggaguuuagccugcccaccuucgacucccugaacaucacggccgccagccucaacgaugacggccuggacaaccacaccauccugcuguacuacuccaccgccgcgagcucccucgccgugacccugaugcuggccaucuuuaucgucuacauggugagccgggacaacguguccugcagcaucugccucuga

SEQ ID NO: 14473 - RNA, 1755 nt, Artificial Sequence
  derived and/or modified CDS sequence (AUadapt) from InfluenzaB__AFH57876__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuauuucgccaaccugaaggggacgcggacccgcggcaagcucugccccgacugccugaacugcaccgaccuggacguggcccucgggcggcccaugugugugggcaccacgccguccgccaaggccucgauccugcacgagguccgccccgugaccuccggcugcuuccccaucaugcacgaccggaccaagauccgccagcugcccaaccuccugcggggguacgagaacauccgccugaguacccagaacgugaucgacgcggagaaggccccgggcgggcccuaccggcucggcacguccgggagcugccccaacgccaccuccaagucgggcuucuuugccaccauggcgugggccguccccaaggacaacaacaagaacgccaccaacccgcugacgguggaggugcccuacaucugcaccgagggcgaggaccagaucaccgucuggggguuccauuccgacaacaagaaccagaugaagaaccuguacggcgacagcaacccccagaaguucaccuccagugccaacggggugacgacccacuacgugucccagaucggcucguuccccgaccagaccgaggacggcgggcucccgcaguccggccgcaucgucguggacuacaugaugcagaagcccgggaagaccggcacgaucguguaucagcgggggauccugcugccccagaaggucuggugcgccagcggccgcagcaaggugaucaagggcucccucccccugaucggggaggcggacugccugcacgagaaguacggcgggcucaacaagaguaagccguacuacaccggcgagcacgccaaggccaucgggaacugccccaucugggugaagacgccccugaagcuggccaacggcaccaaguaccggcccccggccaagcuccugaaggagcgcggcuucuucggggcgaucgccggcuuucuggagggcgggugggaggggaugaucgccggcuggcacggcuacaccucccacggggcccacggcgucgccguggcggccgaccucaagucgacccaggaggccaucaacaagaucaccaagaaccugaacucccugagugagcucgaggucaagaaccugcagcggcuguccggggccauggacgagcuccacaacgagauccuggagcuggacgagaagguggacgaccuccgcgccgacaccaucagcucccagaucgagcuggcggugcugcucaguaacgagggcaucaucaacuccgaggacgagcaccuccuggcccuggagcggaagcugaagaagaugcugggccccagcgccgucgagaucgggaacggcugcuucgagacgaagcauaagugcaaccagaccugccucgaccgcaucgccgcggggaccuucaacgccggcgaguucucccugcccaccuucgacagucugaacaucaccgccgccucccucaacgacgacgggcuggacaaccacacgauccugcuguacuacaguaccgccgcguccagccucgccgugacccugaugcuggccaucuucaucguguacauggucucccgggacaacgugagcugcagcaucugccucuga

SEQ ID NO: 14474 - RNA, 1755 nt, Artificial Sequence
  derived and/or modified CDS sequence (AUadapt) from InfluenzaB__AFH57942__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuauuucgccaaccugaaggggacgcggacccgcggcaagcucugccccgacugccugaacugcaccgaccuggauguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguaugagaacauccgccugagcacccagaacgugaucgacgcggagaaggccccgggcgggcccuaccggcucggcacguccgggucgugccccaacgccaccuccaagaucggcuuuuucgccaccauggcgugggccguccccaaggacaacuacaagaacgccaccaacccgcugacgguggaggugcccuacaucugcaccgagggcgaggaucagaucaccgucuggggguuccacagcgacaacaagaaccagaugaagucccuguacggcgacaguaacccccagaaguucaccuccagcgccaacggggugacgacccacuacgugucccagaucggcgacuuccccgaucagaccgaggacggcgggcucccgcagagcggccgcaucgucguggacuacaugaugcagaagcccgggaagaccggcacgaucguguaccagcgcgggguccugcugccccagaagguguggugcgccuccggccggagcaaggugaucaagggcucgcucccccugaucggggaggcggacugucugcacgagaaguacggcgggcucaacaaguccaagccguacuacaccggcgagcacgccaaggccaucgggaacugccccaucugggucaagacgccccugaagcuggccaauggcaccaaguaccggcccccggccaagcuccugaaggagcgcggcuucuucggggcgaucgccggcuuccuggagggcgggugggaggggaugaucgccggcuggcacggcuacaccagccacggggcccauggcguggccgucgcggccgaccucaaguccacccaggaggccaucaacaagaucaccaagaaccugaacagccuguccgagcucgaggugaagaaccugcagcggcugagcggggccauggacgagcuccauaacgagauccuggagcuggacgagaagguggacgaccuccgcgccgacaccaucuccagccagaucgagcuggcgguccugcucuccaacgagggcaucaucaacagugaggacgagcaccuccuggcccuggagcggaagcugaagaagaugcugggccccuccgccguggacaucgggaacggcugcuucgagacgaagcacaagugcaaucagaccugccucgaccgcaucgccgcggggaccuucaacgccggcgaguucagccugcccaccuucgacucccugaauaucaccgccgccagccucaacgacgacgggcuggacaaccacacgauccugcuguacuauuccaccgccgcgagcucccucgccgugacccugaugcuggccaucuucaucgucuacauggugagccgggacaacguguccugcagcaucugccucuga

SEQ ID NO: 14475 - RNA, 1752 nt, Artificial Sequence
  derived and/or modified CDS sequence (AUadapt) from InfluenzaB__AFH57986__HA
augaaggccaucaucgugcugcucauggucgugaccaguaacgccgaccgcaucugcaccggcaucacguccagcaacaguccccacguggucaagaccgcgacccagggggaggugaacgugaccggcgucaucccgcugacgaccacccccaccaagucccacuucgccaaccugaaggggacgaagacccggggcaagcucugccccaauugccugaacugcaccgaccuggacguggcccucgggcgccccaugugugugggcaccacgccguccgccaaggccagcauccugcacgagguccggcccgugaccuccggcugcuuccccaucaugcacgaccgcaccaagauccggcagcugcccaaucuccugcgcggguacgagaacauccggcugagcacccagaacgugaucaacgcggagcgcgccccgggcgggcccuaucggcucggcacguccgggagcugccccaacgucaccucccgcgacggcuucuucgccaccauggccugggcggugccccgggauaacaagaccgccacgaacccgcugaccguggagguccccuacaucugcaccaagggcgaggaccagaucaccguguggggguuucacagcgacgacaagacgcagaugaagaaccuguacggcgauuccaacccccagaaguucaccagcuccgccaacggggugaccacccacuaugucagccagaucggcggcuuccccaaccagacggaggacgggggccucccgcaguccgggcgcaucgugguggacuacaugguccagaagcccggcaagaccgggaccaucguguaucagcggggcgugcugcugccccagaaggucuggugcgccagcggccgcuccaaggugaucaaggggagccucccccugaucggcgaggccgacugccugcaugagaaguacgggggccucaacaagagcaagccguacuacaccggggagcacgcgaaggccaucggcaauugccccaucugggucaagacgccccugaagcuggccaacggcaccaaguaccggcccccggccaagcuccugaaggagcgcggguucuucggcgccaucgcgggguuucuggagggcgggugggagggcaugaucgccggcuggcacggguacaccucccacggcgcccacgggguggccguggccgcggaccucaagagcacccaggaggccaucaauaagaucacgaagaaccugaacucccugagcgagcucgaggucaagaaccugcagcggcuguccggcgccauggacgagcuccauaacgagauccuggagcuggacgagaagguggacgaccuccgcgccgacaccaucagcucccagaucgagcuggccgugcugcucaguaacgagggcaucaucaacuccgaggacgagcaccuccuggcgcuggagcggaagcugaagaagaugcuggggcccagcgccgucgauaucggcaacgggugcuucgagaccaagcacaagugcaaccagaccugucucgaccgcaucgccgccggcaccuucaacgcgggggaguucucccugcccacguucgauagccugaacaucaccgccgccucccucaacgacgacggccuggacaaucacaccauccugcuguacuacagcaccgccgccuccagccucgcggugacgcugaugaucgccaucuuuaucguguacauggucucccgggacaacgugagcugcuccaucugccuguga

SEQ ID NO: 14476 - RNA, 1758 nt, Artificial Sequence
  derived and/or modified CDS sequence (AUadapt) from InfluenzaB__AFH58249__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacgaagacccggggcaagcucugucccaagugccugaacugcaccgaccuggacguggcccucgggcgccccaagugcaccggcaacaucccgcccgccaagguguccauccugcacgagguccggcccgugacgagcggcugcuuccccaucaugcacgaucgcaccaagauccggcagcugccgaaccuccugcgcggguacgagcggauccgccuguccaaccacaacgugaucaacgccgaggaggcgcccggcgggcccuacaagaucggcaccucgggguccugccccaacgucaccaacggcaacggcuuuuucgccacgauggccugggccgugccgaagaacgagaacaacaagaccgcgaccaacagccucaccaucgaggugcccuacaucugcacggagggggaggaccagaucaccgucuggggcuuccacuccgacagugagacccagauggccaagcuguacggggacuccaagccccagaaguucaccagcuccgccaacggcgugacgacccacuacgugucgcagaucggcggguuccccaaccagaccgaggacggcgggcugccgcaguccggccggaucgucguggacuauauggugcagaaguccgggaagaccggcacgaucaccuaccagcgcggcauccuccugccccagaaggucuggugcgccuccgggcggagcaaggugaucaagggcucgcugccccucaucggggaggccgacugccugcacgagaaguacggcgggcugaacaaguccaagcccuacuacaccggcgagcacgcgaaggccaucggcaauugcccgaucugggugaagacgccccucaagcuggccaacgggaccaaguaccgcccgcccgccacccugcucaaggagcggggcuucuucggggccaucgcgggcuuccuggagggcgggugggagggcaugaucgccggguggcacggcuacaccucgcacggggcccacggcgucgccguggccgcggaccugaaguccacccaggaggccaucaauaagaucacgaagaaccucaacagccuguccgagcuggaggucaagaaccuccagcgccugucgggcgccauggacgagcugcacaacgagauccucgagcuggacgagaagguggacgaccugcgggccgacaccaucuccagucagaucgagcucgccgugcugcuguccaacgaggggaucaucaacucggaggacgagcaccuccuggcgcuggagcgcaagcucaagaagaugcugggccccuccgccgucgagaucgggaacggcugcuucgagaccaagcacaagugcaaccagaccugccuggaucggaucgccgccgggaccuucaacgcgggcgaguucagccuccccacguucgacucccugaacaucaccgccgccucgcugaacgacgacggccucgacaaucacaccauccugcuguacuacuccaccgccgccagcucccuggcggugacgcucaugaucgccaucuucguggucuacauggugucgcgcgacaacguguccugcagcaucugccuguga

SEQ ID NO: 14477 - RNA, 1758 nt, Artificial Sequence
  derived and/or modified CDS sequence (AUadapt) from InfluenzaB__AFH58260__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacgaagacccggggcaagcucugccccaagugccugaacuguaccgaccuggacguggcccucgggcgccccaagugcaccggcaacaucccguccgccgaggugagcauccugcacgagguccggcccgugacguccggcugcuuccccaucaugcacgaccgcaccaagauccggcagcugcccaaccuccugcgcggguacgagcacauccggcugucgacccacaaugugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucuguaccgagggggaggaccagaucaccgucuggggcuuccacucggacaacgagauccagauggccaagcuguacggggacuccaagccccagaaguucaccucguccagcaacggcgugacgacccacuacgugucccagaucggcggguuccccaaucagaccgaggacggcgggcugccccagucgggccgcaucgucguggacuacauggugcagaaguccgggaagaccggcacgaucaccuaccagcggggcauccuccugccgcagaaggucuggugcgccagcgggcgcucgaaggugaucaagggcucccugccccucaucggggaggccgacugccugcacgagcgguacggcgggcugaacaagagcaagcccuacuacaccggcgagcaugccaaggcgaucggcaacugccccaucugggugaagaccccgcucaagcuggccaacgggacgaaguaccgcccgcccgccaagcugcucaaggagcggggcuucuucggggccaucgccggcuuccuggagggcgggugggagggcaugaucgcgggguggcacggcuacaccucccacggggcccacggcgucgccguggccgccgaccugaaguccacccaggaggcgaucaacaagaucaccaagaaccucaacucccugagugagcuggaggucaagaaccuccagcgccuguccggcgccauggacgagcugcacaacgagauccucgagcuggacgagaagguggacgaccugcgggccgacacgaucucgucccagaucgagcucgccgugcugcugagcaacgaggggaucaucaacuccgaggacgagcaccuccuggcccuggagcgcaagcucaagaagaugcugggccccucggcggucgagaucgggaauggcugcuucgagaccaagcacaagugcaaccagaccugccuggaccggaucgccgccgggaccuucgacgccggcgaguucucccuccccaccuucgacagccugaacaucacggcggccucccugaacgaugacggccucgacaaccacaccauccugcuguacuacucgaccgccgccuccagccuggccgugacccucaugaucgcgaucuucguggucuacauggugucccgcgacaacgugucgugcagcaucugccuguga

SEQ ID NO: 14478 - RNA, 1755 nt, Artificial Sequence
  derived and/or modified CDS sequence (AUadapt) from InfluenzaB__AFH58271__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuauuucgccaaccugaaggggacgcggacccgcggcaagcucugccccgacugccugaacugcaccgaccuggauguggcccucgggcggcccaugugcgugggcaccacgccguccgccaaggccucgauccugcacgaggucaagcccgugaccuccggcugcuuccccaucaugcacgaccgcaccaagauccggcagcugcccaaccuccugcgcggguaugagaacauccggcugagcacccagaacgugaucgacgcggagaaggccccgggcgggcccuaccgccucggcacguccgggagcugccccaacgccaccuccaagaguggcuucuucgccaccauggcgugggccguccccaaggacaacaacaagaacgccaccaacccgcugacgguggaggugcccuacaucuguaccgagggcgaggaccagaucaccgucuggggguuccacuccgacgacaagacccagaugaagaaccuguacggcgacaguaacccccagaaguucacguccagcgccaacggggugaccacccacuacgugucccagaucggcagcuuccccgaucagaccgaggacggcgggcucccgcaguccggccggaucgucguggacuacaugaugcagaagcccgggaagacgggcaccaucguguaccagcgcgggguccugcugccccagaagguguggugcgccagcggccggucgaaggugaucaagggcucccucccccugaucggggaggcggacugucugcacgagaaguacggcgggcucaacaagagcaagccguacuacaccggcgagcacgccaaggccaucgggaacugucccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccucccacggggcccauggcguggccgucgcggccgaccucaagagcacccaggaggccaucaacaagaucaccaagaaccugaacucccugagcgagcucgaggugaagaaccugcagcgccuguccggggccauggacgagcuccauaacgagauccuggagcuggacgagaagguggacgaccuccgggccgacacgaucucgucccagaucgagcuggcgguccugcucagcaacgagggcaucaucaauuccgaggacgagcaccuccuggcccuggagcgcaagcugaagaagaugcugggccccagcgccguggagaucgggaacggcugcuucgagaccaagcacaagugcaaucagaccugccucgaccggaucgccgcggggaccuucaacgccggcgaguucucccugcccaccuucgacagccugaauaucacggccgccucccucaacgacgacgggcuggacaaccacaccauccugcuguacuacaguaccgccgcguccagccucgccgugacccugaugcuggccaucuucaucgucuacauggugucccgcgacaacgugagcugcagcaucugccucuga

SEQ ID NO: 14479 - RNA, 1755 nt, Artificial Sequence; identical to SEQ ID NO: 14478
  derived and/or modified CDS sequence (AUadapt) from InfluenzaB__AFH58282__HA

SEQ ID NO: 14480 - RNA, 1758 nt, Artificial Sequence; identical to SEQ ID NO: 14090
  derived and/or modified CDS sequence (AUadapt) from InfluenzaB__AFH58293__HA

SEQ ID NO: 14481 - RNA, 1755 nt, Artificial Sequence
  derived and/or modified CDS sequence (AUadapt) from InfluenzaB__AFH58304__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacugcaccgaucuggacguggcccucgggcggcccaugugcgugggcaccacgccguccgccaaggccagcauccugcacgagguccgccccgugaccuccggcugcuuccccaucaugcacgaucggaccaagauccgccagcugcccaaccuccugcggggguacgagaacauccgccugagcacccagaacgugaucgacgcggagaaggccccgggcgggcccuaccggcucggcacguccgggagcugucccaacgccaccuccaagaucggcuucuucgccaccauggcgugggccguccccaaggacaacuacaagaacgccaccaauccgcugacgguggaggugcccuacaucugcaccgagggcgaggaccagaucaccgucuggggguuccacagcgacgacaagacccagaugaagaaucuguacggcgacuccaacccccagaaguucacgucguccgccaacggggugaccacccacuaugugagccagaucggcgacuuccccgaccagaccgaggacggcgggcucccgcaguccggccgcaucgucguggacuacaugaugcagaagcccgggaagacgggcaccaucguguaccagcgcgggguccugcugccccagaagguguggugugccagcggccgguccaaggugaucaagggcagccucccccugaucggggaggcggacugccugcacgagaaguacggcgggcucaacaagaguaagccguacuacaccggcgagcacgccaaggccaucgggaacugccccaucugggucaagacgccccugaagcuggccaacggcaccaaguaccggcccccggccaagcuccugaaggagcgcggcuucuuuggggcgaucgccggcuuccuggagggcgggugggaggggaugaucgccggcuggcacggcuacaccucccacggggcccacggcguggccgucgcggccgaccucaagagcacccaggaggccaucaauaagaucaccaagaaccugaacucccugagcgagcucgaggugaagaaccugcagcggcuguccggggccauggacgagcuccacaacgagauccuggagcuggacgagaagguggaugaccuccgcgccgacacgaucucgucccagaucgagcuggcgguccugcucagcaacgagggcaucaucaacuccgaggacgagcaucuccuggcccuggagcggaagcugaagaagaugcugggccccagcgccguggacaucgggaacggcugcuucgagaccaagcacaagugcaaccagaccugucucgaccgcaucgccgcggggaccuucaacgccggcgaguucucccugcccaccuucgacagccugaauaucacggccgccucccucaacgacgacgggcuggacaaccacaccauccugcuguacuacaguaccgccgcguccagccucgccgugacccugaugcuggccaucuucaucgucuacauggugucccgggacaacgugagcugcuccaucugccucuga

SEQ ID NO: 14482 - RNA, 1755 nt, Artificial Sequence; identical to SEQ ID NO: 14481
  derived and/or modified CDS sequence (AUadapt) from InfluenzaB__AFH58315__HA

SEQ ID NO: 14483 - RNA, 1755 nt, Artificial Sequence
  derived and/or modified CDS sequence (AUadapt) from InfluenzaB__AFH58326__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaagagcuacuucgccaaccugaaggggacgcggacccgcggcaagcucugccccgacugccugaauugcaccgaccuggacguggcccucgggcggcccaugugcgugggcaccacgccguccgccaaggccagcauccugcacgagguccgccccgugaccuccggcugcuuucccaucaugcacgaccggaccaagauccgccagcugcccaaccuccugcggggguacgagaacauccgccugagcacccagaacgugaucgaugcggagaaggccccgggcgggcccuaccggcucggcacguccgggagcugccccaacgccaccuccaagaucggcuucuucgccaccauggcgugggccguccccaaggacaauuacaagaacgccaccaacccgcugacgguggaggugcccuacaucugcaccgagggcgaggaccagaucaccgucuggggguuccauucggacaacaaggcccagaugaagaaccuguacggcgacuccaacccccagaaguuuaccagcuccgccaacggggugacgacccacuacgugagccagaucggcgacuuccccgaucagaccgaggacggcgggccgccccaguccggccgcaucgucguggacuacaugaugcagaagcccgggaagaccggcacgaucguguaccagcgcgggguccuccugccccagaagguguggugcgcgagcggccgguccaaggugaucaagggcagccugccgcucaucggggaggccgauugccugcacgagaaguacggcgggcugaacaagagcaagcccuacuacaccggcgagcaugccaaggccaucgggaacugccccaucugggucaagacgccccucaagcuggccaacggcaccaaguaccggccgcccgcgaagcugcucaaggagcgcggcuucuucggggccaucgccggcuuccuggagggcgggugggaggggaugaucgccggcuggcauggcuacaccucccacggggcccacggcguggcggucgccgccgaccugaaguccacccaggaggccaucaacaagaucaccaagaaccucaacucccugagugagcuggaggugaagaaccuccagcggcuguccggggccauggacgagcugcacaacgagauccucgagcuggacgagaagguggacgaccugcgcgcggauaccaucucgucccagaucgagcucgccguccugcugagcaacgagggcaucaucaacuccgaggacgagcaccuccuggcccuggagcggaagcucaagaagaugcugggccccagcgccguggauaucgggaacggcugcuucgagacgaagcacaagugcaaccagaccugccuggaucgcaucgcggccgggaccuucaacgccggcgaguucucccuccccaccuucgacagccugaacaucaccgccgccucccugaaugacgacgggcucgacaaccacacgauccugcuguacuacaguaccgcggccuccagccuggccgugacccucaugcuggccaucuucaucgucuacauggugucccgggacaacgugagcugcuccaucugccuguga

SEQ ID NO: 14484 - RNA, 1755 nt, Artificial Sequence
  derived and/or modified CDS sequence (AUadapt) from InfluenzaB__AFH58337__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacugcaccgaucuggacguggcccucgggcggcccaugugcgugggcaccacgccguccgccaaggccagcauccugcacgagguccgccccgugaccuccggcugcuuccccaucaugcacgaucggaccaagauccgccagcugcccaaccuccugcggggguacgagaacauccgccugagcacccagaacgugaucgacgcggagaaggccccgggcgggcccuaccggcucggcacguccgggagcugucccaacgccaccuccaagaucggcuucuucgccaccauggcgugggccguccccaaggacaacuacaagaacgccaccaauccgcugacgguggaggugcccuacaucugcaccgagggcgaggaccagaucaccgucuggggguuccacagcgacaacaaggcccagaugaagaaucuguacggcgacuccaacccccagaaguucaccucguccgccaacggggugacgacccacuaugugagccagaucggcgacuuccccgaccagaccgaggacggcgggcucccgcaguccggccgcaucgucguggacuacaugaugcagaagcccgggaagaccggcacgaucguguaccagcgcgggguccugcugccccagaagguguggugugcgagcggccgguccaaggugaucaagggcagccucccccugaucggggaggccgacugccugcacgagaaguacggcgggcucaacaagaguaagccguacuacaccggcgagcacgccaaggccaucgggaacugccccaucugggucaagacgccccugaagcuggccaacggcaccaaguaccggcccccggcgaagcuccugaaggagcgcggcuucuuuggggccaucgccggcuuccuggagggcgggugggaggggaugaucgccggcuggcacggcuacaccucccacggggcccacggcguggcggucgccgccgaccucaagagcacccaggaggccaucaauaagaucaccaagaaccugaacucccugagcgagcucgaggugaagaaccugcagcggcuguccggggccauggacgagcuccacaacgagauccuggagcuggacgagaagguggaugaccuccgcgcggacaccaucucgucccagaucgagcuggccguccugcucagcaacgagggcaucaucaacuccgaggacgagcaucuccuggcccuggagcggaagcugaagaagaugcugggccccagcgccguggacaucgggaacggcugcuucgagacgaagcacaagugcaaccagaccugucucgaccgcaucgcggccgggaccuucaacgccggcgaguucucccugcccaccuucgacagccugaauaucaccgccgccucccucaacgacgacgggcuggacaaccacacgauccugcuguacuacaguaccgcggccuccagccucgccgugacccugaugcuggccaucuucaucgucuacauggugucccgggacaacgugagcugcuccaucugccucuga

SEQ ID NO: 14485 - RNA, 1758 nt, Artificial Sequence
  derived and/or modified CDS sequence (AUadapt) from InfluenzaB__AFH58348__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugucccaagugccugaacugcaccgaccuggacguggcccucgggcgccccaagugcaccggcaacaucccguccgcccgggugagcauccugcacgagguccgccccgugacguccggcugcuuccccaucaugcacgaucggaccaagauccgccagcugcccaaccuccugcggggguacgagcacauccgccugucggcccacaacgugaucaacgcggagaacgccccgggcgggcccuacaagaucggcaccuccgggagcugccccaacgucaccaauggcaacggcuucuucgccacgauggccugggcggugcccaagaacgacaacaacaagaccgccaccaacucccucaccaucgaggugccguacaucugcacggagggggaggaccagaucaccgucuggggcuuccauucggacaaggagacccagauggccaagcuguacggggacuccaagccccagaaguucaccagcuccgccaacggcgugacgacccacuacgugucgcagaucggcggguuccccaaccagaccgaggauggcgggcugccccaguccggccggaucgucguggacuacauggugcagaaguccgggaagaccggcacgaucaccuaccagcgcggcauccuccugccgcagaaggucuggugcgccuccgggcggagcaaggugaucaagggcucgcugccccucaucggggaggcggacugccugcacgagaaguacggcgggcugaacaaguccaagcccuacuacaccggcgagcaugccaaggccaucggcaacugccccaucugggugaagaccccgcucaagcuggccaacgggacgaaguaccgcccgcccgccaagcugcucaaggagcggggcuucuucggggcgaucgccggcuuccuggagggcgggugggagggcaugaucgccggguggcacggcuacaccucgcacggggcccacggcgucgccguggcggccgaucugaaguccacccaggaggccaucaacaagaucaccaagaaccucaacagccuguccgagcuggaggucaagaaccuccagcgccugucgggcgccauggacgagcugcacaacgagauccucgagcuggacgagaagguggacgaccugcgggccgauacgaucuccagccagaucgagcucgcggugcugcuguccaacgaggggaucaucaacucggaggacgagcaccuccuggcccuggagcgcaagcucaagaagaugcugggccccuccgccgucgagaucgggaacggcugcuucgagaccaagcacaagugcaaccagaccugucuggaccggaucgccgcggggaccuucaacgccggcgaguucagccuccccaccuucgacucccugaacaucacggccgccucgcugaacgacgacggccucgauaaccacaccauccugcuguacuacuccaccgccgcgagcucccuggccgugacccucaugaucgccaucuucguggucuacauggugucgcgcgacaacguguccugcagcaucugccuguga

SEQ ID NO: 14486 - RNA, 1758 nt, Artificial Sequence
  derived and/or modified CDS sequence (AUadapt) from InfluenzaB__AFH58370__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugccccaagugucugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcauauccgccugucggcccacaacgugaucaacgcggagaacgccccgggcgggcccuacaagaucggcaccuccgggagcugccccaacgucaccaacggcaacggcuucuucgccacgauggccugggcggugcccaagaaugacaacaacaagaccgccaccaacucccucaccaucgaggugccguacaucugcacggagggggaggaccagaucaccgucuggggcuuccacucggacaacgagauccagauggccaagcuguacggggacuccaagccccagaaguuuaccagcuccgccaacggcgugaccacgcacuacgugucgcagaucggcggguuccccaaccagaccgaggacggcgggcugccccaguccggccggaucgucguggacuacauggugcagaaguccgggaagaccggcaccaucacguaccagcgcggcauccuccugccgcagaaggucuggugcgccuccgggcggagcaaggugaucaagggcucgcugccccucaucggggaggcggauugccugcacgagaaguacggcgggcugaacaaguccaagcccuacuacaccggcgagcacgccaaggccaucggcaacugccccaucugggugaagaccccgcucaagcuggccaacgggaccaaguaccgcccgcccgccaagcugcucaaggagcggggcuucuucggggcgaucgccggcuuucuggagggcgggugggagggcaugaucgccggguggcacggcuacacgucgcacggggcccacggcgucgccguggcggccgaccugaaguccacccaggaggccaucaacaagaucaccaagaaccucaacagccuguccgagcuggaggucaagaaccuccagcgccugucgggcgccauggacgagcugcacaaugagauccucgagcuggacgagaagguggacgaccugcgggccgacaccaucuccagccagaucgagcucgcggugcugcuguccaacgaggggaucaucaacucggaggacgagcaccuccuggcccuggagcgcaagcucaagaagaugcugggccccuccgccgucgagaucgggaacggcugcuucgagacgaagcauaagugcaaccagaccugccuggaccggaucgccgcggggaccuucaacgccggcgaguucagccuccccaccuucgacucccugaacaucaccgccgccucgcugaacgacgauggccucgacaaccacacgauccugcuguacuacuccaccgccgcgagcucccuggccgugacccucaugaucgccaucuucguggucuacauggugucgcgcgacaacguguccugcagcaucugccuguga

SEQ ID NO: 14487 - RNA, 1758 nt, Artificial Sequence; identical to SEQ ID NO: 14089
  derived and/or modified CDS sequence (AUadapt) from InfluenzaB__AFH58392__HA

SEQ ID NO: 14488 - RNA, 1758 nt, Artificial Sequence; identical to SEQ ID NO: 14090
  derived and/or modified CDS sequence (AUadapt) from InfluenzaB__AFH58403__HA

SEQ ID NO: 14489 - RNA, 1758 nt, Artificial Sequence; identical to SEQ ID NO: 14090
  derived and/or modified CDS sequence (AUadapt) from InfluenzaB__AFH58414__HA

SEQ ID NO: 14490 - RNA, 1758 nt, Artificial Sequence; identical to SEQ ID NO: 14090
  derived and/or modified CDS sequence (AUadapt) from InfluenzaB__AFH58425__HA

SEQ ID NO: 14491 - RNA, 1758 nt, Artificial Sequence; identical to SEQ ID NO: 14090
  derived and/or modified CDS sequence (AUadapt) from InfluenzaB__AFH58436__HA

SEQ ID NO: 14492 - RNA, 1758 nt, Artificial Sequence; identical to SEQ ID NO: 14097
  derived and/or modified CDS sequence (AUadapt) from InfluenzaB__AFH58458__HA

SEQ ID NO: 14493 - RNA, 1758 nt, Artificial Sequence; identical to SEQ ID NO: 14097
  derived and/or modified CDS sequence (AUadapt) from InfluenzaB__AFH58469__HA

SEQ ID NO: 14494 - RNA, 1755 nt, Artificial Sequence; identical to SEQ ID NO: 14474
  derived and/or modified CDS sequence (AUadapt) from InfluenzaB__AFH58480__HA

SEQ ID NO: 14495 - RNA, 1755 nt, Artificial Sequence; identical to SEQ ID NO: 14136
  derived and/or modified CDS sequence (AUadapt) from InfluenzaB__AFH58502__HA

SEQ ID NO: 14496 - RNA, 1758 nt, Artificial Sequence; identical to SEQ ID NO: 14110
  derived and/or modified CDS sequence (AUadapt) from InfluenzaB__AFH58513__HA

SEQ ID NO: 14497 - RNA, 1758 nt, Artificial Sequence; identical to SEQ ID NO: 14110
  derived and/or modified CDS sequence (AUadapt) from InfluenzaB__AFH58524__HA

SEQ ID NO: 14498 - RNA, 1755 nt, Artificial Sequence; identical to SEQ ID NO: 14091
  derived and/or modified CDS sequence (AUadapt) from InfluenzaB__AFH58535__HA

SEQ ID NO: 14499 - RNA, 1752 nt, Artificial Sequence
  derived and/or modified CDS sequence (AUadapt) from InfluenzaB__AFH58557__HA
augaaggccaucaucgugcugcucauggucgugaccaguaacgccgaccgcaucugcaccggcaucacguccagcaacaguccccacguggucaagaccgcgacccagggggaggugaacgugaccggcgucaucccgcugacgaccacccccaccaagucccacuucgccaaccugaaggggacgaagacccggggcaagcucugccccaauugccugaacugcaccgaccuggacguggcccucgggcgccccaugugcgugggcaccacgccguccgccaaggccaguauccugcacgagguccggcccgugaccuccggcugcuuccccaucaugcacgaccgcaccaagauccggcagcugcccaaccuccugcgcggguaugagaacauccggcugagcacccagaacgugaucaacgcggagcgcgccccgggcgggcccuaccggcucggcacguccgggagcugucccaacgucaccucccgcgacggcuucuucgccaccauggccugggcggugccccgggacaacaagaccgccacgaauccgcugaccguggagguccccuacaucugcaccaagggcgaggaccagaucaccguguggggguuccacagcgaugacaagacgcagaugaagaaccuguacggcgacuccaacccccagaaguuuaccagcuccgccaacggggugaccacccacuacgucagccagaucggcggcuuccccaaucagacggaggacgggggccucccgcaguccgggcgcaucgugguggacuacaugguccagaagcccggcaagaccgggaccaucguguaccagcggggcgugcugcugccccagaaggucuggugcgccagcggccgcuccaaggugaucaaggggagucucccccugaucggcgaggccgacugccugcacgagaaguacgggggccucaacaagagcaagccguauuacaccggggagcacgcgaaggccaucggcaacugccccaucugggucaagacgccccugaagcuggccaacggcaccaaguaccggcccccggccaagcuccugaaggagcgcggguuuuucggcgccaucgcgggguuccuggagggcgggugggagggcaugaucgccggcuggcacggguacaccucccacggcgcccacgggguggccguggccgcggaucucaagagcacccaggaggccaucaacaagaucacgaagaaccugaacucccugagcgagcucgaggucaagaaccugcagcggcuguccggcgccauggaugagcuccacaacgagauccuggagcuggacgagaagguggacgaccuccgcgccgauaccaucagcucccagaucgagcuggccgugcugcucagcaacgagggcaucaucaacuccgaggacgagcaccuccuggcgcuggagcggaagcugaagaagaugcuggggcccagugccgucgacaucggcaacgggugcuucgagaccaagcacaagugcaaucagaccugccucgaccgcaucgccgccggcaccuucaacgcgggggaguucuccuuccccacguuugacagccugaacaucaccgccgccucccugaacgacgacggccucgauaaccacaccauccugcuguacuacagcaccgccgccuccagccuggcggugacgcucaugaucgccaucuuuaucguguacauggucucccgggacaacgugagcugcuccaucugccuguga

SEQ ID NO: 14500 - RNA, 1755 nt, Artificial Sequence
  derived and/or modified CDS sequence (AUadapt) from InfluenzaB__AFJ76224__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagucccacuuugccaaccugaaggggacgaagacccggggcaagcucugcccgaccugccugaacugcaccgaccuggacguggcccucgggucccccaugugcgugggcaucacgcccagcgccaaggccuccauccugcaugagguccgccccgugaccagcggcugcuuccccaucaugcacgaccggaccaagauccgccagcugcccaaccuccugcggggguacgagaagauccgccuguccacccagaacgugaucaacaucgagaaggcgccgggcgggcccuaucggcucggcacgucgggguccugccccaacgccaccagccgcuccggcuucuucgccaccauggccugggcggucccccgggacaacaacaagaccgccacgaauccgcugaccguggaggugccccacaucugcaccaaggaggaggaccagaucaccgucuggggcuuccacagcgacaacaagacgcagaugaagaaccuguacggggauuccaacccccagaaguucaccucguccgccaacggcgugaccacccacuacgugagccagaucgggggcuuccccgaccagacggaggauggcgggcucccgcaguccggccgcaucgucguggacuacauggugcagaagcccgggaagaccggcaccaucgucuaccagcgggggauccugcugccccagaagguguggugcgccagcggccgcucgaaggugaucaagggcucccucccccugaucggggaggccgacugccugcacgagaaguauggcgggcucaacaagagcaagccguacuacaccggcgagcacgcgaaggccaucgggaacugccccaucugggucaagacgccccugaagcuggccaacggcaccaaguaccggcccccggccaagcuccugaaggagcgcggcuuuuucggggccaucgcgggcuuccuggagggcgggugggaggggaugaucgccggcuggcacggcuacaccucccacggggcccacggcguggccgucgccgcggaccucaagagcacccaggaggccaucaacaagaucacgaagaaucugaacucccugucggagcucgaggugaagaaccugcagcggcuguccggggccauggacgagcuccacaacgagauccuggagcuggacgagaagguggacgaccuccgcgccgacaccaucaguucccagaucgagcuggccguccugcucagcaacgagggcaucaucaacuccgaggacgagcaccuccuggcgcuggagcggaagcugaagaagaugcugggccccucggccguggacaucgggaacggcugcuuugagaccaagcacaagugcaaccagaccugccucgaccgcaucgccgccgggaccuucaacgcgggcgaguucucccugcccacguucgauagccugaacaucaccgccgccucccucaacgacgacgggcuggacaaccacaccauccugcuguacuauagcaccgccgccuccucgcucgcggugacgcugaugaucgccaucuucaucgucuacaugaucucccgggacaacgugagcugcagcaucugccuguga

SEQ ID NO: 14501 - RNA, 1755 nt, Artificial Sequence
  derived and/or modified CDS sequence (AUadapt) from InfluenzaB__AFJ76235__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagucccacuuugccaaccugaaggggacgaagacccggggcaagcucugcccgaccugccugaacugcaccgaccuggacguggcccucgggucccccaugugcgugggcaucacgccgagcgccaaggccuccauccugcaugagguccgccccgugaccagccggugcuuccccaucaugcacgaccgcaccaagauccggcagcugcccaaccuccugcgcggcuacgagaagauccggcuguccacccagaacgugaucaacaucgagaaggcgcccgggggccccuaucgccucgggacgucgggcuccugccccaacgccaccagccgguccggguucuucgccaccauggccugggcggucccccgcgacaacaacaagaccgccacgaauccgcugaccguggaggugccccacaucugcaccaaggaggaggaccagaucaccgucuggggcuuccacagcgacaacaagacgcagaugaagaaccuguacggcgauuccaacccccagaaguucaccucguccgccaacggggugaccacccacuacgugagccagaucggcggguuccccgaccagacggaggauggcggccucccgcaguccgggcggaucgucguggacuacauggugcagaagcccggcaagaccgggaccaucgucuaccagcgcggcauccugcugccccagaagguguggugcgccagcgggcggucgaaggugaucaagggcucccucccccugaucggcgaggccgacugccugcacgagaaguaugggggccucaacaagagcaagccguacuacaccggggagcacgcgaaggccaucggcaacugccccaucugggucaagacgccccugaagcuggccaacgggaccaaguaccggcccccggccaagcuccugaaggagcgcggcuuuuucggcgccaucgcgggguuccuggagggcgggugggagggcaugaucgccggguggcacggcuacaccucccacggcgcccacgggguggccgucgccgcggaccucaagagcacccaggaggccaucaacaagaucacgaagaaucugaacucccugucggagcucgaggugaagaaccugcagcgccuguccggcgccauggacgagcuccacaacgagauccuggagcuggacgagaagguggacgaccuccgggccgacaccaucaguucccagaucgagcuggccguccugcucagcaacgaggggaucaucaacuccgaggacgagcaccuccuggcgcuggagcgcaagcugaagaagaugcugggccccucggccguggacaucggcaacgggugcuuugagaccaagcacaagugcaaccagaccugccucgaccggaucgccgccggcaccuucaacgcgggggaguucucccugcccacguucgauagccugaacaucaccgccgccucccucaacgacgacggccuggacaaccacaccauccugcuguacuauagcaccgccgccuccucgcucgcggugacgcugaugaucgccaucuucaucgucuacaugaucucccgcgacaacgugagcugcagcaucugccuguga

SEQ ID NO: 14502 - RNA, 1755 nt, Artificial Sequence; identical to SEQ ID NO: 14500
  derived and/or modified CDS sequence (AUadapt) from InfluenzaB__AFJ76246__HA

SEQ ID NO: 14503 - RNA, 1758 nt, Artificial Sequence; identical to SEQ ID NO: 14254
  derived and/or modified CDS sequence (AUadapt) from InfluenzaB__AFJ76268__HA

SEQ ID NO: 14504 - RNA, 1758 nt, Artificial Sequence; identical to SEQ ID NO: 14305
  derived and/or modified CDS sequence (AUadapt) from InfluenzaB__AFJ76301__HA

SEQ ID NO: 14505 - RNA, 1755 nt, Artificial Sequence; identical to SEQ ID NO: 14166
  derived and/or modified CDS sequence (AUadapt) from InfluenzaB__AFJ76323__HA

SEQ ID NO: 14506 - RNA, 1758 nt, Artificial Sequence
  derived and/or modified CDS sequence (AUadapt) from InfluenzaB__AFJ76334__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccacuucgccaaucugaaggggacggagacccggggcaagcucugccccaagugccugaacugcaccgaccuggacguggcccucgggcgccccaagugcaccggcaacaucccguccgcccgggugucgauccugcacgagguccgccccgugacguccggcugcuuucccaucaugcacgaccggaccaagauccgccagcugcccaaccuccugcggggguacgagcacauccgccugagcacccacaacgugaucaacgccgagaacgcgccgggcgggcccuacaagaucggcaccuccgggaguugccccaacgucacgaacggcaacggcuucuucgccaccauggccugggccgugcccaagaacgacaacaacaagaccgcgaccaacucccucacgaucgaggugccguauaucugcaccgagggggaggaccagaucaccgucuggggcuuccacagcgacuccgagacccagauggccaagcuguacggggacucgaagccccagaaguucacguccagcgccaauggcgugaccacccacuacgugucccagaucggcggguuccccaaccagaccgaggacggcgggcugccccagucgggccggaucgucguggacuacauggugcagaaguccgggaagacgggcaccaucaccuaccagcgcggcauccuccugccgcagaaggucuggugcgccagcgggcggucgaaggugaucaagggcucccugccccucaucggggaggccgauugccugcacgagaaguacggcgggcugaacaagagcaagcccuacuacaccggcgagcacgcgaaggccaucggcaacugccccaucugggugaagacgccgcucaagcuggccaacgggaccaaguaucgcccgcccgccaagcugcucaaggagcggggcuucuucggggccaucgcgggcuuccuggagggcggguggaagggcaugaucgccggguggcacggcuacaccucccacggggcccacggcgucgccguggccgcggaccugaaguccacccaggaggccaucaacaagaucacgaagaaccucaacucccugagugagcuggaggucaagaaccuccagcgccuguccggcgccauggacgagcugcacaacgagauccucgagcuggacgagaagguggacgaccugcgggccgacaccaucagcucccagaucgagcucgccgugcugcugucgaacgaggggaucaucaauuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuuugacgcgggcgaguucucccuccccacguucgacucgcugaacaucaccgccgccucccugaacgacgacggccucgacaaccauaccauccugcuguacuacagcaccgccgccuccucgcuggcggugacgcucaugaucgccguguucgucguguacauggugucccgcgacaacgucagcugcagcaucugccuguga

SEQ ID NO: 14507 - RNA, 1758 nt, Artificial Sequence; identical to SEQ ID NO: 14254
  derived and/or modified CDS sequence (AUadapt) from InfluenzaB__AFJ77327__HA

SEQ ID NO: 14508 - RNA, 1755 nt, Artificial Sequence; identical to SEQ ID NO: 14166
  derived and/or modified CDS sequence (AUadapt) from InfluenzaB__AFJ77369__HA

SEQ ID NO: 14509 - RNA, 1755 nt, Artificial Sequence; identical to SEQ ID NO: 14166
  derived and/or modified CDS sequence (AUadapt) from InfluenzaB__AFJ77380__HA

SEQ ID NO: 14510 - RNA, 1755 nt, Artificial Sequence
  derived and/or modified CDS sequence (AUadapt) from InfluenzaB__AFJ80139__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaagucccauuucgccaaccugaaggggacgaagacccggggcaagcucugcccgaccugccugaacugcaccgaccuggacguggcccucgggcgccccaugugugugggcaucacgcccuccgccaaggccagcauccugcacgagguccggcccgugaccuccggcugcuuccccaucaugcacgaccgcaccaagauccggcagcugcccaaccuccugcgcggguacgagaagauccggcugucgacccagaaugugaucaacgcggagaaggccccgggcgggcccuaccgccucggcacguccgggagcugccccaacgccaccucccggagcggcuucuucgccaccauggcgugggccgucccccgcgauaacaacaagaccgccacgaacccgcugaccguggaggugcccuacaucugcaccaaggaggaggaccagaucaccgucuggggcuuccacuccgacaauaagacgcagaugaagaaccuguacggggacagcaacccccagaaguucaccuccucggccaacggcgugaccacccauuacgugucccagaucgggggcuuccccgaccagacggaggacggcgggcucccgcagagcggccggaucgucguggacuacauggugcagaagcccgggaagaccggcaccaucgucuaccagcgcgggauccugcugccccagaagguguggugcgccuccggccggaguaaggugaucaagggcuuccucccccugaucggggaggcggacugccugcacgagaaguacggcgggcucaacaagagcaagccguacuauaccggcgagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuauaccucccacggggcccacggcguggccgucgcggccgaccucaagucgacccaggaggccaucaacaagaucacgaagaaccugaacucccugagcgagcucgaggugaagaaucugcagcgccuguccggggccauggacgagcuccacaacgagauccuggagcuggacgagaagguggacgaccuccgggccgacaccaucagcucccagaucgagcuggcgguccugcucagcaaugagggcaucaucaacuccgaggacgagcaccuccuggcccuggagcgcaagcugaagaagaugcugggccccucggccguggacaucgggaacggcugcuucgagaccaagcauaagugcaaccagaccugccucgaccggaucgccgcggggaccuucaacgccggcgaguucucccugcccacguucgacagucugaacaucaccgccgccucccucaacgacgacgggcuggacaaccacaccauccugcuguacuauagcaccgccgcguccagccucgccgugacgcugaugaucgccaucuucaucgucuacaugaucucccgcgacaacgugagcugcuccaucugccuguga

SEQ ID NO: 14511 - RNA, 1755 nt, Artificial Sequence
  derived and/or modified CDS sequence (AUadapt) from InfluenzaB__AFJ80150__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaagucccacuucgccaaccugaaggggacgaagacccggggcaagcucugcccgaccugccugaacugcaccgaccuggauguggcccucgggcgccccaugugcgugggcaucacgcccuccgccaaggccucgauccugcacgagguccggcccgugaccuccggcugcuuccccaucaugcacgaccgcaccaagauccggcagcugcccaaccuccugcgcggguaugagaagauccggcugagcacccagaacgugaucaacgcggagaaggccccgggcgggcccuaccgccucggcacguccgggagcugccccaacgccaccucccggagcggcuuuuucgccaccauggcgugggccgucccccgcgacaacaacaagaccgccacgaacccgcugaccguggaggugcccuacaucugcaccaaggaggaggaccagaucaccgucuggggcuuucacuccgacaacaagacgcagaugaagaaccuguacggggacucgaacccccagaaguuuaccuccagcgccaacggcgugaccacccacuacgugucccagaucgggggcuuccccgaccagacggaggacggcgggcucccgcagagcggccggaucgucguggauuacauggugcagaagcccgggaagaccggcaccaucgucuaccagcgcgggauccugcugccccagaagguguggugcgccuccggccggagcaaggugaucaagggcucgcucccccugaucggggaggcggacugccugcacgagaaguauggcgggcucaacaaguccaagccguacuacaccggcgagcacgccaaggccaucgggaacugccccaucugggucaagacgccccugaagcuggccaacggcaccaaguaucggcccccggccaagcuccugaaggagcgcggcuucuucggggcgaucgccggcuuccuggagggcgggugggaggggaugaucgccggcuggcacggcuacaccagccacggggcccacggcguggccgucgcggccgaucucaaguccacccaggaggccaucaacaagaucacgaagaaccugaacagccuguccgagcucgaggugaagaaccugcagcgccugucgggggccauggacgagcuccacaaugagauccuggagcuggacgagaagguggacgaccuccgggccgacaccaucuccagccagaucgagcuggcgguccugcucuccaacgagggcaucaucaacagcgaggaugagcaccuccuggcccuggagcgcaagcugaagaagaugcugggccccuccgccguggacaucgggaacggcugcuucgagaccaagcacaagugcaaccagaccugucucgaccggaucgccgcggggaccuucaacgccggcgaguucagccugcccacguucgacucccugaacaucaccgccgccagucucaacgacgacgggcuggacaaccacaccauccugcuguacuacuccaccgccgcgaguucccucgccgugacgcugaugaucgccaucuucaucgucuacaugaucagccgcgacaacguguccugcagcaucugccuguga

SEQ ID NO: 14512 - RNA, 1755 nt, Artificial Sequence
  derived and/or modified CDS sequence (AUadapt) from InfluenzaB__AFJ80161__HA
augaaggccaucaucgugcugcucauggucgugaccaguaacgccgaccgcaucugcaccggcaucacguccagcaacagcccccacguggucaagaccgcgacccagggggaggugaaugugaccggcgccaucccgcugacgaccacccccaccaagucccacuucgccaaccugaaggggacgaagacccggggcaagcucugcccgaccugccugaacugcaccgaccuggaugucgcccucgggcgccccaugugcgugggcaucacgcccuccgccaaggcgucgauccugcacgaggugcggcccgucaccuccggcugcuuccccaucaugcacgaccgcaccaagauccggcagcugcccaaccuccugcgcggguaugagaagauccggcugagcacccagaacgugaucaacgccgagaaggccccgggcgggcccuaccgccucggcacguccgggagcugccccaacgccaccucccggagcggcuuuuucgcgaccauggccugggccgugccccgcgacaacaacaagaccgccacgaacccgcugaccgucgaggugccccacaucugcaccaaggaggaggaccagaucaccguguggggcuuucacuccgacaacaagacgcagaugaagaaccuguacggggacucgaacccccagaaguuuaccuccagcgccaacggcaucaccacccacuacgucucccagaucgggggcuuccccgaccagacggaggacggcgggcucccgcagagcggccggaucgugguggauuacaugguccagaagcccgggaagaccggcaccaucguguaccagcgcgggauccugcugccccagaagguguggugcgcguccggccggucgaaggucaucaagggcagccucccccugaucggggaggccgacugccugcacgagaaguauggcgggcucaacaaguccaagccguacuacaccggcgagcacgccaaggccaucgggaacugccccaucugggugaagacgccccugaagcuggccaacggcaccaaguaucggcccccggcgaagcuccugaaggagcgcggcuucuucggggccaucgccggcuuccuggagggcgggugggaggggaugaucgccggcuggcacggcuacaccagccacggggcccacggcguggcggucgccgccgaucucaaguccacccaggaggccaucaacaagaucacgaagaaccugaacagccuguccgagcucgaggugaagaaccugcagcgccugucgggggccauggacgagcuccacaaugagauccuggagcuggacgagaaggucgacgaccuccgggcggacaccaucuccagccagaucgagcuggccgugcugcucuccaacgagggcaucaucaacagcgaggaugagcaccuccuggcccuggagcgcaagcugaagaagaugcugggccccuccgccguggacaucgggaacggcugcuucgagaccaagcacaagugcaaccagaccugucucgaccggaucgcggccgggaccuucaacgccggcgaguucucgcugcccacguucgacucccugaacaucaccgccgccagucucaacgacgacgggcuggacaaccacaccauccugcuguacuacuccaccgcggccaguucccucgccgucacgcugaugaucgccaucuucaucguguacaugaucuuccgcgacaacgugagcugcuccaucugccuguga

SEQ ID NO: 14513 - RNA, 1755 nt, Artificial Sequence
  derived and/or modified CDS sequence (AUadapt) from InfluenzaB__AFJ80172__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaagucccauuucgccaaccugaaggggacgaagacccggggcaagcucugcccgaccugccugaacugcaccgaccuggacguggcccucgggcgccccaugugcgugggcaucacgcccuccgccaaggccaguauccugcacgagguccggcccgugaccuccggcugcuuccccaucaugcacgaccgcaccaagauccggcagcugcccaaccuccugcgcggguacgagaagauccggcugagcacccagaaugugaucaacgcggagaaggccccgggcgggcccuaccgccucggcacguccgggagcugccccaacgccaccucccggucgggcuucuucgccaccauggcgugggccgucccccgcgacaauaacaagaccgccacgaacccgcugaccguggaggugcccuacaucugcaccaaggaggaggaccagaucaccgucuggggcuuccacuccgacaauaagacgcagaugaagaaccuguacggggacagcaacccccagaaguucaccuccagcgccaacggcgugaccacccacuaugugucccagaucggggacuuccccgaccagacggaggacggcggccucccgcagucggggcggaucgucguggacuacauggugcagaagcccggcaagaccgggaccaucgucuaccagcgcggcauccugcugccccagaagguguggugugccuccgggcggagcaaggugaucaagggcagccucccccugaucggcgaggcggacugccugcacgagaaguacgggggccucaacaaguccaagccguacuacaccggggagcaugccaaggccaucggcaacugccccaucugggucaagacgccccugaagcuggccaacgggaccaaguaccggcccccggccaagcuccugaaggagcgcggcuucuucggcgcgaucgccggguuccuggagggcgggugggagggcaugaucgccggguggcacggcuauaccucgcacggcgcccacgggguggccgucgcggccgaccucaaguccacccaggaggccaucaacaagaucacgaagaaccugaacagccuguccgagcucgaggugaagaaccugcagcgccugaguggcgccauggacgagcuccacaacgagauccuggagcuggacgagaagguggacgaccuccgggccgacaccaucuccucgcagaucgagcuggcgguccugcucuccaaugaggggaucaucaacagcgaggacgagcaccuccuggcccuggagcgcaagcugaagaagaugcugggccccuccgccguggacaucggcaacgggugcuucgagaccaagcacaaguguaaccagaccugccucgaccggaucgccgcgggcaccuucaacgccggggaguucagccugcccacguucgauucccugaacaucaccgccgccucgcucaacgacgacggccuggacaaccacaccauccugcuguacuauuccaccgccgcgagcucccucgccgugacgcugaugaucgccaucuucaucgucuacaugaucagccgcgacaacguguccugcagcaucugccuguga

SEQ ID NO: 14514 - RNA, 1755 nt, Artificial Sequence; identical to SEQ ID NO: 14500
  derived and/or modified CDS sequence (AUadapt) from InfluenzaB__AFJ80183__HA

SEQ ID NO: 14515 - RNA, 1755 nt, Artificial Sequence; identical to SEQ ID NO: 14511
  derived and/or modified CDS sequence (AUadapt) from InfluenzaB__AFJ80194__HA

SEQ ID NO: 14516 - RNA, 1755 nt, Artificial Sequence; identical to SEQ ID NO: 14500
  derived and/or modified CDS sequence (AUadapt) from InfluenzaB__AFJ80205__HA

SEQ ID NO: 14517 - RNA, 1755 nt, Artificial Sequence; identical to SEQ ID NO: 14145
  derived and/or modified CDS sequence (AUadapt) from InfluenzaB__AFJ80216__HA

SEQ ID NO: 14518 - RNA, 1755 nt, Artificial Sequence; identical to SEQ ID NO: 14500
  derived and/or modified CDS sequence (AUadapt) from InfluenzaB__AFJ80227__HA

SEQ ID NO: 14519 - RNA, 1758 nt, Artificial Sequence
  derived and/or modified CDS sequence (AUadapt) from InfluenzaB__AFJ80238__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaauaucccguccgccaaggugucgauccugcacgagguccggcccgugacguccggcugcuuccccaucaugcacgaccgcaccaagauccggcagcugcccaaccuccugcgcggguacgagcacauccggcugucgauccacaacgugaucaacgccgagaaggcgccgggcgggcccuacaagaucggcaccuccgggagcugccccaacgucaccaacggcaacggcuucuuugccacgauggccugggccgugcccaagaacgacaacaacaagaccgcgaccaacucccucaccaucgaggugccguacaucugcacggagggggaggaccagaucaccgucuggggcuuccacucggacaacgagacccagauggccaagcuguacggggacuccaagccccagaaguucaccucguccgccaacggcgugacgacccacuacgugagucagaucggcggguuccccaaccagaccgaggacggcgggcugccccaguccggccgcaucgucguggacuacauggugcagaaguccgggaagaccggcacgaucaccuaccagcggggcauccuccugccgcagaaggucuggugcgccuccgggcgcucgaaggugaucaagggcucgcugccccucaucggggaggccgacugccugcacgagaaguacggcgggcugaacaaguccaagcccuacuacaccggcgagcacgcgaaggccaucggcaacugccccaucugggugaagaccccgcucaagcuggccaaugggacgaaguaccggccgcccgccaagcugcucaaggagcgcggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucaccaagaaccucaacucgcuguccgagcuggaggucaagaaccuccagcggcugucgggcgccauggacgagcugcacaacgagauccucgagcuggacgagaagguggaugaccugcgcgccgacacgaucuccagccagaucgagcucgccgugcugcuguccaacgaggggaucaucaacucggaggacgagcaccuccuggcgcuggagcggaagcucaagaagaugcugggccccuccgccgucgagaucgggaacggcugcuucgagaccaagcacaagugcaaccagaccugccuggaccgcaucgccgccgggaccuucgacgcgggcgaguucucgcuccccaccuuugacucccugaacaucacggccgccagccugaacgacgacggccucgacaaccacaccauccugcuguacuacuccaccgccgccucgucccuggcggugacccucaugaucgccaucuucguggucuacauggugucgcgggacaacguguccugcagcaucugccuguga

SEQ ID NO: 14520 - RNA, 1755 nt, Artificial Sequence
  derived and/or modified CDS sequence (AUadapt) from InfluenzaB__AFJ80656__HA
augaaggccaucaucgugcugcucauggucgugaccaguaacgccgaccgcaucugcaccggcaucacguccagcaacagcccccaugugguccggaccgcgacccagggggaggugaacgugaccggcgucaucccgcugacgaccacccccaccaagucccacuucgccaaccugaaggggacgaagacccgcggcaagcucugcccgaccugccugaauugcaccgaccuggacguggcccucgggcggcccaugugcgugggcaucacgcccuccgccaaggccagcauccugcacgagguccgccccgugaccuccggcugcuuucccaucaugcacgaccggaccaagauccgccagcugcccaaccuccugcggggguacgagaagauccgccugagcacccagaacgugaucaaugcggagaaggccccgggcgggcccuaccggcucggcacguccgggucgugccccaacgccaccucccgcagcggcuucuucgccaccauggcgugggccgucccccgggauaacaacaagaccgccacgaacccgcugaccguggaggugccccacaucugcaccaaggaggaggaccagaucaccgucuggggcuuucacuccgacaacaagacgcagaugaagaaccuguacggggacagcaauccccagaaguucaccuccagcgccaacggcgugaccacccacuacgugucccagaucgggggcuuccccgaucagacggaggacggcgggcucccgcagagcggccgcaucgucguggacuacauggugcagaagcccgggaagaccggcaccaucgucuaccagcgggggauccugcugccccagaagguguggugcgccuccggccgcagcaaggugaucaagggcagucucccccugaucggggaggcggacugccugcacgagaaguacggcgggcucaacaaguccaagccguacuauaccggcgagcacgccaaggccaucgggaacugccccaucugggucaagacgccccugaagcuggccaacggcaccaaguaccggcccccggccaagcuccugaaggagcgcggcuucuucggggcgaucgccggcuuucuggagggcgggugggaggggaugaucgccggcuggcacggcuacaccagccacggggcccacggcguggccgucgcggccgaccucaaguccacccaggaggccaucaauaagaucacgaagaaccugaacagccuguccgagcucgaggugaagaaccugcagcggcugagcggggccauggacgagcuccacaaugagauccuggagcuggacgagaagguggacgaccuccgcgccgacaccaucuccagccagaucgagcuggcgguccugcucuccaacgagggcaucaucaauucggaggacgagcaccuccuggcccuggagcggaagcugaagaagaugcugggccccuccgccguggacaucgggaacggcugcuucgagaccaagcauaagugcaaccagaccugccucgaccgcaucgccgcggggaccuucaacgccggcgaguuuagccugcccacguucgacucccugaacaucaccgccgccagccucaacgacgaugggcuggacaaccacaccauccugcuguacuacuccaccgccgcgagcucccucgccgugacgcugaugaucgccaucuuuaucgucuacaugaucagccgggacaacguguccugcagcaucugccuguga

SEQ ID NO: 14521 - RNA, 1755 nt, Artificial Sequence; identical to SEQ ID NO: 14500
  derived and/or modified CDS sequence (AUadapt) from InfluenzaB__AFJ80667__HA

SEQ ID NO: 14522 - RNA, 1755 nt, Artificial Sequence; identical to SEQ ID NO: 14500
  derived and/or modified CDS sequence (AUadapt) from InfluenzaB__AFJ80678__HA

SEQ ID NO: 14523 - RNA, 1755 nt, Artificial Sequence; identical to SEQ ID NO: 14500
  derived and/or modified CDS sequence (AUadapt) from InfluenzaB__AFJ80689__HA

SEQ ID NO: 14524 - RNA, 1755 nt, Artificial Sequence
  derived and/or modified CDS sequence (AUadapt) from InfluenzaB__AFJ80711__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaucaaguccuacuucgccaaccugaaggggaccaagacgcggggcaagcucugccccgacugccugaacugcaccgaucuggacguggcccucgggcgccccaugugcgugggcaccaccccguccgccaaggccagcauccugcacgagguccggcccgugacguccggcugcuuccccaucaugcacgaucgcaccaagauccggcagcugcccaaccuccugcgcggguacgagaacauccggcugagcacccagaacgugaucgacgcggagaaggccccgggcgggcccuaccgccucggcaccuccgggucgugucccaacgccacguccaagagcggcuucuucgccaccauggcgugggccguccccaaggacaacaacaagaaugccaccaacccgcugaccguggaggugcccuacgucugcacggagggcgaggaccagaucaccguguggggguuccacuccgacaacaagacccagaugaagaaucuguacggcgacagcaacccccagaaguucaccuccagcgccaacggggugacgacccauuacgucucccagaucggcggcuuccccgaccagaccgaggacgggggccucccgcagagcgggcggaucgugguggacuacaugguccagaagcccggcaagaccgggacgaucguguaccagcgcggcgugcugcugccccagaaggucuggugugccuccggccggagcaaggugaucaaggggucgcucccccugaucggcgaggcggacugccugcacgagaaguacgggggccucaacaaguccaagccguauuacaccggggagcacgccaaggccaucggcaacugccccaucugggucaagacgccccugaagcuggccaacggcaccaaguaccggcccccggccaagcuccugaaggagcgcggguucuucggcgcgaucgccggguuucuggagggcgggugggagggcaugaucgccggcuggcacggguacaccagccacggcgcccacgggguggccguggcggccgaccucaaguccacccaggaggccaucaacaagaucaccaagaaucugaacagccuguccgagcucgaggucaagaaccugcagcgccugagcggcgccauggacgagcuccacaacgagauccuggagcuggacgagaagguggaugaccuccgggccgacaccaucuccagccagaucgagcuggcggugcugcucuccaacgagggcaucaucaacucggaggacgagcaucuccuggcccuggagcgcaagcugaagaagaugcuggggcccuccgccgucgacaucggcaacgggugcuucgagacgaagcacaagugcaaccagaccugccucgaucggaucgccgcgggcaccuucaacgccggggaguucagccugcccaccuucgacucccugaacaucaccgccgccagucucaacgacgacggccuggacaaccacacgauccugcuguacuacuccaccgccgcgaguucccucgccgugacccugaugcuggccaucuucaucguguacauggucagccgcgacaacguguccugcagcaucugccucuga

SEQ ID NO: 14525 - RNA, 1755 nt, Artificial Sequence; identical to SEQ ID NO: 14524
  derived and/or modified CDS sequence (AUadapt) from InfluenzaB__AFJ80722__HA

SEQ ID NO: 14526 - RNA, 1755 nt, Artificial Sequence
  derived and/or modified CDS sequence (AUadapt) from InfluenzaB__AFJ80733__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacugcaccgaucuggacguggcccucgggcggcccaugugcaugggcaccacgccguccgccaaggccagcauccugcacgaggugcgccccgucaccuccggcugcuuccccaucaugcacgaucggaccaagauccgccagcugcccaaccuccugcggggguacgagaacauccgccugucgacccagaacgugaucgacgcggagaaggccccgggcgggcccuaccggcucggcacguccgggagcugucccgacgccaccaacaaguccggcuucuucgccaccauggcgugggccgugcccaaggacaacaacaagaaugccaccaacccgcugacggucgaggugcccuacaucugcaccgagggcgaggaccagaucaccguguggggguuccacagcgacaauaagacccagaugaagaaccuguacggcgacuccaacccccagaaguucacgagcuccgccaacggggucaccacccauuacgugucgcagaucggcggcuuccccgaccagaccgaggacgggggccucccgcaguccgggcgcaucguggucgacuacaugaugcagaagcccggcaagacggggaccaucguguaccagcggggcgugcugcugccccagaaggucuggugugccagcggccgcuccaaggugaucaaggggagccucccccugaucggcgaggcggacugccugcacgagaaguacgggggccucaacaagaguaagccguacuacaccggggagcacgccaaggccaucggcaacugccccaucugggugaagacgccccugaagcuggccaacggcaccaaguaccggcccccggccaagcuccugaaggagcgcggguucuuuggcgcgaucgccggguuccuggagggcgggugggagggcaugaucgccggcuggcacggguacaccucccacggcgcccacggggucgccguggcggccgaccucaagucgacccaggaggccaucaauaagaucaccaagaaccugaacucccugagcgagcucgaggucaagaaccugcagcggcuguccggcgccauggacgagcuccacaacgagauccuggagcuggacgagaagguggaugaccuccgcgccgacacgaucagcucccagaucgagcuggcggugcugcucagcaacgagggcaucaucaacuccgaggacgagcaucuccuggcccuggagcggaagcugaagaagaugcuggggcccucggccgucgacaucggcaacgggugcuucgagaccaagcacaagugcaaccagaccugucucgaccgcaucgccgcgggcaccuucaacgccggggaguucucccugcccaccuucgacagccugaauaucacggccgccucccucaacgacgacggccuggacaaccacaccauccugcuguacuacaguaccgccgcguccagccucgccgugacccugaugcuggccaucuucaucguguacauggucucccgggacaacgugagcugcuccaucugccucuga

SEQ ID NO: 14527 - RNA, 1758 nt, Artificial Sequence; identical to SEQ ID NO: 14254
  derived and/or modified CDS sequence (AUadapt) from InfluenzaB__AFJ80744__HA

SEQ ID NO: 14528 - RNA, 1758 nt, Artificial Sequence; identical to SEQ ID NO: 14254
  derived and/or modified CDS sequence (AUadapt) from InfluenzaB__AFJ80755__HA

SEQ ID NO: 14529 - RNA, 1758 nt, Artificial Sequence; identical to SEQ ID NO: 14254
  derived and/or modified CDS sequence (AUadapt) from InfluenzaB__AFJ80781__HA

SEQ ID NO: 14530 - RNA, 1758 nt, Artificial Sequence; identical to SEQ ID NO: 14254
  derived and/or modified CDS sequence (AUadapt) from InfluenzaB__AFJ80792__HA

SEQ ID NO: 14531 - RNA, 1758 nt, Artificial Sequence; identical to SEQ ID NO: 14254
  derived and/or modified CDS sequence (AUadapt) from InfluenzaB__AFJ80803__HA

SEQ ID NO: 14532 - RNA, 1758 nt, Artificial Sequence; identical to SEQ ID NO: 14254
  derived and/or modified CDS sequence (AUadapt) from InfluenzaB__AFJ80814__HA

SEQ ID NO: 14533 - RNA, 1758 nt, Artificial Sequence
  derived and/or modified CDS sequence (AUadapt) from InfluenzaB__AFJ80825__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugccccaagugucugaacugcaccgaccuggacguggcccucgggcgccccaagugcaccggcaacaucccguccgcccgggugagcauccugcacgagguccgccccaucacguccggcugcuuccccaucaugcacgaccggaccaagauccgccagcugcccaaccuccugcggggguacgagcauauccgccugucgacccacaacgugaucaacgccgagaacgcgccgggcgggcccuacaagaucggcaccuccgggucgugccccaacgugacgaacggcaacggcuucuucgccaccauggccugggccguccccaagaaugacaacaacaagaccgcgaccaacucccucacgaucgaggugccguacaucugcaccgagggggaggaccagaucaccguguggggcuuccacagcgacaacgagacccagauggccaagcuguacggggacuccaagccccagaaguuuacgucguccgccaacggcgucaccacccacuacgugagccagaucggcggguuccccaaccagaccgaggacggcgggcugccccaguccggccggaucguggucgacuacauggugcagaaguccgggaagacgggcaccaucaccuaccagcgcggcauccuccugccgcagaagguguggugcgccuccgggcggucgaaggucaucaagggcucgcugccccucaucggggaggccgauugccugcacgagaaguacggcgggcugaacaaguccaagcccuacuacaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuucuggagggcgggugggagggcaugaucgccggguggcacggcuacaccagccacggggcccacggcguggccgucgccgcggaccugaaguccacccaggaggccaucaacaagaucacgaagaaccucaacucgcuguccgagcuggaggugaagaaccuccagcgccugagcggcgccauggacgagcugcacaaugagauccucgagcuggacgagaaggucgacgaccugcgggccgacaccaucuccucgcagaucgagcucgccgugcugcuguccaacgaggggaucaucaacucggaggacgagcaccuccuggcgcuggagcgcaagcucaagaagaugcugggccccuccgccguggagaucgggaacggcugcuucgagaccaagcauaagugcaaccagaccugccuggaccggaucgccgccgggaccuucgacgcgggcgaguucagccuccccacguucgacucccugaacaucaccgccgccucgcugaacgacgauggccucgacaaccacaccauccugcuguacuacuccaccgccgccagcucccuggcggucacgcucaugaucgccaucuucgugguguacauggucucgcgcgacaacguguccugcagcaucugccuguga

SEQ ID NO: 14534 - RNA, 1758 nt, Artificial Sequence; identical to SEQ ID NO: 14254
  derived and/or modified CDS sequence (AUadapt) from InfluenzaB__AFJ80836__HA

SEQ ID NO: 14535 - RNA, 1758 nt, Artificial Sequence; identical to SEQ ID NO: 14322
  derived and/or modified CDS sequence (AUadapt) from InfluenzaB__AFJ80847__HA

SEQ ID NO: 14536 - RNA, 1758 nt, Artificial Sequence; identical to SEQ ID NO: 14254
  derived and/or modified CDS sequence (AUadapt) from InfluenzaB__AFJ80858__HA

SEQ ID NO: 14537 - RNA, 1758 nt, Artificial Sequence; identical to SEQ ID NO: 14254
  derived and/or modified CDS sequence (AUadapt) from InfluenzaB__AFJ80869__HA

SEQ ID NO: 14538 - RNA, 1758 nt, Artificial Sequence; identical to SEQ ID NO: 14254
  derived and/or modified CDS sequence (AUadapt) from InfluenzaB__AFJ80880__HA

SEQ ID NO: 14539 - RNA, 1758 nt, Artificial Sequence; identical to SEQ ID NO: 14305
  derived and/or modified CDS sequence (AUadapt) from InfluenzaB__AFJ80891__HA

SEQ ID NO: 14540 - RNA, 1758 nt, Artificial Sequence; identical to SEQ ID NO: 14305
  derived and/or modified CDS sequence (AUadapt) from InfluenzaB__AFJ80902__HA

SEQ ID NO: 14541 - RNA, 1758 nt, Artificial Sequence; identical to SEQ ID NO: 14254
  derived and/or modified CDS sequence (AUadapt) from InfluenzaB__AFJ80913__HA

SEQ ID NO: 14542 - RNA, 1758 nt, Artificial Sequence
  derived and/or modified CDS sequence (AUadapt) from InfluenzaB__AFJ80924__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccacuucgccaaucugaaggggacggagacccggggcaagcucugccccaagugccugaacugcaccgaccuggacguggcccucgggcgccccaagugcaccggcaacaucccguccgcccgggugucgauccugcacgagguccgccccgugacguccggcugcuuucccaucaugcacgaccggaccaagauccgccagcugcccaaccuccugcggggguacgagcacauccgccugagcacccacaacgugaucaacgccgagaacgcgccgggcgggcccuacaagaucggcaccuccgggaguugccccaacgucacgaacggcaacggcuucuucgccaccauggccugggccgugcccaagaacgacaacaacaagaccgcgaccaacucccucacgaucgaggugccguauaucugcgccgagggggaggaccagaucaccgucuggggcuuccacagcgacaacgagacccagauggccaagcuguacggggacuccaagccccagaaguucaccucguccgccaauggcgugacgacccacuacgugagccagaucggcggguuccccaaccagaccgaggacggcgggcugccccaguccggccggaucgucguggacuacauggugcagaaguccgggaagaccggcacgaucaccuaccagcgcggcauccuccugccgcagaaggucuggugcgccuccgggcggucgaaggugaucaagggcagccugccccucaucggggaggcggauugccugcacgagaaguacggcgggcugaacaaguccaagcccuacuacaccggcgagcacgccaaggccaucggcaacugccccaucugggugaagaccccgcucaagcuggccaacgggacgaaguaccgcccgcccgccaagcugcucaaggagcggggcuuuuucggggcgaucgccggcuuccuggagggcgggugggagggcaugaucgccggguggcacggcuacaccucgcacggggcccacggcgucgccguggcggccgaccugaaguccacccaggaggccaucaacaagaucaccaagaaccucaacagucuguccgagcuggaggucaagaaccuccagcgccugucgggcgccauggacgagcugcacaacgagauccucgagcuggacgagaagguggacgaccugcgggccgacacgaucuccagccagaucgagcucgcggugcugcuguccaacgaggggaucaucaauucggaggacgagcaccuccuggcccuggagcgcaagcucaagaagaugcugggccccuccgccgucgagaucgggaacggcugcuucgagaccaagcacaagugcaaccagaccugccuggaccggaucgccgcggggaccuuugacgccggcgaguucagccuccccaccuucgacucccugaacaucacggccgccucgcugaacgacgacggccucgacaaucacaccauccugcuguacuacuccaccgccgcgagcucccuggccgugacccucaugaucgccaucuucguggucuacauggugucgcgcgacaacguguccugcagcaucugccuguga

SEQ ID NO: 14543 - RNA, 1758 nt, Artificial Sequence; identical to SEQ ID NO: 14305
  derived and/or modified CDS sequence (AUadapt) from InfluenzaB__AFJ80935__HA

SEQ ID NO: 14544 - RNA, 1755 nt, Artificial Sequence; identical to SEQ ID NO: 14166
  derived and/or modified CDS sequence (AUadapt) from InfluenzaB__AFJ80946__HA

SEQ ID NO: 14545 - RNA, 1758 nt, Artificial Sequence
  derived and/or modified CDS sequence (AUadapt) from InfluenzaB__AFJ80957__HA
augaaggccaucaucgugcugcucauggucgccaccaguaacgcggaccgcaucugcaccggcaucacguccucgaacagcccccacguggugaagaccgccacccagggggaggucaacgugaccggcgugaucccgcugacgaccacccccaccaagucgcacuucgccaaccugaaggggacggagacccggggcaagcucugucccaagugccugaacugcaccgaccuggacgucgcccucgggcgccccaagugcaccggcaacaucccguccgcccgggugagcauccugcacgaggugcgccccgucacguccggcugcuuccccaucaugcacgaucggaccaagauccgccagcugcccaaccuccugcggggguacgagcacauccgccugucgacccacaacgugaucaacgcggagaacgccccgggcgggcccuacaagaucggcaccuccgggucgugccccaacgugacgaauggcaacggcuucuucgccaccauggccugggcgguccccaagaacgacaacaacaagaccgccaccaacucccucacgaucgaggugccguacaucugcaccgagggggaggaccagaucaccguguggggcuuccacagugacaacgagacccagauggccaagcuguacggggacuccaagccccagaaguucacgucguccgccaacggcgucaccacccacuacgugagccagaucggcggguuccccaaccagaccgaggauggcgggcugccccaguccggccggaucguggucgacuacauggugcagaaguccgggaagacgggcaccaucaccuaccagcgcggcauccuccugccgcagaagguguggugcgccuccgggcggucgaaggucaucaagggcucgcugccccucaucggggaggcggacugccugcacgagaaguacggcgggcugaacaaguccaagcccuacuauaccggcgagcacgccaaggccaucggcaacugccccaucugggugaagacgccgcucaagcuggccaacgggaccaaguaccgcccgcccgccaagcugcucaaggagcggggcuucuucggggcgaucgccggcuuccuggagggcgggugggagggcaugaucgccggguggcacggcuacaccagccacggggcccauggcguggccgucgcggccgaccugaaguccacccaggaggccaucaacaagaucacgaagaaccucaacucgcuguccgagcuggaggugaagaaccuccagcgccugagcggcgccauggacgagcugcacaacgagauccucgagcuggacgagaaggucgacgaccugcgggccgauaccaucuccucgcagaucgagcucgcggugcugcuguccaacgaggggaucaucaacucggaggacgagcaccuccuggcccuggagcgcaagcucaagaagaugcugggccccuccgccguggagaucgggaacggcugcuucgagaccaagcacaagugcaaccagaccugucuggaccggaucgccgcggggaccuucaacgccggcgaguucagccuccccacguucgacucccugaacaucaccgccgccucgcugaacgacgacggccucgauaaccacaccauccugcuguacuacuccaccgccgcgagcucccuggccgucacgcucaugaucgccaucuucgugguguacauggucucgcgcgacaacguguccugcagcaucugccuguga

SEQ ID NO: 14546 - RNA, 1755 nt, Artificial Sequence; identical to SEQ ID NO: 14166
  derived and/or modified CDS sequence (AUadapt) from InfluenzaB__AFJ80968__HA

SEQ ID NO: 14547 - RNA, 1755 nt, Artificial Sequence; identical to SEQ ID NO: 14166
  derived and/or modified CDS sequence (AUadapt) from InfluenzaB__AFJ80979__HA

SEQ ID NO: 14548 - RNA, 1755 nt, Artificial Sequence
  derived and/or modified CDS sequence (AUadapt) from InfluenzaB__AFJ80990__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacuguaccgaccuggacguggcccucgggcggcccaugugcgugggcaccacgccguccgccgaggccagcauccugcacgagguccgccccgugaccuccggcugcuuccccaucaugcaugaccggaccaagauccgccagcugcccaaccuccugcggggguacgagaacauccgccugagcacccagaacgugaucgacgcggagaaggccccgggcgggcccuaucggcucggcacguccgggucgugccccaacgccaccaacaaguccggcuucuucgccaccauggcgugggccguccccaaggacaauaacaagaacgccaccaacccgcugacgguggaggugcccuacaucugcaccgagggcgaggaccagaucaccgucuggggguuccauagcgacaacaagacccagaugaagaaccuguacggcgacuccaacccccagaaguuuacgagcuccgccaacggggugaccacccacuacgugagccagaucggcggcuuccccgaccagaccgaggaugggggccucccgcaguccgggcgcaucgucguggacuacaugaugcagaagcccggcaagacggggaccaucguguaccagcggggcguccugcugccccagaagguguggugcgccagcggccgcuccaaggugaucaaggggucgcucccccugaucggcgaggcggacugucugcacgagaaguacgggggccucaacaagagcaagccguacuacaccggggagcacgccaaggccaucggcaauugccccaucugggucaagacgccccugaagcuggccaacggcaccaaguaccggcccccggccaagcuccugaaggagcgcggguucuucggcgcgaucgccggguuccuggagggcgggugggagggcaugaucgccggcuggcacggguauaccucccacggcgcccacgggguggccgucgcggccgaccucaagagcacccaggaggccaucaacaagaucaccaagaaccugaacucccugagugagcucgaggugaagaaccugcagcggcuguccggcgccauggacgagcuccacaacgagauccuggagcuggacgagaagguggacgaccuccgcgccgauacgaucagcucccagaucgagcuggcgguccugcucucgaacgagggcaucaucaacuccgaggacgagcaccuccuggcccuggagcggaagcugaagaagaugcuggggcccagcgccguggauaucggcaacgggugcuucgagaccaagcacaagugcaaccagaccugccucgaucgcaucgccgcgggcaccuucaacgccggggaguucucccugcccaccuucgacagccugaacaucacggccgccucccucaaugacgacggccuggacaaccacaccauccugcuguacuacaguaccgccgcguccagccucgccgugacccugaugcuggccaucuucaucgucuacauggugucccgggacaacgugagcugcuccaucugccucuga

SEQ ID NO: 14549 - RNA, 1755 nt, Artificial Sequence; identical to SEQ ID NO: 14166
  derived and/or modified CDS sequence (AUadapt) from InfluenzaB__AFJ81001__HA

SEQ ID NO: 14550 - RNA, 1755 nt, Artificial Sequence; identical to SEQ ID NO: 14166
  derived and/or modified CDS sequence (AUadapt) from InfluenzaB__AFJ84360__HA

SEQ ID NO: 14551 - RNA, 1758 nt, Artificial Sequence; identical to SEQ ID NO: 14254
  derived and/or modified CDS sequence (AUadapt) from InfluenzaB__AFJ90395__HA

SEQ ID NO: 14552 - RNA, 1755 nt, Artificial Sequence; identical to SEQ ID NO: 14166
  derived and/or modified CDS sequence (AUadapt) from InfluenzaB__AFJ90406__HA

SEQ ID NO: 14553 - RNA, 1755 nt, Artificial Sequence; identical to SEQ ID NO: 14166
  derived and/or modified CDS sequence (AUadapt) from InfluenzaB__AFJ90417__HA

SEQ ID NO: 14554 - RNA, 1755 nt, Artificial Sequence; identical to SEQ ID NO: 14166
  derived and/or modified CDS sequence (AUadapt) from InfluenzaB__AFJ90428__HA

SEQ ID NO: 14555 - RNA, 1755 nt, Artificial Sequence; identical to SEQ ID NO: 14166
  derived and/or modified CDS sequence (AUadapt) from InfluenzaB__AFJ90450__HA

SEQ ID NO: 14556 - RNA, 1755 nt, Artificial Sequence; identical to SEQ ID NO: 14166
  derived and/or modified CDS sequence (AUadapt) from InfluenzaB__AFJ91038__HA

SEQ ID NO: 14557 - RNA, 1755 nt, Artificial Sequence
  derived and/or modified CDS sequence (AUadapt) from InfluenzaB__AFJ91049__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaucacccccaccaaguccuacuucgccaaccugaaggggacccggacgcgcggcaagcucugccccgacugccugaacugcaccgaucuggacguggcccucgggcggcccaugugcgugggcaccaccccguccgccaaggccagcauccugcacgagguccgccccgugacguccggcugcuuccccaucaugcacgaucggaccaagauccgccagcuggcgaaccuccugcggggguacgagaacauccgccugagcacccagaacgugaucgacgccgagaaggcccccggcgggccguaccggcucggcaccuccgggucgugucccaacgccacguccaagagcggcuucuucgcgaccauggccugggccguccccaaggacaacaacaagaaugccaccaacccccugaccguggaggugccguacaucugcacggagggcgaggaccagaucaccgucuggggguuccacuccgacaacaagacccagaugaagaaucuguacggcgacagcaacccccagaaguucaccuccagcgccaacggggugacgacccauuacgugucccagaucggcggcuuccccgaccagaccgaggacgggggccucccccagagcgggcgcaucgucguggacuacaugaugcagaagccgggcaagaccgggacgaucguguaccagcggggcguccugcugccccagaagguguggugugcguccggccgcagcaaggugaucaaggggucgcucccccugaucggcgaggccgacugccugcacgagaaguacgggggccucaacaaguccaagcccuauuacaccggggagcacgccaaggccaucggcaacugcccgaucugggucaagacgccccugaagcuggccaacggcaccaaguaccggccgcccgcgaagcuccugaaggagcgcggguucuucggcgccaucgccggguuucuggagggcgggugggagggcaugaucgccggcuggcacggguacaccagccacggcgcccacgggguggcggucgccgccgaccucaaguccacccaggaggccaucaacaagaucaccaagaaucugaacagccuguccgagcucgaggugaagaaccugcagcggcugagcggcgccauggacgagcuccacaacgagauccuggagcuggacgagaagguggaugaccuccgcgcggacaccaucuccagccagaucgagcuggccguccugcucuccaacgagggcaucaucaacucggaggacgagcaucuccuggcccuggagcggaagcugaagaagaugcuggggcccuccgccguggacaucggcaacgggugcuucgagacgaagcacaagugcaaccagaccugccucgaucgcaucgcggccggcaccuucaacgccggggaguucagccugcccaccuucgacucccugaacaucaccgccgccagucucaacgacgacggccuggacaaccacacgauccugcuguacuacuccaccgcggccaguucccucgccgugacccugaugcuggccaucuucaucgucuacauggugagccgggacaacguguccugcagcaucugccucuga

SEQ ID NO: 14558 - RNA, 1758 nt, Artificial Sequence
  derived and/or modified CDS sequence (AUadapt) from InfluenzaB__AFJ91060__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccauuucgccaaccugaaggggacggagacccggggcaagcucugcccccgcugccugaacugcaccgaccuggacguggcccucgggcggcccaagugcaccggcaauaucccguccgcccgcgugucgauccugcacgagguccggcccgugacguccggcugcuuccccaucaugcacgaccgcaccaagauccggcagcugcccaaccuccugcgcggguacgagcacauccggcugagcacccauaacgugaucaacgccgagaacgcgccgggcgggcccuacaagaucggcaccuccgggagcugccccaacgucacgaacggcaacggcuuuuucgccaccauggccugggccgugcccaagaacgacaacaacaagaccgcgaccaacucccucacgaucgaggugccguacaucugcaccgagggggaggaccagaucaccgucuggggcuuccauucggacaacgaggcccagauggccaagcuguacggggacuccaagccccagaaguucaccagcuccgccaacggcgugacgacccacuaugugucgcagaucggcggguuccccaaccagaccgaggacggcgggcugccccaguccggccgcaucgucguggacuacauggugcagaaguccgggaagaccggcacgaucaccuaccagcggggcauccuccugccgcagaaggucuggugcgccuccgggcgcagcaaggugaucaagggcagccugccccucaucggggaggcggauugccugcacgagaaguacggcgggcugaacaaguccaagcccuacuacaccggcgagcacgccaaggccaucggcaacugccccaucugggugaagaccccgcucaagcuggccaaugggacgaaguaccggccgcccgccaagcugcucaaggagcgcggcuucuucggggcgaucgccggcuuccuggagggcgggugggagggcaugaucgccggguggcacggcuacaccucgcacggggcccacggcgucgccguggcggccgaucugaaguccacccaggaggccaucaacaagaucaccaagaaccucaacagccuguccgagcuggaggucaagaaccuccagcggcugucgggcgccauggacgagcugcacaacgagauccucgagcuggacgagaagguggaugaccugcgcgccgacacgaucuccagccagaucgagcucgcggugcugcuguccaacgaggggaucaucaacagcgaggacgagcaccuccuggcccuggagcggaagcucaagaagaugcugggccccuccgccgucgagaucgggaacggcuguuucgagaccaagcacaagugcaaccagaccugccuggaccgcaucgccgcggggaccuucgacgccggcgaguucucgcuccccaccuuugacucccugaacaucacggccgccagccugaacgacgacggccucgacaaccacaccauccugcuguauuacuccaccgccgcgucgucccuggccgugacccucaugaucgccaucuucguggucuacauggugagccgggacaacguguccugcagcaucugccuguga

SEQ ID NO: 14559 - RNA, 1755 nt, Artificial Sequence; identical to SEQ ID NO: 14166
  derived and/or modified CDS sequence (AUadapt) from InfluenzaB__AFJ91071__HA

SEQ ID NO: 14560 - RNA, 1755 nt, Artificial Sequence; identical to SEQ ID NO: 14117
  derived and/or modified CDS sequence (AUadapt) from InfluenzaB__AFJ91082__HA

SEQ ID NO: 14561 - RNA, 1755 nt, Artificial Sequence; identical to SEQ ID NO: 14117
  derived and/or modified CDS sequence (AUadapt) from InfluenzaB__AFJ91093__HA

SEQ ID NO: 14562 - RNA, 1755 nt, Artificial Sequence; identical to SEQ ID NO: 14117
  derived and/or modified CDS sequence (AUadapt) from InfluenzaB__AFJ91104__HA

SEQ ID NO: 14563 - RNA, 1755 nt, Artificial Sequence; identical to SEQ ID NO: 14117
  derived and/or modified CDS sequence (AUadapt) from InfluenzaB__AFJ91115__HA

SEQ ID NO: 14564 - RNA, 1758 nt, Artificial Sequence
  derived and/or modified CDS sequence (AUadapt) from InfluenzaB__AFJ91704__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugucccaagugccugaacugcaccgaccuggacguggcccucgggcgccccaagugcaccggcaacaucccguccgcccgggugagcauccugcacgagguccgccccgugacguccggcugcuuccccaucaugcacgaucggaccaagauccgccagcugcccaaccuccugcggggguacgagcacauccgccugucgacccacaacgugaucaacgccgagaacgcgccgggcgggcccuacaagaucggcaccuccgggagcugccccaacgucacgaauggcaagggcuucuucgccaccauggccugggccgugcccaagaacgacaacaacaagaccgcgaccaacucccucacgaucgaggugccguacaucugcaccgagggggaggaccagaucaccgucuggggcuuccacagugacaacgagacccagauggccaagcuguacggggacuccaagccccagaaguucacgagcuccgccaacggcgugaccacccacuacgugucgcagaucggcggguuccccaaccagaccgaggauggcgggcugccccaguccggccggaucgucguggacuacauggugcagaaguccgggaagacgggcaccaucaccuaccagcgcggcauccuccugccgcagaaggucuggugcgccuccgggcggagcaaggugaucaagggcucgcugccccucaucggggaggccgacugccugcacgagaaguacggcgggcugaacaaguccaagcccuacuacaccggcgagcaugcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccucgcacggggcccacggcgucgccguggccgcggaucugaaguccacccaggaggccaucaacaagaucacgaagaaccucaacagccuguccgagcuggaggucaagaaccuccagcgccugucgggcgccauggacgagcugcacaacgagauccucgagcuggacgagaagguggacgaccugcgggccgauaccaucuccagccagaucgagcucgccgugcugcuguccaacgaggggaucaucaacucggaggacgagcaccuccuggcgcuggagcgcaagcucaagaagaugcugggccccuccgccgucgagaucgggaacggcugcuucgagaccaagcacaagugcaaccagaccugucuggaccggaucgccgccgggaccuucgacgcgggcgaguucagccuccccacguucgacucccugaacaucaccgccgccucgcugaacgacgacggccucgauaaccacaccauccugcuguacuacuccaccgccgccagcucccuggcggugacgcucaugaucgccaucuucguggucuacauggugucgcgcgacaacguguccugcagcaucugccuguga

SEQ ID NO: 14565 - RNA, 1755 nt, Artificial Sequence
  derived and/or modified CDS sequence (AUadapt) from InfluenzaB__AFK09797__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaucaaguccuauuucgccaaccugaaggggaccaagacgcggggcaagcucugccccgacugccugaacugcaccgaccuggauguggcccucgggcgccccaugugcgugggcaccaccccguccgccaaggccagcauccugcacgagguccggcccgugacguccggcugcuuccccaucaugcacgaccgcaccaagauccggcagcugcccaaccuccugcgcggguaugagaacauccggcugucgacccagaacgugaucgacgcggagaaggccccgggcgggcccuaccgccucggcaccuccgggagcugccccaacgccacguccaagaguggcuucuucgccaccauggcgugggccguccccaaggacaacaacaagaacgccaccaacccgcugaccguggaggugcccuacgucuguacggagggcgaggaccagaucaccguguggggguuccacuccgacaacaagaaccagaugaagaaccuguacggcgauagcaacccccagaaguucaccuccucggccaacggggugaccacgcacuacgucucccagaucggcggcuuccccgaucagaccgaggacgggggccucccgcagagcgggcggaucgugguggacuacaugguccagaagcccggcaagaccgggaccaucguguaccagcgcggcgugcugcugccccagaaggucuggugcgccuccggccggagcaaggugaucaaggggagccucccccugaucggcgaggcggacugucugcacgagaaguacgggggccucaacaaguccaagccguacuacacgggggagcacgccaaggccaucggcaacugccccaucugggucaagacgccccugaagcuggccaauggcaccaaguaccggcccccggccaagcuccugaaggagcgcggguucuucggcgcgaucgccggguuccuggagggcgggugggagggcaugaucgccggcuggcacggguacaccagccacggcgcccaugggguggccguggcggccgaccucaaguccacccaggaggccaucaacaagaucaccaagaaccugaacucgcuguccgagcucgaggucaagaaccugcagcgccugagcggcgccauggacgagcuccauaacgagauccuggagcuggacgagaagguggacgaccuccgggccgacaccaucuccagccagaucgagcuggcggugcugcucuccaacgagggcaucaucaacagugaggacgagcaccuccuggcccuggagcgcaagcugaagaagaugcuggggcccuccgccgucgacaucggcaacgggugcuucgagaccaagcacaagugcaaucagacgugccucgaccggaucgccgcgggcaccuucaacgccggggaguucucgcugcccaccuucgacucccugaauaucaccgccgccagccucaacgacgacggccuggacaaccacaccauccugcuguacuauuccacggccgcgagcucccucgccgugacccugaugcuggccaucuucaucguguacauggucagccgcgacaacguguccugcagcaucugccucuga

SEQ ID NO: 14566 - RNA, 1755 nt, Artificial Sequence; identical to SEQ ID NO: 14117
  derived and/or modified CDS sequence (AUadapt) from InfluenzaB__AFN54654__HA

SEQ ID NO: 14567 - RNA, 1755 nt, Artificial Sequence; identical to SEQ ID NO: 14307
  derived and/or modified CDS sequence (AUadapt) from InfluenzaB__AFN54665__HA

SEQ ID NO: 14568 - RNA, 1755 nt, Artificial Sequence; identical to SEQ ID NO: 14307
  derived and/or modified CDS sequence (AUadapt) from InfluenzaB__AFN54676__HA

SEQ ID NO: 14569 - RNA, 1755 nt, Artificial Sequence; identical to SEQ ID NO: 14117
  derived and/or modified CDS sequence (AUadapt) from InfluenzaB__AFN54687__HA

SEQ ID NO: 14570 - RNA, 1755 nt, Artificial Sequence
  derived and/or modified CDS sequence (AUadapt) from InfluenzaB__AFN54698__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuauuucgccaaccugaaggggacgcggacccgcggcaagcucugccccgacugccugaacugcaccgaccuggacguggcccucgggcggcccaugugugugggcaccacgccguccgccaaggccagcauccugcacgagguccgccccgugaccuccggcugcuuccccaucaugcacgaccggaccaagauccgccagcugcccaaccuccugcggggguacgagaacauccgccugaguacccagaacgugaucgacgcggagaaggccccgggcgggcccuaccggcucggcacguccgggucgugccccaacgccaccuccaagaucggcuucuucgccaccauggcgugggccguccccaaggauaacuacaagaacgccaccaacccgcugacgguggaggugcccuacaucugcaccgagggcgaggaccagaucaccgucuggggguuccacagugacaacaagacccagaugaagaaccuguacggcgacuccaacccccagaaguucacgagcuucgccaauggggugaccacccacuacgugucccagaucggcgacuuccccgaccagaccgaggacggcgggcucccgcagagcggccgcaucgucguggacuacaugaugcagaagcccgggaagacgggcaccaucguguaucagcgcgggguccugcugccccagaagguguggugcgccuccggccggagcaaggugaucaagggcucccucccccugaucggggaggcggacugccugcacgagaaguacggcgggcucaacaagucgaagccguauuacaccggcgagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcauggcuacaccagccacggggcccacggcguggccgucgcggccgaccucaaguccacccaggaggccaucaacaagaucaccaagaaccugaacagccuguccgagcucgaggugaagaaucugcagcggcugagcggggccauggacgagcuccacaacgagauccuggagcuggacgagaagguggacgaccuccgcgccgacacgaucuccagccagaucgagcuggcgguccugcucuccaaugagggcaucaucaacucggaggacgagcaccuccuggcccuggagcggaagcugaagaagaugcugggccccuccgccguggacaucgggaacggcugcuucgagaccaagcauaagugcaaccagaccugccucgaccgcaucgccgcggggaccuucaacgccggcgaguucagccugcccaccuucgauucccugaacaucacggccgccagccucaacgacgacgggcuggacaaccacaccauccugcuguacuauuccaccgccgcgagcucccucgccgugacccugaugcuggccaucuucaucgucuacauggugagccgggacaacguguccugcagcaucugccucuga

SEQ ID NO: 14571 - RNA, 1755 nt, Artificial Sequence; identical to SEQ ID NO: 14117
  derived and/or modified CDS sequence (AUadapt) from InfluenzaB__AFN54709__HA

SEQ ID NO: 14572 - RNA, 1755 nt, Artificial Sequence; identical to SEQ ID NO: 14117
  derived and/or modified CDS sequence (AUadapt) from InfluenzaB__AFN54720__HA

SEQ ID NO: 14573 - RNA, 1755 nt, Artificial Sequence; identical to SEQ ID NO: 14117
  derived and/or modified CDS sequence (AUadapt) from InfluenzaB__AFN54731__HA

SEQ ID NO: 14574 - RNA, 1755 nt, Artificial Sequence; identical to SEQ ID NO: 14117
  derived and/or modified CDS sequence (AUadapt) from InfluenzaB__AFN54742__HA

SEQ ID NO: 14575 - RNA, 1755 nt, Artificial Sequence; identical to SEQ ID NO: 14117
  derived and/or modified CDS sequence (AUadapt) from InfluenzaB__AFN54753__HA

SEQ ID NO: 14576 - RNA, 1755 nt, Artificial Sequence; identical to SEQ ID NO: 14117
  derived and/or modified CDS sequence (AUadapt) from InfluenzaB__AFN54764__HA

SEQ ID NO: 14577 - RNA, 1755 nt, Artificial Sequence; identical to SEQ ID NO: 14117
  derived and/or modified CDS sequence (AUadapt) from InfluenzaB__AFN54775__HA

SEQ ID NO: 14578 - RNA, 1755 nt, Artificial Sequence; identical to SEQ ID NO: 14117
  derived and/or modified CDS sequence (AUadapt) from InfluenzaB__AFN54786__HA

SEQ ID NO: 14579 - RNA, 1755 nt, Artificial Sequence; identical to SEQ ID NO: 14117
  derived and/or modified CDS sequence (AUadapt) from InfluenzaB__AFN54797__HA

SEQ ID NO: 14580 - RNA, 1755 nt, Artificial Sequence; identical to SEQ ID NO: 14117
  derived and/or modified CDS sequence (AUadapt) from InfluenzaB__AFN54808__HA

SEQ ID NO: 14581 - RNA, 1755 nt, Artificial Sequence; identical to SEQ ID NO: 14307
  derived and/or modified CDS sequence (AUadapt) from InfluenzaB__AFN54819__HA

SEQ ID NO: 14582 - RNA, 1755 nt, Artificial Sequence; identical to SEQ ID NO: 14117
  derived and/or modified CDS sequence (AUadapt) from InfluenzaB__AFN54830__HA

SEQ ID NO: 14583 - RNA, 1755 nt, Artificial Sequence; identical to SEQ ID NO: 14117
  derived and/or modified CDS sequence (AUadapt) from InfluenzaB__AFN54841__HA

SEQ ID NO: 14584 - RNA, 1755 nt, Artificial Sequence; identical to SEQ ID NO: 14117
  derived and/or modified CDS sequence (AUadapt) from InfluenzaB__AFN54852__HA

SEQ ID NO: 14585 - RNA, 1755 nt, Artificial Sequence; identical to SEQ ID NO: 14117
  derived and/or modified CDS sequence (AUadapt) from InfluenzaB__AFN54863__HA

SEQ ID NO: 14586 - RNA, 1758 nt, Artificial Sequence
  derived and/or modified CDS sequence (AUadapt) from InfluenzaB__AFU34595__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuuugccaaccugaaggggacggagacccggggcaagcucugccccaagugccccaacugcaccgaccuggacguggcccuggggcgcccgaagugcaccggcaagauccccuccgcccgggugagcauccuccacgagguccgccccgugacguccggcugcuuucccaucaugcacgaccggaccaagauccgccagcugccgaaccugcuccggggguacgagcacauccgccugucgacccacaacgugaucaacgccgagaacgcgcccggcgggcccuacaagaucggcaccuccgggaguugccccaacgucacgaacggcaacggcuucuucgccaccauggccugggccgugccgaagaacgacaagaacaagaccgcgaccaacccccugacgaucgaggugcccuacaucuguaccgagggggaggaccagaucaccgucuggggcuuccacuccgacaacgagacccagauggccaagcucuaccgggacucgaagccccagaaguucacguccucggccaacggggugaccacccauuacgugucccagaucggcggcuucccgaaccagaccgaggacgggggccugccccagagcgggcgcaucgucguggacuacauggugcagaaguccggcaagacggggaccaucaccuaccagcggggcauccugcucccccagaaggucuggugcgccucgggccgcuccaaggugaucaaggggagccugccccugaucggcgaggccgauugccuccacgagaaguacgggggccugaacaagucgaagccguacuacaccggggagcacgcgaaggccaucggcaacugccccaucugggugaagacgccccugaagcucgccaacggcaccaaguaucggcccccgaccaagcugcugaaggagcgcggguucuucggcgccaucgccggguuccucgagggcgggugggagggcaugaucgcgggcuggcacggguacaccucccacggcgcccacggggucgccguggccgccgaccugaaguccacgcaggaggcgaucaacaagaucaccaagaaccugaacucccucagugagcuggaggucaagaaccugcagcggcucuccggcgccauggacgagcugcacaacgagauccuggagcucgacgagaagguggacgaccugcgcgccgacaccaucucgucccagaucgagcuggccgugcuccugucgaacgagggcaucaucaauuccgaggacgagcaccuccuggcccuggagcggaagcugaagaagaugcucgggcccagcgcggucgagaucggcaacgggugcuucgagaccaagcacaagugcaaccagaccugccuggaccgcaucgccgccggcacguuugacgccggggaguucucccugcccaccuucgacucgcucaacaucaccgcggccucccugaacgacgacggccuggacaaccauaccauccuccuguacuacagcacggccgccuccucgcuggccgugacccugaugaucgcgaucuucguggucuacauggugucccgggacaacgugagcugcuccaucugccucuga

SEQ ID NO: 14587 - RNA, 1758 nt, Artificial Sequence
  derived and/or modified CDS sequence (AUadapt) from InfluenzaB__AFU34606__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaucugaaggggacggagacccggggcaagcucugccccaagugccccaacugcaccgaccuggacguggcccuggaccgcccgaagugcaccgggaagauccccuccgcccgggugagcauccuccacgagguccgccuggugacguccggcugcuuucccaucaugcacgaccggaccaagauccgccagcugcccaaccuccugcggggcuacgagcacauccgccugucgacccacaacgugaucaacgccgagaacgcgcccgggggccccuacaagaucgggaccuccggcaguugccccaacgucacgaacgggaacggcuucuucgccaccauggccugggccgugcccaagaacgacaagaacaagaccgcgaccaacccgcucacgaucgaggugcccuacaucuguaccgagggcgaggaccagaucaccgucuggggguuccacuccgacgacgagacccagauggccaagcuguacggcgacucgaagccccagaaguucacguccagcgccaacggggugaccacccauuacgugucccagaucggcggcuuccccaaccagaccgaggacgggggccugccgcagucggggcggaucgucguggacuacauggugcagaaguccggcaagacggggaccaucaccuaccagcgcggcauccuccugccccagaaggucuggugcgccagcggccgguccaaggugaucaaggggucgcugccccucaucggcgaggccgauugccugcacgagaaguacgggggccugaacaagagcaagcccuacuacaccggggagcacgcgaaggccaucggcaacugcccgaucugggugaagacgccccucaagcuggccaacggcaccaaguaucgcccgcccgccaagcugcucaaggagcggggguucuucggcgccaucgcgggguuccuggagggcgggugggagggcaugaucgccggcuggcacggguacaccucccacggcgcccacggggucgccguggccgcggaccugaaguccacccaggaggccaucaacaagaucacgaagaaccucaacucccugagugagcuggaggucaagaaccuccagcgccuguccggcgccauggacgagcugcacaacgagauccucgagcuggacgagaagguggacgaccugcgggccgacaccaucagcucccagaucgagcucgccgugcugcugucgaacgagggcaucaucaauuccgaggacgagcaccuccuggcgcuggagcgcaagcucaagaagaugcuggggccgagcgccgucgagaucggcaacgggugcuucgagaccaagcacaagugcaaccagaccugccuggaccggaucgccgccggcaccuuugacgcgggggaguucucccuccccacguucgacucgcugaacaucaccgccgccucccugaacgacgacggccucgacaaccauaccauccugcuguacuacagcaccgccgccuccucgcuggcggugacgcucaugaucgccaucuucguggucuacauggugucccgcgacaacgugagcugcuccaucugccuguga

SEQ ID NO: 14588 - RNA, 1758 nt, Artificial Sequence; identical to SEQ ID NO: 14110
  derived and/or modified CDS sequence (AUadapt) from InfluenzaB__AFU34617__HA

SEQ ID NO: 14589 - RNA, 1758 nt, Artificial Sequence
  derived and/or modified CDS sequence (AUadapt) from InfluenzaB__AFU34628__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcauuucgccaaccugaaggggacggagacccggggcaagcucugccccaagugccccaacugcaccgaccuggacguggcccuggggcgcccgaagugcaccggcaagauccccuccgcccgggugaguauccuccacgagguccgccccgugacguccggcugcuuccccaucaugcacgaccggaccaagauccgccagcugccgaaccugcuccggggguacgagcacauccgccugucgacccauaacgugaucaacgccgagaacgcgcccggcgggcccuacaagaucggcaccuccgggagcugccccaacgucacgaacggcaacggcuuuuucgccaccauggccugggccgugccgaagaacgacaagaacaagaccgcgaccaacccccugacgaucgaggugcccuacaucugcaccgagggggaggaccagaucaccgucuggggcuuccauuccgacgacgagacccagauggccaagcucuacggggacucgaagccccagaaguucacguccagcgccaacggcgugaccacccacuaugugucccagaucggcggguucccgaaccagaccgaggacggcgggcugccccagucgggccggaucgucguggacuacauggugcagaaguccgggaagacgggcaccaucaccuaccagcgcggcauccugcucccccagaaggucuggugcgccagcgggcgguccaaggugaucaagggcucgcugccccugaucggggaggccgauugccuccacgagaaguacggcgggcugaacaagagcaagccguacuacaccggcgagcacgcgaaggccaucggcaacugucccaucugggugaagacgccccugaagcucgccaacgggaccaaguaccggcccccggccaagcugcugaaggagcgcggcuuccucggggccaucgcgggcuuccuggagggcggguggaagggcaugaucgccggguggcacggcuacaccucccacggggcccacggcgucgccguggccgcggaccugaaguccacccaggaggccaucaauaagaucacgaagaaccucaacucccugucggagcuggaggucaagaaccuccagcgccuguccggcgccauggacgagcugcacaacgagauccucgagcuggacgagaagguggacgaucugcgggccgacaccaucagcucccagaucgagcucgccgugcugcugucgaacgaggggaucaucaacuccgaggacgagcaccuccuggcgcuggagcgcaagcucaagaagaugcugggccccagcgccgucgagaucgggaacggcuguuucgagaccaagcacaagugcaaccagaccugccuggaccggaucgccgccgggaccuucgacgcgggcgaguucucccuccccacguuugacucgcugaacaucaccgccgccucccugaacgacgacggccucgacaaccacaccauccugcuguauuacagcaccgccgccuccucgcuggcggugacgcucaugaucgccaucuucguggucuacauggugucccgcgacaacgugagcugcuccaucugccuguga

SEQ ID NO: 14590 - RNA, 1758 nt, Artificial Sequence; identical to SEQ ID NO: 14348
  derived and/or modified CDS sequence (AUadapt) from InfluenzaB__AFU34639__HA

SEQ ID NO: 14591 - RNA, 1758 nt, Artificial Sequence; identical to SEQ ID NO: 14118
  derived and/or modified CDS sequence (AUadapt) from InfluenzaB__AGB08299__HA

SEQ ID NO: 14592 - RNA, 1758 nt, Artificial Sequence; identical to SEQ ID NO: 14118
  derived and/or modified CDS sequence (AUadapt) from InfluenzaB__AGB08300__HA

SEQ ID NO: 14593 - RNA, 1755 nt, Artificial Sequence
  derived and/or modified CDS sequence (AUadapt) from InfluenzaB__AGB97259__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacuguaccgaccuggacguggcccucgggcggcccaugugcgugggcaccacgccguccgccaaggccagcauccugcacgagguccgccccgugaccuccggcugcuuccccaucaugcacgaucggaccaagauccgccagcugcccaaccuccugcggggguacgagaagauccgccugagcacccagaacgugaucgacgcggagaaggccccgggcgggcccuaccggcucggcacguccgggagcugucccaacgccaccuccaagaucggcuucuucgccaccauggcgugggccguccccaaggacaacuacaagaacgccaccaacccgcugacgguggaggugcccuauaucugcaccgagggcgaggaccagaucaccgucuggggguuccacagcgacaacaagacccagaugaagucccuguauggcgacucgaacccccagaaguucacguccagcgccaacggggugaccacccacuacgugucccagaucggcgauuuccccgaccagaccgaggacggcgggcucccgcagagcggccgcaucgucguggacuacaugaugcagaagcccgggaagacgggcaccaucguguaccagcgcgggguccugcugccccagaagguguggugugccuccggccggagcaaggugaucaagggcagccucccccugaucggggaggcggacugccugcacgaggaguacggcgggcucaacaaguccaagccguacuauaccggcaagcacgccaaggccaucgggaacugccccaucugggucaagacgccccugaagcuggccaacggcaccaaguaccggcccccggccaagcuccugaaggagcgcggcuucuucggggcgaucgccggcuuucuggagggcgggugggaggggaugaucgccggcuggcacggcuacaccagccacggggcccacggcguggccgucgcggccgaccucaaguccacccaggaggccaucaacaagaucaccaagaaccugaauagccuguccgagcucgaggugaagaaccugcagcggcugucgggggccauggacgagcuccacaacgagauccuggagcuggacgagaagguggaugaccuccgcgccgacacgaucuccagccagaucgagcuggcgguccugcucuccaacgagggcaucaucaacagcgaggacgagcaccuccuggcccuggagcggaagcugaagaagaugcugggccccuccgccguggauaucgggaacggcugcuucgagaccaagcacaagugcaaccagaccugccucgaucgcaucgccgcggggaccuucaacgccggcgaguucagccugcccaccuucgacucccugaacaucacggccgccagccucaaugacgacgggcuggacaaccacaccauccugcuguacuacuccaccgccgcgaguucccucgccgugacccugaugcuggccaucuucaucgucuacaucgugagccgggacaacguguccugcagcaucugccucuga

SEQ ID NO: 14594 - RNA, 1755 nt, Artificial Sequence; identical to SEQ ID NO: 14116
  derived and/or modified CDS sequence (AUadapt) from InfluenzaB__AGB97265__HA

SEQ ID NO: 14595 - RNA, 1755 nt, Artificial Sequence; identical to SEQ ID NO: 14116
  derived and/or modified CDS sequence (AUadapt) from InfluenzaB__AGF44878__HA

SEQ ID NO: 14596 - RNA, 1755 nt, Artificial Sequence; identical to SEQ ID NO: 14116
  derived and/or modified CDS sequence (AUadapt) from InfluenzaB__AGF44879__HA

SEQ ID NO: 14597 - RNA, 1755 nt, Artificial Sequence
  derived and/or modified CDS sequence (AUadapt) from InfluenzaB__AGF44881__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgaagacccggggcaagcucugccccgacugccugaacugcaccgaucuggacguggcccucgggcgccccaugugcgugggcaccacgccguccgccaaggccagcauccugcacgagguccggcccgugaccuccggcugcuuccccaucaugcacgaucgcaccaagauccggcagcuggcgaaccuccugcgcggguacgagaacauccggcugagcacccagaacgugaucgacgccgagaaggcccccggcgggccguaccgccucggcacguccgggucgugucccaacgccaccuccaagagcggcuucuucgcgaccauggccugggccguccccaaggacaacaacaagaaugccaccaacccccugacgguggaggugccguacaucugcgccgagggcgaggaccagaucgcggucuggggguuccacuccgacaacaagacccagaugaagaaucuguacggcgacagcaacccccagaaguucaccuccagcgccaacggggugaccacgcauuacgugucccagaucggcggcuuccccgaccagaccgaggacgggggccucccccagagcgggcggaucgucguggacuacaugaugcagaagccgggcaagaccgggaccaucguguaccagcgcggcguccugcugccccagaagguguggugugccuccggccggagcaaggugaucaaggggucgcucccccugaucggcgaggccgacugccugcacgagaaguacgggggccucaacaaguccaagcccuauuacacgggggagcacgccaaggcgaucggcaacugcccgaucugggucaagacgccccugaagcuggccaacggcaccaaguaccgcccgcccgccaagcuccugaaggagcggggguucuucggcgccaucgccggguuucuggagggcgggugggagggcaugaucgcgggcuggcacggguacaccagccacggcgcccacgggguggccgucgccgccgaccucaaguccacccaggaggcgaucaacaagaucaccaagaaucugaacagccuguccgagcucgaggugaagaaccugcagcgccugagcggcgccauggacgagcuccacaacgagauccuggagcuggacgagaagguggaugaccuccgggccgacaccaucuccagccagaucgagcuggccguccugcucuccaacgagggcaucaucaacucggaggacgagcaucuccuggcgcuggagcgcaagcugaagaagaugcuggggcccuccgccguggacaucggcaacgggugcuucgagaccaagcacaagugcaaccagacgugccucgaucggaucgccgccggcaccuucaacgccggggaguucagccugcccaccuucgacucccugaacaucaccgcggccagucucaacgacgacggccuggacaaccacaccauccugcuguacuacuccacggccgccaguucccucgccgugauccugaugcuggcgaucuucaucgucuacauggugagccgcgacaacguguccugcagcaucugccucuga

SEQ ID NO: 14598 - RNA, 1755 nt, Artificial Sequence
  derived and/or modified CDS sequence (AUadapt) from InfluenzaB__AGF44882__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuauuucgccaaccugaaggggacgaagacccggggcaagcucugccccgacugccugaacugcaccgaccuggacguggcccucgggcgccccaugugugugggcaccacgccguccgccaaggccucgauccugcacgagguccggcccgugaccuccggcugcuuccccaucaugcacgaccgcaccaagauccggcagcuggcgaaccuccugcgcggguacgagaacauccggcugaguacccagaacgugaucgacgccgagaaggcccccggcgggccguaccgccucggcacguccgggagcugccccaacgccaccuccaagucgggcuucuuugcgaccauggccugggccguccccaaggacaacaacaagaacgccaccaacccccugacgguggaggugccguacaucugcgccgagggcgaggaccagaucaccgucuggggguuccauuccgacaacaagacccagaugaagaaccuguacggcgacagcaacccccagaaguucaccuccagcgcgaauggggugacgacccacuacgugucccagaucggcggcuuccccgaccagaccgaggacgggggccucccccagucggggcggaucgucguggacuacaugaugcagaagccgggcaagaccgggacgaucguguaucagcgcggcguccugcugccccagaagguguggugcgccuccggcaagagcaaggugaucaaggggagccucccccugaucggcgaggccgacugccugcacgagaaguacgggggccucaacaaguccaagcccuacuauaccggggagcacgccaaggccaucggcaacugcccgaucugggucaagacgccccugaagcuggcgaacggcaccaaguaccggccgcccgccaagcuccugaaggagcgcggguucuucggcgccaucgccggguuccuggagggcgggugggagggcaugaucgccggcuggcacggguauaccucgcacggcgcgcacgggguggccgucgccgccgaccucaaguccacccaggaggccaucaacaagaucaccaagaaccugaacagccuguccgagcucgaggugaagaaucugcagcggcugagcggcgcgauggacgagcuccacaacgagauccuggagcuggacgagaagguggacgaccuccgcgccgacaccaucuccucgcagaucgagcuggccguccugcucuccaaugagggcaucaucaacagcgaggacgagcaccuccuggcccuggagcggaagcugaagaagaugcuggggcccuccgcgguggacaucggcaacgggugcuucgagacgaagcacaaguguaaccagaccugccucgaccgcaucgccgccggcaccuucaacgccggggaguucagccugcccaccuucgauucccugaacaucaccgccgcgucgcucaacgacgacggccuggacaaccacacgauccugcuguacuauuccaccgccgccagcucccucgccgugacccugaugcuggccaucuucaucgucuacauggugagccgggacaacguguccugcagcaucugccucuga

SEQ ID NO: 14599 - RNA, 1755 nt, Artificial Sequence; identical to SEQ ID NO: 14116
  derived and/or modified CDS sequence (AUadapt) from InfluenzaB__AGF44883__HA

SEQ ID NO: 14600 - RNA, 1755 nt, Artificial Sequence; identical to SEQ ID NO: 14116
  derived and/or modified CDS sequence (AUadapt) from InfluenzaB__AGF44884__HA

SEQ ID NO: 14601 - RNA, 1755 nt, Artificial Sequence; identical to SEQ ID NO: 14116
  derived and/or modified CDS sequence (AUadapt) from InfluenzaB__AGF44886__HA

SEQ ID NO: 14602 - RNA, 1755 nt, Artificial Sequence; identical to SEQ ID NO: 14116
  derived and/or modified CDS sequence (AUadapt) from InfluenzaB__AGF44887__HA

SEQ ID NO: 14603 - RNA, 1755 nt, Artificial Sequence; identical to SEQ ID NO: 14116
  derived and/or modified CDS sequence (AUadapt) from InfluenzaB__AGF44888__HA

SEQ ID NO: 14604 - RNA, 1755 nt, Artificial Sequence
  derived and/or modified CDS sequence (AUadapt) from InfluenzaB__AGL09834__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgaagacccggggcaagcucugccccgacugccugaacuguaccgaccuggacguggcccucgggcgccccaugugcgugggcaccacgccguccgccaaggccagcauccugcacgagguccggcccgugaccuccggcugcuuccccaucaugcaugaccgcaccaagauccggcagcuggcgaaccuccugcgcggguacgagaacauccggcugagcacccagaacgugaucgacgccgagaaggcccccggcgggccguaucgccucggcacguccgggucgugccccaacgccaccuccaagagcggcuucuucgcgaccauggccugggccguccccaaggacaauaacaagaacgccaccaacccccugacgguggaggugccguacaucugcgccgagggcgaggaccagaucgcggucuggggguuccauuccgacaacaagacccagaugaagaaccuguacggcgacagcaacccccagaaguuuaccuccagcgccaacggggugaccacgcacuacgugucccagaucggcggcuuccccgaccagaccgaggacgggggccucccccagagugggcggaucgucguggacuacaugaugcagaagccgggcaagaccgggaccaucguguaccagcgcggcguccugcugccccagaagguguggugcgccuccggccggagcaaggugaucaaggggucgcucccccugaucggcgaggccgacugccugcaugagaaguacgggggccucaacaaguccaagcccuacuacacgggggagcacgccaaggcgaucggcaacugcccgaucugggucaagacgccccugaagcuggccaauggcaccaaguaccgcccgcccgccaagcuccugaaggagcggggguucuucggcgccaucgccggguuccuggagggcgggugggagggcaugaucgcgggcuggcacggguacaccagccauggcgcccacgggguggccgucgccgccgaccucaaguccacccaggaggcgaucaacaagaucaccaagaaccugaacagccuguccgagcucgaggugaagaaccugcagcgccugaguggcgccauggacgagcuccacaacgagauccuggagcuggacgagaagguggacgaccuccgggccgacaccaucuccagucagaucgagcuggccguccugcucuccaacgagggcaucaucaacucggaggacgagcaccuccuggcgcuggagcgcaagcugaagaagaugcuggggcccuccgccguggacaucggcaacggguguuucgagaccaagcacaagugcaaccagacgugccucgaccggaucgccgccggcaccuucaaugccggggacuucagccugcccaccuucgacucccugaacaucaccgcggccagccucaaugacgacggccuggacaaccacaccauccugcuguacuacuccacggccgccaguucccucgccgugacccugaugcuggcgaucuucaucgucuacauggugagccgcgacaacguguccugcagcaucugccucuga

SEQ ID NO: 14605 - RNA, 1755 nt, Artificial Sequence; identical to SEQ ID NO: 14116
  derived and/or modified CDS sequence (AUadapt) from InfluenzaB__AGL09835__HA

SEQ ID NO: 14606 - RNA, 1755 nt, Artificial Sequence
  derived and/or modified CDS sequence (AUadapt) from InfluenzaB__AGL09836__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgaagacccggggcaagcucugccccgacugccugaacugcaccgaucuggacguggcccucgggcgccccaugugcgugggcaccacgccguccgccaaggccagcauccugcacgagguccggcccgugaccuccggcugcuuccccaucaugcacgaucgcaccaagauccggcagcuggcgaaccuccugcgcggguacgagaacauccggcugucgacccagaacgugaucgacgccaagaaggcccccggcgggccguaccgccucggcacguccgggagcugucccaacgccaccuccaagagcggcuucuucgcgaccauggccugggccguccccgaggacaacaacaagaaugccaccaacccccugacgguggaggugccguacaucugcgccgagggcgaggaccagaucaccgucuggggguuccacuccgacaacaagacccagaugaagaaucuguacggcgacagcaacccccagaaguucaccuccucggcgaacggggugacgacccauuacgugucccagaucggcggcuuccccgaccagaccgaggacgggggccucccccagagcgggcggaucgucguggacuacaugaugcagaagccgggcaagaccgggacgaucguguaccagcgcggcguccugcugccccagaagguguggugugccuccggccggagcaaggugaucaaggggagccucccccugaucggcgaggccgacugccugcacgagaaguacgggggccucaacaaguccaagcccuauuacaccggggagcacgccaaggccaucggcaacugcccgaucugggucaagacgccccugaagcuggcgaacggcaccaaguaccgcccgcccgccaagcuccugaaggagcggggguucuucggcgccaucgccggguuucuggagggcgggugggagggcaugaucgccggcuggcacggguacaccagccacggcgcgcacgggguggccgucgccgccgaccucaaguccacccaggaggccaucaacaagaucaccaagaaucugaacucgcuguccgagcucgaggugaagaaccugcagcgccugagcggcgcgauggacgagcuccacaacgagauccuggagcuggacgagaagguggaugaccuccgggccgacaccaucuccagccagaucgagcuggccguccugcucuccaacgagggcaucaucaacagcgaggacgagcaucuccuggcccuggagcgcaagcugaagaagaugcuggggcccuccgcgguggacaucggcaacgggugcuucgagacgaagcacaagugcaaccagaccugccucgaucggaucgccgccggcaccuucaacgccggggaguucucgcugcccaccuucgacucccugaacaucaccgccgcgagucucaacgacgacggccuggacaaccacacgauccugcuguacuacuccaccgccgccaguucccucgccgugacccugaugcuggccaucuucaucgucuacauggugagccgcgacaacguguccugcagcaucugccucuga

SEQ ID NO: 14607 - RNA, 1755 nt, Artificial Sequence; identical to SEQ ID NO: 14116
  derived and/or modified CDS sequence (AUadapt) from InfluenzaB__AGL09837__HA

SEQ ID NO: 14608 - RNA, 1755 nt, Artificial Sequence; identical to SEQ ID NO: 14116
  derived and/or modified CDS sequence (AUadapt) from InfluenzaB__AGL09838__HA

SEQ ID NO: 14609 - RNA, 1755 nt, Artificial Sequence; identical to SEQ ID NO: 14116
  derived and/or modified CDS sequence (AUadapt) from InfluenzaB__AGL09839__HA

SEQ ID NO: 14610 - RNA, 1755 nt, Artificial Sequence; identical to SEQ ID NO: 14116
  derived and/or modified CDS sequence (AUadapt) from InfluenzaB__AGL09840__HA

SEQ ID NO: 14611 - RNA, 1755 nt, Artificial Sequence; identical to SEQ ID NO: 14116
  derived and/or modified CDS sequence (AUadapt) from InfluenzaB__AGL09841__HA

SEQ ID NO: 14612 - RNA, 1758 nt, Artificial Sequence
  derived and/or modified CDS sequence (AUadapt) from InfluenzaB__AGL09842__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugucccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaucuccugcggggguacgagcacauccgccugucgacccacaacgugaucaacgccgagaacgcgccgggcgggcccuacaagaucggcaccuccgggagcugccccaacgucacgaacggcaauggcuucuucgccaccauggccugggccgugcccaagaacgacaagaacaagaccgagaccaacccgcucacgaucgaggugcccuacaucugcaccgagggggaggaccagaucaccgucuggggcuuccacuccgacaaugagacccagauggcgaagcuguacggggacucgaagccccagaaguucacguccucggccaacggcgugaccacccacuacgugucccagaucggcggguuccccaaccagaccgaggacggcgggcugccgcagagcggccggaucgucguggauuacauggugcagaaguccgggaagacgggcaccaucaccuaccagcgcggcauccuccugccccagaaggucuggugcgccucggggcgguccaaggugaucaagggcagccugccccucaucggggaggccgacugccugcacgagaaguacggcgggcugaacaagucgaagcccuacuauaccggcgagcacgccaaggcgaucggcaacugcccgaucugggugaagacgccccucaagcuggccaacgggaccaaguaccgcccgcccgccaagcugcucaaggagcggggcuucuucggggccaucgccggcuuccuggagggcgggugggagggcaugaucgcgggguggcacggcuacaccucccacggggcccacggcgucgccguggccgccgaucugaaguccacccaggaggcgaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucaguucccagaucgagcucgccgugcugcugucgaacgaggggaucaucaacuccgaggacgagcaccuccuggcccuggagcgcaagcucaagaagaugcugggccccagcgcggucgagaucgggaacggcugcuucgagaccaagcacaagugcaaccagaccugucuggaccggaucgccgccgggaccuucgacgccggcgaguucucccuccccacguucgacucgcugaacaucaccgcggccucccugaacgacgacggccucgacaaucacaccauccugcuguacuacagcaccgccgccuccucgcuggccgugacgcucaugaucgcgaucuucguggucuacauggugucccgcgacaacgugagcugcuccaucugccuguga

SEQ ID NO: 14613 - RNA, 1755 nt, Artificial Sequence; identical to SEQ ID NO: 14116
  derived and/or modified CDS sequence (AUadapt) from InfluenzaB__AGL09843__HA

SEQ ID NO: 14614 - RNA, 1755 nt, Artificial Sequence
  derived and/or modified CDS sequence (AUadapt) from InfluenzaB__AGL09844__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuauuucgccaaccugaaggggacgaagacccggggcaagcucugccccgacugccugaacugcaccgaccuggauguggcccucgggcgccccaugugcgugggcaccacgccguccgccaaggccucgauccugcacgagguccggcccgugaccuccggcugcuuccccaucaugcacgaccgcaccaagauccggcagcuggcgaaccuccugcgcggguaugagaacauccggcugagcacccagaacgugaucgacgccgagaaggcccccggcgggccguaccgccucggcacguccgggagcugccccaacgccaccuccaagaguggcuucuucgcgaccauggccugggccguccccaaggacaacaacaagaacgccaccaacccccugacgguggaggugccguacaucugugccgagggcgaggaccagaucaccgucuggggguuccacuccgacaacaagacccagaugaagaaccuguacggcgacaguaacccccagaaguucaccuccagcgcgaacggggugacgacccacuacgugucccagaucggcggcuuccccgaccagaaggaggaugggggccucccccagagcgggcggaucgucguggacuacaugaugcagaagccgggcaagaccgggaccaucguguaccagcgcggcguccugcugccccagaagguguggugcgccuccggccggagcaaggugaucaaggggucgcucccccugaucggcgaggccgacugucugcacgagaaguacgggggccucaacaaguccaagcccuacuacacgggggagcacgccaaggccaucggcaacugcccgaucugggucaagacgccccugaagcuggcgaauggcaccaaguaccgcccgcccgccaagcuccugaaggagcggggguucuucggcgccaucgccggguuccuggagggcgggugggagggcaugaucgccggcuggcacggguacaccagccacggcgcgcaugggguggccgucgccgccgaccucaaguccacccaggaggccaucaacaagaucaccaagaaccugaacagccuguccgagcucgaggugaagaaccugcagcgccugucgggcgcgauggacgagcuccauaacgagauccuggagcuggacgagaagguggacgaccuccgggccgacaccaucuccagccagaucgagcuggccguccugcucuccaacgagggcaucaucaacagugaggacgagcaccuccuggcccuggagcgcaagcugaagaagaugcuggggcccuccgcgguggacaucggcaacgggugcuucgagaccaagcacaagugcaaucagacgugccucgaccggaucgccgccggcaccuucaacgccggggaguucagccugcccaccuucgacucccugaauaucaccgccgcgucgcucaacgacgacggccuggacaaccacaccauccugcuguacuauuccacggccgccagcucccucgccgugacccugaugcuggccaucuucaucgucuacauggugagccgcgacaacguguccugcagcaucugccucuga

SEQ ID NO: 14615 - RNA, 1755 nt, Artificial Sequence; identical to SEQ ID NO: 14116
  derived and/or modified CDS sequence (AUadapt) from InfluenzaB__AGL09845__HA

SEQ ID NO: 14616 - RNA, 1755 nt, Artificial Sequence; identical to SEQ ID NO: 14116
  derived and/or modified CDS sequence (AUadapt) from InfluenzaB__AGL09846__HA

SEQ ID NO: 14617 - RNA, 1755 nt, Artificial Sequence
  derived and/or modified CDS sequence (AUadapt) from InfluenzaB__AGL09847__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgaagacccggggcaagcucugccccgacugccugaacugcaccgaucuggacguggcccucgggcgccccaugugcgugggcaccacgccguccgccaaggccagcauccugcacgagguccggcccgugaccuccggcugcuuccccaucaugcacgaucgcaccaagauccggcagcuggcgaaccuccugcgcggguacgagaacauccggcugucgacccagaacgugaucgacgccgagaaggcccccggcgggccguaccgccucggcacguccgggagcugucccaacgccaccuccaagagcggcuucuucgcgaccauggccugggccguccccaaggacaacaacaagaaugccaccaacccccugacgguggaggugccguacaucugcgccgagggcgaggaccagaucgcgaucuggggguuccacuccgacaacaagacccagaugaagaaucuguacggcgacagcaacccccagaaguucaccuccucggccaacggggucaccacgcauuacgugucccagaucggcggcuuccccgaccagaccgaggacgggggccucccccagagcgggcggaucguggucgacuacaugaugcagaagccgggcaagaccgggaccaucguguaccagcgcggcgugcugcugccccagaaggucuggugugccuccggccggagcaaggugaucaaggggagccucccccugaucggcgaggccgacugccugcacgagaaguacgggggccucaacaaguccaagcccuauuacacgggggagcacgccaaggcgaucggcaacugcccgaucugggugaagacgccccugaagcuggccaacggcaccaaguaccgcccgcccgccaagcuccugaaggagcggggguucuucggcgccaucgccggguuucuggagggcgggugggagggcaugaucgcgggcuggcacggguacaccagccacggcgcccacggggucgccguggccgccgaccucaaguccacccaggaggcgaucaacaagaucaccaagaaucugaacucgcuguccgagcucgaggucaagaaccugcagcgccugagcggcgccauggacgagcuccacaacgagauccuggagcuggacgagaagguggaugaccuccgggccgacaccaucuccagccagaucgagcuggccgugcugcucuccaacgagggcaucaucaacagcgaggacgagcaucuccuggcgcuggagcgcaagcugaagaagaugcuggggcccuccgccgucgacaucggcaacgggugcuucgagaccaagcacaagugcaaccagacgugccucgaucggaucgccgccggcaccuucaacgccggggaguucucgcugcccaccuucgacucccugaacaucaccgcggccagucucaacgacgacggccuggacaaccacaccauccugcuguacuacuccacggccgccaguucccucgccgugacccugaugcuggcgaucuucaucguguacauggucagccgcgacaacguguccugcagcaucugccucuga

SEQ ID NO: 14618 - RNA, 1755 nt, Artificial Sequence
  derived and/or modified CDS sequence (AUadapt) from InfluenzaB__AGL09849__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuauuucgccaaccugaaggggacgaagacccggggcaagcucugccccgacugccugaacugcaccgaccuggauguggcccucgggcgccccaugugcgugggcaccacgccguccgccaaggccucgauccugcacgagguccggcccgugaccuccggcugcuuccccaucaugcacgaccgcaccaagauccggcagcuggcgaaccuccugcgcggguaugagaacauccggcugagcacccagaacgugaucaacgccgagaaggcccccggcgggccguaccgccucggcacguccgggagcugccccaacgccaccuccaagaguggcuucuucgcgaccauggccugggccguccccaaggacaacaacaagaacgccaccaacccccugacgguggaggugccguacaucugugccgagggcgaggaccagaucaccgucuggggguuccacuccgacaacaagacccagaugaagaaccuguacggcgacaguaacccccagaaguucaccuccagcgcgaacggggugacgacccacuacgugucccagaucggcggcuuccccgaccagaccgaggaugggggccucccccagagcgggcggaucgucguggacuacaugaugcagaagccgggcaagaccgggacgaucguguaccagcgcggcguccugcugccccagaagguguggugcgccuccggccggagcaaggugaucaaggggucgcucccccugaucggcgaggccgacugucugcacgagaaguacgggggccucaacaaguccaagcccuacuacaccggggagcacgccaaggccaucggcaacugcccgaucugggucaagacgccccugaagcuggcgaauggcaccaaguaccgcccgcccgccaagcuccugaaggagcggggguucuucggcgccaucgccggguuccuggagggcgggugggagggcaugaucgccggcuggcacggguacaccagccacggcgcgcaugggguggccgucgccgccgaccucaaguccacccaggaggccaucaacaagaucaccaagaaccugaacagccuguccgagcucgaggugaagaaccugcagcgccugucgggcgcgauggacgagcuccauaacgagauccuggagcuggacgagaagguggacgaccuccgggccgacaccaucuccagccagaucgagcuggccguccugcucuccaacgagggcaucaucaacagugaggacgagcaccuccuggcccuggagcgcaagcugaagaagaugcuggggcccuccgcgguggacaucggcaacgggugcuucgagacgaagcacaagugcaaucagaccugccucgaccggaucgccgccggcaccuucaacgccggggaguucagccugcccaccuucgacucccugaauaucaccgccgcgucgcucaacgacgacggccuggacaaccacacgauccugcuguacuauuccaccgccgccagcucccucgccgugacccugaugcuggccaucuucaucgucuacauggugagccgcgacaacguguccugcagcaucugccucuga

SEQ ID NO: 14619 - RNA, 1755 nt, Artificial Sequence; identical to SEQ ID NO: 14116
  derived and/or modified CDS sequence (AUadapt) from InfluenzaB__AGL09850__HA

SEQ ID NO: 14620 - RNA, 1755 nt, Artificial Sequence; identical to SEQ ID NO: 14116
  derived and/or modified CDS sequence (AUadapt) from InfluenzaB__AGL09851__HA

SEQ ID NO: 14621 - RNA, 1758 nt, Artificial Sequence; identical to SEQ ID NO: 14118
  derived and/or modified CDS sequence (AUadapt) from InfluenzaB__AGL09852__HA

SEQ ID NO: 14622 - RNA, 1755 nt, Artificial Sequence; identical to SEQ ID NO: 14116
  derived and/or modified CDS sequence (AUadapt) from InfluenzaB__AGL09853__HA

SEQ ID NO: 14623 - RNA, 1755 nt, Artificial Sequence; identical to SEQ ID NO: 14116
  derived and/or modified CDS sequence (AUadapt) from InfluenzaB__AGL09854__HA

SEQ ID NO: 14624 - RNA, 1758 nt, Artificial Sequence
  derived and/or modified CDS sequence (AUadapt) from InfluenzaB__AGL09855__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugccccaagugccugaacuguaccgaccuggacguggcccucgggcgccccaagugcaccggcaagaucccguccgcccgggugucgauccugcacgagguccgccccgugacguccggcugcuuccccaucaugcacgaccggaccaagauccgccagcugcccaaccuccugcggggguacgagcacauccgccugagcacccacaacgugaucaaugccgagaacgcgccgggcgggcccuacaagaucggcaccuccgggucgugccccaacgucacgaacggcaacggcuucuucgccaccauggccugggccgugcccaagaacgacaagaacaagaccgagaccaacccgcucacgaucgaggugcccuacaucugcaccgaggaggaggaucagaucaccgucuggggguuccacuccgacaacgagacccagauggcgaagcuguacggcgacucgaagccccagaaguucacguccagcgccaacggggugaccacccacuacgugucccagaucggcgacuuccccaaccagaccgaggauggcgggcugccgcagucgggccggaucgucguggacuacauggugcagaaguccgggaagacgggcaccaucaccuaccagcgcgggauccuccugccccagaaggucuggugcgccucgggccgguccaaggugaucaagggcagccugccccucaucggggaggccgacugccugcacgagaaguacggcgggcugaacaagucgaagcccuacuacaccggcgagcaugccaaggcgaucgggaacugcccgaucugggugaagacgccccucaagcuggccaacggcaccaaguaccgcccgcccgccaagcugcucaaggagcggggcuucuucggggccaucgccggcuuccuggagggcgggugggaggggaugaucgcgggcuggcacggcuacaccucccacggggcccacggcgucgccguggccgccgaccugaaguccacccaggaggcgaucaacaagaucacgaagaaccucaacucccugagugagcuggaggucaagaaccuccagcgccuguccggggccauggacgagcugcacaacgagauccucgagcuggacgagaagguggacgaccugcgggccgacaccaucagcucccagaucgagcucgccgugcugcugucgaacgagggcaucaucaacuccgaggacgagcaccuccuggcccuggagcgcaagcucaagaagaugcugggccccucggcggucgagaucgggaauggcugcuucgagaccaagcacaagugcaaccagaccugccuggaccggaucgccgccgggaccuucgacgccggcgaguucucccuccccacguucgacagccugaacaucaccgcggccucccugaacgaugacgggcucgacaaccacaccauccugcuguacuacucgaccgccgccuccucgcuggccgugacgcucaugaucgcgaucuucguggucuacauggugucccgcgacaacgugagcugcuccaucugccuguga

SEQ ID NO: 14625 - RNA, 1755 nt, Artificial Sequence; identical to SEQ ID NO: 14116
  derived and/or modified CDS sequence (AUadapt) from InfluenzaB__AGL09856__HA

SEQ ID NO: 14626 - RNA, 1755 nt, Artificial Sequence
  derived and/or modified CDS sequence (AUadapt) from InfluenzaB__AGL09857__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgaagacccggggcaagcucugccccgacugccugaacuguaccgaccuggacguggcccucgggcgccccaugugcgugggcaccacgccguccgccaaggccagcauccugcacgagguccggcccgugaccuccggcugcuuccccaucaugcacgaucgcaccaagauccggcagcuggcgaaccuccugcgcggguacgagaacauccggcugucgacccagaaggugaucgacgccgagaaggcccccggcgggccguaccgccucggcacguccgggagcugucccaacgccaccuccaagagcggcuucuucgcgaccauggccugggccguccccaaggacaacaacaagaacgccaccaauccccugacgguggaggugccguacaucugcgccgagggcgaggaccagaucaccgucuggggguuccacuccgacaacaagacccagaugaagaaucuguacggcgacagcaacccccagaaguucaccuccucggcgaacggggugacgacccacuaugugucccagaucggcggcuuccccgaccagaccgaggacgggggccucccccagagcgggcggaucgucguggacuacaugauccagaagccgggcaagaccgggacgaucguguaccagcgcggcguccugcugccccagaagguguggugugccuccggccggagcaaggugaucaaggggagccucccccugaucggcgaggccgacugccugcacgagaaguacgggggccucaacaaguccaagcccuacuauaccggggagcacgccaaggccaucggcaacugcccgaucugggucaagacgccccugaagcuggcgaacggcaccaaguaccgcccgcccgccaagcuccugaaggagcggggguucuucggcgccaucgccggguuucuggagggcgggugggagggcaugaucgccggcuggcacggguacaccagccacggcgcgcacgggguggccgucgccgccgaccucaaguccacccaggaggccaucaacaagaucaccaagaaccugaauucgcuguccgagcucgaggugaagaaccugcagcgccugagcggcgcgauggacgagcuccacaacgagauccuggagcuggacgagaagguggaugaccuccgggccgacaccaucuccagccagaucgagcuggccguccugcucuccaacgagggcaucaucaacagcgaggacgagcaccuccuggcccuggagcgcaagcugaagaagaugcuggggcccuccgcgguggauaucggcaacgggugcuucgagacgaagcacaagugcaaccagaccugccucgaucggaucgccgccggcaccuucaacgccggggaguucucgcugcccaccuucgacucccugaacaucaccgccgcgagccucaaugacgacggccuggacaaccacacgauccugcuguacuacuccaccgccgccaguucccucgccgugacccugaugcuggccaucuucaucgucuacauggugagccgcgacaacguguccugcagcaucugccucuga

SEQ ID NO: 14627 - RNA, 1758 nt, Artificial Sequence; identical to SEQ ID NO: 14124
  derived and/or modified CDS sequence (AUadapt) from InfluenzaB__AGL09859__HA

SEQ ID NO: 14628 - RNA, 1758 nt, Artificial Sequence; identical to SEQ ID NO: 14124
  derived and/or modified CDS sequence (AUadapt) from InfluenzaB__AGL09860__HA

SEQ ID NO: 14629 - RNA, 1758 nt, Artificial Sequence; identical to SEQ ID NO: 14124
  derived and/or modified CDS sequence (AUadapt) from InfluenzaB__AGL09861__HA

SEQ ID NO: 14630 - RNA, 1758 nt, Artificial Sequence; identical to SEQ ID NO: 14124
  derived and/or modified CDS sequence (AUadapt) from InfluenzaB__AGL09862__HA

SEQ ID NO: 14631 - RNA, 1758 nt, Artificial Sequence; identical to SEQ ID NO: 14124
  derived and/or modified CDS sequence (AUadapt) from InfluenzaB__AGL09863__HA

SEQ ID NO: 14632 - RNA, 1755 nt, Artificial Sequence; identical to SEQ ID NO: 14116
  derived and/or modified CDS sequence (AUadapt) from InfluenzaB__AGL09864__HA

SEQ ID NO: 14633 - RNA, 1755 nt, Artificial Sequence; identical to SEQ ID NO: 14116
  derived and/or modified CDS sequence (AUadapt) from InfluenzaB__AGL09866__HA

SEQ ID NO: 14634 - RNA, 1755 nt, Artificial Sequence; identical to SEQ ID NO: 14116
  derived and/or modified CDS sequence (AUadapt) from InfluenzaB__AGL09867__HA

SEQ ID NO: 14635 - RNA, 1755 nt, Artificial Sequence; identical to SEQ ID NO: 14116
  derived and/or modified CDS sequence (AUadapt) from InfluenzaB__AGL09868__HA

SEQ ID NO: 14636 - RNA, 1755 nt, Artificial Sequence
  derived and/or modified CDS sequence (AUadapt) from InfluenzaB__AGL09869__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuauuucgccaaccugaaggggacgaagacccggggcaagcucugccccgacugccugaacugcaccgaccuggauguggcccucgggcgccccaugugcgugggcaccacgccguccgccaaggccucgauccugcacgagguccggcccgugaccuccggcugcuuccccaucaugcacgaccgcaccaagauccggcagcuggcgaaccuccugcgcggguaugagaacauccggcugagcacccagaacgugaucgacgccgagaaggcccccggcgggccguaccgccucggcacguccgggagcugccccaacaccaccuccaagaguggcuucuucgccaccauggcgugggccguccccaaggacaacaacaagaacgccacgaacccccugaccguggaggugccguacaucugugccgagggcgaggaccagaucaccgucuggggguuccacuccgacaacaagacccagaugaagaaccuguacggcgacaguaacccccagaaguucacguccagcgccaacggggugaccacccacuacgugucccagaucggcggcuuccccgaccagaccgaggaugggggccucccccagagcgggcggaucgucguggacuacaugaugcagaagccgggcaagacggggaccaucguguaccagcgcggcguccugcugccccagaagguguggugcgcguccggccggagcaaggugaucaaggggucgcucccccugaucggcgaggccgacugucugcacgagaaguacgggggccucaacaaguccaagcccuacuacaccggggagcacgccaaggccaucggcaacugcccgaucugggucaagacgccccugaagcuggccaauggcaccaaguaccgcccgcccgcgaagcuccugaaggagcggggguucuucggcgccaucgccggguuccuggagggcgggugggagggcaugaucgccggcuggcacggguacaccagccacggcgcccaugggguggcggucgccgccgaccucaaguccacccaggaggccaucaacaagaucaccaagaaccugaacagccuguccgagcucgaggugaagaaccugcagcgccugucgggcgccauggacgagcuccauaacgagauccuggagcuggacgagaagguggacgaccuccgggcggacacgaucuccagccagaucgagcuggccguccugcucuccaacgagggcaucaucaacagugaggacgagcaccuccuggcccuggagcgcaagcugaagaagaugcuggggcccuccgccguggacaucggcaacgggugcuucgagaccaagcacaagugcaaucagaccugccucgaccggaucgcggccggcaccuucaacgccggggaguucagccugcccaccuucgacucccugaauaucacggccgccucgcucaacgacgacggccuggacaaccacaccauccugcuguacuauuccaccgcggccagcucccucgccgugacccugaugcuggccaucuucaucgucuacauggugagccgcgacaacguguccugcagcaucugccucuga

SEQ ID NO: 14637 - RNA, 1755 nt, Artificial Sequence
  derived and/or modified CDS sequence (AUadapt) from InfluenzaB__AGL09870__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaaguccuacuucgccaaccugaaggggacgaagacccggggcaagcucugccccgacugccugaauugcaccgaccuggacguggcccucgggcgccccaugugcgugggcaccacgccguccgccaaggccagcauccugcacgagguccggcccgugaccuccggcuguuuccccaucaugcacgaccgcaccaagauccggcagcuggcgaaccuccugcgcggguacgagaacauccggcugagcacccagaaugugaucgacgccgagaaggcccccggcgggccguaccgccucggcacguccgggagcugccccaacgccaccuccaagagcggcuucuuugcgaccauggccugggccguccccaaggacaacaacaagaacgccaccaacccccugacgguggaggugccguacaucugugccgagggcgaggaccagaucaccgucuggggguuccacuccgacaacaagacccagaugaagaaccuguacggcgauucgaacccccagcgguucaccuccagcgcgaacggggugacgacccacuacgugucccagaucggcggcuuucccgaccagaccgaggacgggggccucccccagagcgggcgcaucgucguggacuacaugaugcagaagccgggcaagaccgggacgaucguguaccagcggggcguccugcugccccagaagguguggugugccuccggccgcagcaaggugaucaaggggagccucccccugaucggcgaggccgacugccugcacgagaaguacgggggccucaacaaguccaagcccuauuacaccggggagcacgccaaggccaucggcaacugcccgaucugggucaagacgccccugaagcuggcgaacggcaccaaguaccggccgcccgccaagcuccugaaggagcgcggguuuuucggcgccaucgccggguuccuggagggcgggugggagggcaugaucgccggcuggcacggguacaccagccacggcgcgcacgggguggccgucgccgccgaucucaaguccacccaggaggccaucaacaagaucaccaagaaccugaacagccuguccgagcucgaggugaagaaccugcagcggcugucgggcgcgauggacgagcuccauaacgagauccuggagcuggacgagaagguggacgaccuccgcgccgacaccaucuccagccagaucgagcuggccguccugcucuccaaugagggcaucaucaacagcgaggacgagcaccuccuggcccuggagcggaagcugaagaagaugcuggggcccuccgcgguggacaucggcaacgggugcuuugagacgaagcacaagugcaaccagaccugccucgaccgcaucgccgccggcaccuucaacgccggggaguuuagccugcccaccuucgacucccugaacaucaccgccgcgagccucaacgaugacggccuggacaaccacacgauccugcuguacuacuccaccgccgccagcucccucgccgugacccugaugcuggccaucuuuaucgucuacauggugagccgggacaacguguccugcagcaucugccucuga

SEQ ID NO: 14638 - RNA, 1755 nt, Artificial Sequence; identical to SEQ ID NO: 14116
  derived and/or modified CDS sequence (AUadapt) from InfluenzaB__AGL09871__HA

SEQ ID NO: 14639 - RNA, 1755 nt, Artificial Sequence
  derived and/or modified CDS sequence (AUadapt) from InfluenzaB__AGL09872__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgaagacccggggcaagcucugccccgacugccugaacuguaccgaccuggacguggcccucgggcgccccaugugcgugggcaccacgccguccgccaaggccagcauccugcacgagguccggcccgugaccuccggcugcuuccccaucaugcaugaccgcaccaagauccggcagcuggcgaaccuccugcgcggguacgagaacauccggcugagcacccagaacgugaucgacgccgagaaggcccccggcgggccguaucgccucggcacguccgggucgugccccaacgccaccuccaagagcggcuucuucgcgaccauggccugggccguccccaaggacaauaacaagaacgccaccaacccccugacgguggaggugccguacaucugcgccgagggcgaggaccagaucgcggucuggggguuccauuccgacaacaagacccagaugaagaaccuguacggcgacagcaacccccagaaguuuaccuccagcgccaacggggugaccacgcacuacgugucccagaucggcggcuuccccgaccagaccgaggacgggggccucccccagagugggcggaucgucguggacuacaugaugcagaagccgggcaagaccgggaccaucguguaccagcgcggcguccugcugccccagaagguguggugcgccuccggccggagcaaggugaucaaggggucgcucccccugaucggcgaggccgacugucugcacgagaaguacgggggccucaacaaguccaagcccuacuacacgggggagcacgccaaggcgaucggcaacuguccgaucugggucaagacgccccugaagcuggccaacggcaccaaguaccgcccgcccgccaagcuccugaaggagcggggguucuucggcgccaucgccggguuccuggagggcgggugggagggcaugaucgcgggcuggcacggguacaccagucacggcgcccacgggguggccgucgccgccgaccucaaguccacccaggaggcgaucaacaagaucaccaagaaccugaacagccuguccgagcucgaggugaagaaucugcagcgccugagcggcgccauggacgagcuccacaacgagauccuggagcuggacgagaagguggacgaccuccgggccgauaccaucuccagccagaucgagcuggccguccugcucuccaacgagggcaucaucaacucggaggacgagcaccuccuggcgcuggagcgcaagcugaagaagaugcuggggcccuccgccguggacaucggcaaugggugcuucgagaccaagcacaagugcaaccagacgugccucgaccggaucgccgccggcaccuuuaacgccggggaguucagccugcccaccuucgacucccugaacaucaccgcggccagccucaaugacgacggccuggacaaccacaccauccugcuguacuacuccacggccgccaguucccucgccgugacccugaugcuggcgaucuucaucgucuacauggugagccgcgacaacguguccugcagcaucugccucuga

SEQ ID NO: 14640 - RNA, 1755 nt, Artificial Sequence; identical to SEQ ID NO: 14116
  derived and/or modified CDS sequence (AUadapt) from InfluenzaB__AGL09873__HA

SEQ ID NO: 14641 - RNA, 1758 nt, Artificial Sequence; identical to SEQ ID NO: 14124
  derived and/or modified CDS sequence (AUadapt) from InfluenzaB__AGL09874__HA

SEQ ID NO: 14642 - RNA, 1758 nt, Artificial Sequence; identical to SEQ ID NO: 14612
  derived and/or modified CDS sequence (AUadapt) from InfluenzaB__AGO02695__HA

SEQ ID NO: 14643 - RNA, 1755 nt, Artificial Sequence; identical to SEQ ID NO: 14116
  derived and/or modified CDS sequence (AUadapt) from InfluenzaB__AGQ16249__HA

SEQ ID NO: 14644 - RNA, 1758 nt, Artificial Sequence; identical to SEQ ID NO: 14124
  derived and/or modified CDS sequence (AUadapt) from InfluenzaB__AGQ16250__HA

SEQ ID NO: 14645 - RNA, 1758 nt, Artificial Sequence; identical to SEQ ID NO: 14124
  derived and/or modified CDS sequence (AUadapt) from InfluenzaB__AGQ16251__HA

SEQ ID NO: 14646 - RNA, 1755 nt, Artificial Sequence
  derived and/or modified CDS sequence (AUadapt) from InfluenzaB__AGQ16252__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccgccaaguccuauuucgccaaccugaaggggacccggacgcgcggcaagcucugccccgacugccugaacugcaccgaccuggauguggcccucgggcggcccaugugcgugggcaccaccccguccgccaaggcgagcauccugcacgagguccgccccgugacguccggcugcuuccccaucaugcacgaccggaccaagauccgccagcugcccaaccuccugcggggguaugagaacauccgccugagcacccagaacgugaucgacgccgagaaggccccgggcgggcccuaccggcucggcaccuccgggucgugccccaacgccacguccaagaucggcuuuuucgcgaccauggccugggccguccccaaggacaacuacaagaacgccaccaacccgcugaccguggaggugcccuacaucugcaaggagggcgaggaucagaucacggucuggggguuccacagcgacaacaagacccagaugaagaaccuguacggcgacuccaauccccagaaguucaccagcuccgccaacggggugaccacgcacuacgugagccagaucggcgacuuccccgaucagaccgaggacggcgggcucccgcaguccggccgcaucgucguggacuacaugaugcagaagcccgggaagaccggcaccaucguguaccagcgcgggguccugcugccccagaagguguggugcgcgagcggccgguccaaggugaucaagggcucgcucccccugaucggggaggccgacugucugcacgaggaguacggcgggcucaacaagagcaagccguacuacacgggcaagcacgccaaggccaucgggaacugucccaucugggucaagacgccccugaagcuggccaacggcaccaaguaccggcccccggcgaagcuccugaaggagcgcggcuucuucggggccaucgccggcuuccuggagggcgggugggaggggaugaucgccggcuggcacggcuacaccucccacggggcccauggcguggcggucgccgccgaccucaagagcacccaggaggccaucaacaagaucaccaagaaccugaacucccugagcgagcucgaggugaagaaccugcagcggcuguccggggccauggacgagcuccauaacgagauccuggagcuggacgagaagguggacgaccuccgcgcggacaccaucagcucccagaucgagcuggccguccugcucucgaacgagggcaucaucaauuccgaggacgagcaccuccuggcccuggagcggaagcugaagaagaugcugggccccagcgccguggacaucgggaacggcugcuucgagaccaagcacaaguguaaccagacgugccucgaccgcaucgcggccgggaccuucaacgccggcgaguucucccugcccaccuucgacagucugaacaucaccgccgccucccucaacgacgacgggcuggacaaccacaccauccugcuguacuauagcacggcggccuccagccucgccgugacccugaugcuggccaucuucaucgucuacauggugucccgggacaacgugagcugcuccaucugccucuga

SEQ ID NO: 14647 - RNA, 1755 nt, Artificial Sequence; identical to SEQ ID NO: 14116
  derived and/or modified CDS sequence (AUadapt) from InfluenzaB__AGQ16253__HA

SEQ ID NO: 14648 - RNA, 1755 nt, Artificial Sequence
  derived and/or modified CDS sequence (AUadapt) from InfluenzaB__AGQ16255__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuauuucgccaaccugaaggggacgaagacccggggcaagcucugccccgacugccugaacugcaccgaccuggacguggcccucgggcgccccaugugugugggcaccacgccguccgccaaggccucgauccugcacgagguccggcccgugaccuccggcugcuuccccaucaugcacgaccgcaccaagauccggcagcuggcgaaccuccugcgcggguacgagaacauccggcugaguacccagaacgugaucgacgccgagaaggcccccggcgggccguaccgccucggcacguccgggagcugccccaacgccaccuccaagagcggcuucuuugcgaccauggccugggccguccccaaggacaacaacaagaacgccaccaacccccugacgguggaggugccguacaucugcgccgagggcgaggaccagaucaccgucuggggguuccauuccgacaacaagacccagaugaagaaccuguacggcgacucgaacccccagaaguucaccuccagcgcgaaugggaucacgacccacuacgugucccagaucggcggcuuccccgaccagaccgaggacgggggccucccccagagcgggcggaucguggucgacuacaugaugcagaagccgggcaagaccgggacgaucguguaucagcgcggcgugcugcugccccagaaggucuggugcgccuccggccggagcaaggugaucaaggggucgcucccccugaucggcgaggccgacugccugcacgagaaguacgggggccucaacaaguccaagcccuacuauaccggggagcacgccaaggccaucggcaacugcccgaucugggugaagacgccccugaagcuggcgaacggcaccaaguaccgcccgcccgccaagcuccugaaggagcggggguucuucggcgccaucgccggguuccuggagggcgggugggagggcaugaucgccggcuggcacggguauaccagccacggcgcgcacggggucgccguggccgccgaccucaaguccacccaggaggccaucaacaagaucaccaagaaccugaacagccuguccgagcucgaggucaagaaucugcagcgccugucgggcgcgauggacgagcuccacaacgagauccuggagcuggacgagaagguggacgaccuccgggccgacaccaucuccagccagaucgagcuggccgugcugcucuccaaugagggcaucaucaacagcgaggacgagcaccuccuggcccuggagcgcaagcugaagaagaugcuggggcccuccgcggucgacaucggcaacgggugcuucgagacgaagcacaaguguaaccagaccugccucgaccggaucgccgccggcaccuucaacgccggggaguucagccugcccaccuucgauucccugaacaucaccgccgcgucgcucaacgacgacggccuggacaaccacaucauccugcuguacuauuccacggccgccagcucccucgccgugacccugaugcuggccaucuucaucguguacauggucagccgcgacaacguguccugcagcaucugccucuga

SEQ ID NO: 14649 - RNA, 1755 nt, Artificial Sequence
  derived and/or modified CDS sequence (AUadapt) from InfluenzaB__AGQ16256__HA
augaaggccaucaucgugcugcucauggucgugaccaguaacgccgaccgcaucugcaccggcaucacguccagcaacagcccccacguggucaagaccgugacccagggggaggugaaugucaccggcgugaucccgcugacgaccacccccaccaaguccuacuucgcgaaccugaaggggacgaagacccggggcaagcucugccccgacugccugaacugcaccgaucuggacguggcccucgggcgccccaugugcgucggcaccacgccguccgccaaggccagcauccugcacgaggugcggcccgugaccuccggcugcuuccccaucaugcacgaucgcaccaagauccggcagcuggccaaccuccugcgcggguacgagaacauccggcugagcacccagaacgucaucgacgcggagaaggcccccggcgggccguaccgccucggcacguccgggucgugucccaacgccaccuccaagagcggcuucuucgccaccauggcgugggccgugcccaaggacuccaacaagaacgccaccaauccccugacgguggaggucccguacaucugcgccgagggcgaggaccagaucaccguguggggguuccacagcgacaacaagacccagaugaagaaucuguacggcgacuccaacccccagaaguucaccagcuccgccaacggggugacgacccacuaugucagccagaucggcggcuuccccgaccagaccgaggacgggggccucccccaguccgggcggaucgugguggacuacaugaugcagaagccgggcaagaccgggacgaucgucuaccagcgcggcgugcugcugccccagaagguguggugcgcgaguggccggucgaaggucaucaaggggucccucccccugaucggcgaggccgacugccugcacgagaaguacgggggccucaacaagagcaagcccuauuacaccggggagcacgccaaggccaucggcaacugcccgaucugggugaagacgccccugaagcuggccaacggcaccaaguaccgcccgcccgcgaagcuccugaaggagcggggguucuucggcgccaucgccggguuucuggagggcgggugggagggcaugaucgccggcuggcacggguacaccucccacggcgcccacggggucgcgguggccgccgaccucaagagcacccaggaggccaucaacaagaucaccaagaaucugaacucccugagcgagcucgaggugaagaaccugcagcgccuguccggcgccauggacgagcuccacaacgagauccuggagcuggacgagaaggucgacgaucuccgggcggacaccaucagcucccagaucgagcuggccgugcugcucagcaacgagggcaucaucaacuccgaggacgagcaccuccuggcccuggagcgcaagcugaagaagaugcuggggcccagugccguggacaucggcaacgggugcuucgagacgaagcacaagugcaaccagaccugccucgaucggaucgcggccggcaccuucaacgccggggaguucucccugcccaccuucgacagccugaacaucaccgccgccucccucaaugacgacggccuggacaaccacacgauccugcuguacuacagcaccgcggccuccagucucgccgucacccugaugcuggccaucuucaucguguacauggugucccgcgacaacgucagcugcagcaucugccucuga

SEQ ID NO: 14650 - RNA, 1755 nt, Artificial Sequence; identical to SEQ ID NO: 14116
  derived and/or modified CDS sequence (AUadapt) from InfluenzaB__AGQ16257__HA

SEQ ID NO: 14651 - RNA, 1755 nt, Artificial Sequence; identical to SEQ ID NO: 14116
  derived and/or modified CDS sequence (AUadapt) from InfluenzaB__AGQ16258__HA

SEQ ID NO: 14652 - RNA, 1755 nt, Artificial Sequence; identical to SEQ ID NO: 14116
  derived and/or modified CDS sequence (AUadapt) from InfluenzaB__AGQ16259__HA

SEQ ID NO: 14653 - RNA, 1755 nt, Artificial Sequence
  derived and/or modified CDS sequence (AUadapt) from InfluenzaB__AGQ16260__HA
augaagaccaucaucgugcugcucauggucgugaccaguaacgccgaccgcaucugcacgggcaucaccuccagcaacagcccccacguggucaagaccgccacccagggggaggugaacgugacgggcgucaucccgcugaccaccacccccaccaaguccuauuucgcgaaccugaaggggaccaagacccggggcaagcucugccccgacugccugaacugcaccgaccuggauguggcccucgggcgccccaugugcgugggcacgaccccguccgccaaggccucgauccugcacgagguccggcccgugaccuccggcugcuuccccaucaugcacgaccgcaccaagauccggcagcuggccaaccuccugcgcggguaugagaacauccggcugagcucccagaacgugaucgacgcggagaaggcccccggcgggccguaccgccucggcacgagcggguccugccccaacgccaccaguaaguccggcuucuucgccaccauggcgugggccguccccaaggacaacaacaagaacgccaccaacccccugacgguggaggugccguacaucugugccgagggcgaggaccagaucaccgucuggggguuccacucggacaacaagacccagaugaagaaccuguacggcgauuccaacccccagaaguucaccagcuccgccaacggggugacgacccacuacgugagccagaucggcggcuuccccgaucagaccgaggacgggggccucccccaguccgggcggaucgucguggacuacaugaugcagaagccgggcaagaccgggacgaucguguaccagcgcggcguccugcugccccagaagguguggugcgcgagcggccggucgaaggugaucaaggggucccucccccugaucggcgaggccgacugccugcaugagaaguacgggggccucaacaagagcaagcccuacuacaccggggagcacgccaaggccaucggcaacugcccgaucugggucaagacgccccugaagcuggccaauggcaccaaguaccgcccgcccgcgaagcuccugaaggagcggggguucuucggcgccaucgccggguuccuggagggcgggugggagggcaugaucgccggcuggcacggguacacgucccacggcgcccacgggguggcggucgccgccgaucucaagagcacccaggaggccaucaacaagaucaccaagaaccugaacucccugagcgagcucgaggugaagaaccugcagcgccuguccggcgccauggacgagcuccacaaugagauccuggagcuggacgagaagguggacgaccuccgggcggacaccaucucgucccagaucgagcuggccguccugcucagcaacgagggcaucaucaacuccgaggaugagcaccuccuggcccuggagcgcaagcugaagaagaugcuggggcccagcgccguggacaucggcaacgggugcuucgagacgaagcacaagugcaaucagaccugccucgaccggaucgcggccggcaccuucaacgccggggaguucucccugcccaccuucgacagccugaauaucaccgccgccucccucaacgacgacggccuggacaaccacacgauccugcuguacuacaguaccgcggccuccagccucgccgugacccugaugcuggccaucuucaucgucuacauggugucccgcgacaacgugagcugcagcaucugccucuga

SEQ ID NO: 14654 - RNA, 1755 nt, Artificial Sequence; identical to SEQ ID NO: 14116
  derived and/or modified CDS sequence (AUadapt) from InfluenzaB__AGQ16261__HA

SEQ ID NO: 14655 - RNA, 1755 nt, Artificial Sequence; identical to SEQ ID NO: 14116
  derived and/or modified CDS sequence (AUadapt) from InfluenzaB__AGQ16262__HA

SEQ ID NO: 14656 - RNA, 1758 nt, Artificial Sequence; identical to SEQ ID NO: 14124
  derived and/or modified CDS sequence (AUadapt) from InfluenzaB__AGQ16263__HA

SEQ ID NO: 14657 - RNA, 1758 nt, Artificial Sequence; identical to SEQ ID NO: 14124
  derived and/or modified CDS sequence (AUadapt) from InfluenzaB__AGQ16264__HA

SEQ ID NO: 14658 - RNA, 1755 nt, Artificial Sequence; identical to SEQ ID NO: 14639
  derived and/or modified CDS sequence (AUadapt) from InfluenzaB__AGQ16265__HA

SEQ ID NO: 14659 - RNA, 1755 nt, Artificial Sequence
  derived and/or modified CDS sequence (AUadapt) from InfluenzaB__AGQ16266__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgaagacccggggcaagcucugccccgacugccugaacuguaccgaccuggacguggcccucgggcgccccaugugcgugggcaccacgccguccgccaaggccagcauccugcacgagguccggcccgugaccuccggcugcuuccccaucaugcaugaccgcaccaagauccggcagcuggcgaaccuccugcgcggguacgagaacauccggcugagcacccagaacgugaucgacgccgagaaggcccccggcgggccguaucgccucggcacguccgggucgugccccaacgccaccuccaagagcggcuucuucgcgaccauggccugggccguccccaaggacaauaacaagaacgccaccaacccccugacgguggaggugccguacaucugcgccgagggcgaggaccagaucaccgucuggggguuccauuccgacaacaagacccagaugaagaaccuguacggcgacagcaacccccagaaguuuaccuccagcgcgaacggggugacgacccacuacgugucccaggucggcggcuuccccgaccagaccgaggacgggggccucccccagagugggcggaucgugguggacuacaugaugcagaagccgggcaagaccgggacgaucgucuaccagcgcggcgugcugcugccccagaagguguggugcgccuccggccggagcaaggucaucaaggggucgcucccccugaucggcgaggccgacugucugcacgagaaguacgggggccucaacaaguccaagcccuacuacaccggggagcacgccaaggccaucggcaacuguccgaucugggugaagacgccccugaagcuggcgaacggcaccaaguaccgcccgcccgccaagcuccugaaggagcggggguucuucggcgccaucgccggguuccuggagggcgggugggagggcaugaucgccggcuggcacggguacaccagucacggcgcgcacggggucgccguggccgccgaccucaaguccacccaggaggccaucaacaagaucaccaagaaccugaacagccuguccgagcucgaggugaagaaucugcagcgccugagcggcgcgauggacgagcuccacaacgagauccuggagcuggacgagaaggucgacgaccuccgggccgauaccaucuccagccagaucgagcuggccgugcugcucuccaacgagggcaucaucaacucggaggacgagcaccuccuggcccuggagcgcaagcugaagaagaugcuggggcccuccgcgguggacaucggcaaugggugcuucgagacgaagcacaagugcaaccagaccugccucgaccggaucgccgccggcaccuuuaacgccggggaguucagccugcccaccuucgacucccugaacaucaccgccgcgagccucaaugacgacggccuggacaaccacacgauccugcuguacuacuccaccgccgccaguucccucgccgucacccugaugcuggccaucuucaucguguacauggugagccgcgacaacgucuccugcagcaucugccucuga

SEQ ID NO: 14660 - RNA, 1755 nt, Artificial Sequence; identical to SEQ ID NO: 14639
  derived and/or modified CDS sequence (AUadapt) from InfluenzaB__AGQ16267__HA

SEQ ID NO: 14661 - RNA, 1755 nt, Artificial Sequence; identical to SEQ ID NO: 14639
  derived and/or modified CDS sequence (AUadapt) from InfluenzaB__AGQ16268__HA

SEQ ID NO: 14662 - RNA, 1758 nt, Artificial Sequence; identical to SEQ ID NO: 14612
  derived and/or modified CDS sequence (AUadapt) from InfluenzaB__AGQ16269__HA

SEQ ID NO: 14663 - RNA, 1755 nt, Artificial Sequence; identical to SEQ ID NO: 14639
  derived and/or modified CDS sequence (AUadapt) from InfluenzaB__AGQ16270__HA

SEQ ID NO: 14664 - RNA, 1755 nt, Artificial Sequence
  derived and/or modified CDS sequence (AUadapt) from InfluenzaB__AGQ16272__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgaagacccggggcaagcucugccccgacugccugaacuguaccgaccuggacguggcccucgggcgccccaugugcgugggcaccacgccguccgccaaggccagcauccugcacgagguccggcccgugaccuccggcugcuuccccaucaugcaugaccgcaccaagauccggcagcuggcgaaccuccugcgcggguacgagaacauccggcugagcacccagaacgugaucgacgccgagaaggcccccggcgggccguaucgccucggcacguccgggucgugccccaacgccaccuccaagagcggcuucuucgcgaccauggccugggccgucccccgggacaauaacaagaacgccaccaacccccugacgguggaggugccguacaucugcgaggagggcgaggaccagaucaccgucuggggguuccauuccgacaacaagacccagaugaagaaccuguacggcgacagcaacccccagaaguuuaccuccagcgccaacggggugacgacccacuacgugucccagaucggcggcuuccccgaccagaccgaggacgggggccucccccagagugggcgcaucgucguggacuacaugaugcagaagccgggcaagaccgggacgaucguguaccagcggggcguccugcugccccagaagguguggugcgcguccggccgcagcaaggugaucaaggggucgcucccccugaucggcgaggccgacugucugcacgagaaguacgggggccucaacaaguccaagcccuacuacaccggggagcacgccaaggccaucggcaacuguccgaucugggucaagacgccccugaagcuggccaacggcaccaaguaccggccgcccgcgaagcuccugaaggagcgcggguucuucggcgccaucgccggguuccuggagggcgggugggagggcaugaucgccggcuggcacggguacaccagucacggcgcccacgggguggcggucgccgccgaccucaaguccacccaggaggccaucaacaagaucaccaagaaccugaacagccuguccgagcucgaggugaagaaucugcagcggcugagcggcgccauggacgagcuccacaacgagauccuggagcuggacgagaagguggacgaccuccgcgcggauaccaucuccagccagaucgagcuggccguccugcucuccaacgagggcaucaucaacucggaggacgagcaccuccuggcccuggagcggaagcugaagaagaugcuggggcccuccgccguggacaucggcaaugggugcuucgagacgaagcacaagugcaaccagaccugccucgaccgcaucgcggccggcaccuuuaacgccggggaguucagccugcccaccuucgacucccugaacaucaccgccgccagccucaaugacgacggccuggacaaccacacgauccugcuguacuacuccaccgcggccaguucccucgccgugacccugaugcuggccaucuucaucgucuacauggugagccgggacaacguguccugcagcaucugccucuga

SEQ ID NO: 14665 - RNA, 1755 nt, Artificial Sequence; identical to SEQ ID NO: 14116
  derived and/or modified CDS sequence (AUadapt) from InfluenzaB__AGQ16273__HA

SEQ ID NO: 14666 - RNA, 1755 nt, Artificial Sequence; identical to SEQ ID NO: 14116
  derived and/or modified CDS sequence (AUadapt) from InfluenzaB__AGQ16274__HA

SEQ ID NO: 14667 - RNA, 1755 nt, Artificial Sequence; identical to SEQ ID NO: 14116
  derived and/or modified CDS sequence (AUadapt) from InfluenzaB__AGQ16275__HA

SEQ ID NO: 14668 - RNA, 1755 nt, Artificial Sequence; identical to SEQ ID NO: 14116
  derived and/or modified CDS sequence (AUadapt) from InfluenzaB__AGQ16276__HA

SEQ ID NO: 14669 - RNA, 1755 nt, Artificial Sequence; identical to SEQ ID NO: 14639
  derived and/or modified CDS sequence (AUadapt) from InfluenzaB__AGQ16277__HA

SEQ ID NO: 14670 - RNA, 1755 nt, Artificial Sequence; identical to SEQ ID NO: 14639
  derived and/or modified CDS sequence (AUadapt) from InfluenzaB__AGQ16278__HA

SEQ ID NO: 14671 - RNA, 1755 nt, Artificial Sequence; identical to SEQ ID NO: 14639
  derived and/or modified CDS sequence (AUadapt) from InfluenzaB__AGQ16279__HA

SEQ ID NO: 14672 - RNA, 1755 nt, Artificial Sequence; identical to SEQ ID NO: 14639
  derived and/or modified CDS sequence (AUadapt) from InfluenzaB__AGQ16280__HA

SEQ ID NO: 14673 - RNA, 1755 nt, Artificial Sequence
  derived and/or modified CDS sequence (AUadapt) from InfluenzaB__AGQ16281__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuauuucgccaaccugaaggggacgaagacccggggcaagcucugccccgacugccugaacugcaccgaccuggauguggcccucgggcgccccaugugcgugggcaccacgccguccgccaaggccucgauccugcacgagguccggcccgugaccuccggcugcuuccccaucaugcacgaccgcaccaagauccggcagcuggcgaaccuccugcgcggguaugagaacauccggcugagcacccagaacgugaucgacgccgagaaggcccccggcgggccguaccgccucggcacguccgggagcugccccaacgccaccuccaagaguggcuucuucgcgaccauggccugggccguccccaaggacaacaacaagaacgccaccaacccccugacgguggaggugccguacaucugugccgagggcgaggaccagaucaccgucuggggguuccacuccgacaacaagacccagaugaagaaccuguacggcgacaguaacccccagaaguucaccuccagcgcgaacggggugacgacccacuacgugucccagaucggcagcuuccccgaucagaccgaggacggcgggcucccccaguccggccggaucgucguggacuacaugaugcagaagccggggaagaccggcacgaucguguaccagcgcgggguccugcugccccagaagguguggugcgccagcggccggucgaaggugaucaagggcucccucccccugaucggggaggccgacugccugcaugagaaguacggcgggcucaacaagagcaagcccuacuacaccggcgagcacgccaaggccaucgggaacugcccgaucugggucaagacgccccugaagcuggcgaauggcaccaaguaccgcccgcccgccaagcuccugaaggagcggggcuucuucggggccaucgccggcuuccuggagggcgggugggaggggaugaucgccggcuggcacggcuacaccucccacggggcgcacggcguggccgucgccgccgaucucaagagcacccaggaggccaucaacaagaucaccaagaaccugaacucccugagcgagcucgaggugaagaaccugcagcgccuguccggggcgauggacgagcuccacaaugagauccuggagcuggacgagaagguggacgaccuccgggccgacaccaucucgucccagaucgagcuggccguccugcucagcaacgagggcaucaucaacuccgaggaugagcaccuccuggcccuggagcgcaagcugaagaagaugcugggccccagcgcgguggacaucgggaacggcugcuucgagacgaagcacaagugcaaucagaccugccucgaccggaucgccgccgggaccuucaacgccggcgaguucucccugcccaccuucgacagccugaauaucaccgccgcgucccucaacgacgacgggcuggacaaccacacgauccugcuguacuacaguaccgccgccuccagccucgccgugacccugaugcuggccaucuucaucgucuacauggugucccgcgacaacgugagcugcagcaucugccucuga

SEQ ID NO: 14674 - RNA, 1755 nt, Artificial Sequence
  derived and/or modified CDS sequence (AUadapt) from InfluenzaB__AGQ16282__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaaguccuacuucgccaaccugaaggggacgaagacccggggcaagcucugccccgacugucugaacugcaccgaccuggacguggcccucgggcgccccaugugcgugggcaccacgccguccgccaaggccagcauccugcaugagguccggcccgugaccuccggcugcuuccccaucaugcacgaccgcaccaagauccggcagcuggcgaaccuccugcgcggguacgagaauauccggcugagcacccagaacgugaucgacgccgagaaggcccccggcgggccguaccgccucggcacguccgggagcugccccaacgccaccuccaagaguggcuucuucgcgaccauggccugggccguccccaagggcaacaacaagaacgccaccaacccccugacgguggaggugccguauaucugcgccgagggggaggaccagaucaccgucuggggcuuccacuccgacaacaagacccagaugaagaaucuguacggggacagcaacccccagcgguucaccuccagcgcgaauggcgugacgacccacuacgugucccagaucggcggguuccccgaccagaccgaggacggcgggcucccccagagcggccgcaucgucguggauuacaugaugcagaagccggggaagaccggcacgaucguguaccagcggggcguccugcugccccagaagguguggugcgccuccgggcgcagcaaggugaucaagggcucgcucccccugaucggggaggccgacugccugcaugagaaguacggcgggcucaacaaguccaagcccuacuacaccggcgagcacgccaaggccaucggcaacuguccgaucugggucaagacgccccugaagcuggcgaacgggaccaaguaccggccgcccgccaagcuccugaaggagcgcggcuucuucggggccaucgccggcuuccuggagggcgggugggagggcaugaucgccggguggcacggcuauaccagccacggggcgcacggcguggccgucgccgccgaccucaaguccacccaggaggccaucaacaagaucaccaagaaccugaauagccuguccgagcucgaggugaagaaccugcagcggcugagcggcgcgauggacgagcuccacaacgagauccuggagcuggaugagaagguggacgaccuccgcgccgacaccaucuccagccagaucgagcuggccguccugcucuccaacgaggggaucaucaacagcgaggaugagcaccuccuggcccuggagcggaagcugaagaagaugcugggccccuccgcgguggacaucgggaacggcugcuucgagacgaagcacaaguguaaccagaccugccucgaccgcaucgccgccgggaccuucaacgccggcgaguucagucugcccaccuucgacucccugaacaucaccgccgcgagccucaacgacgauggccuggacaaccacacgauccugcuguacuacuccaccgccgccagcucccucgccgugacccugaugcuggccaucuuuaucgucuacauggugagccgggacaacguguccugcagcaucugccucuga

SEQ ID NO: 14675 - RNA, 1755 nt, Artificial Sequence
  derived and/or modified CDS sequence (AUadapt) from InfluenzaB__AGQ16283__HA
augaaggccaucaucgugcugcucauggucgugaccaguaacgccgaccgcaucugcaccggcaucacguccagcaacagcccccacguggucaagaccgcgacccauggggaggugaacgugaccggcgucaucccgcugacgaccacccccaccaaguccuacuucgccaaccugaaggggacgaagacccggggcaagcucugccccgacugccugaauugcaccgaccuggacguggcccucgggcgccccaugugcgugggcaccacgccguccgccaaggccagcauccugcacgagguccggcccgugaccuccggcugcuuucccaucaugcacgaccgcaccaagauccggcagcuggcgaaccuccugcgcggguacgagaacauccggcugagcacccagaacgugaucgaugccgagaaggcccccggcgggccguaccgccucggcacguccgggucgugccccaacgccaccuccaagagcggcuucuucgcgaccauggccugggccguccccaaggauaacaacaagaacgccaccaacccccugacgguggaggugccguacaucugcgccgagggcgaggaccagaucgcggucuggggguuucacuccgacaacaagacccagaugaagaaccuguacggcgacagcaauccccagaaguucaccuccagcgccaacggggugaccacgcacuacgugucccagaucggcggcuuccccgaccagaccgaggaugggggccucccccagagcgggcggaucgucguggacuacaugaugcagaagccgggcaagaccgggaccaucguguaccagcgcggcguccugcugccccagaagguguggugcgccuccggccggagcaaggugaucaaggggucgcucccccugaucggcgaggccgacugucugcacgagaaguacgggggccucaacaaguccaagcccuacuacacgggggagcacgccaaggcgaucggcaacuguccgaucugggucaagacgccccugaagcuggccaacggcaccaaguaccgcccgcccgccaagcuccugaaggagcggggguucuucggcgccaucgccggguuccuggagggcgggugggagggcaugaucgcgggcuggcacggguacaccagucacggcgcccacgggguggccgucgccgccgaccucaaguccacccaggaggcgaucaacaagaucaccaagaaccugaacagccuguccgagcucgaggugaagaaucugcagcgccugagcggcgccauggacgagcuccacaacgagauccuggagcuggacgagaagguggacgaccuccgggccgauaccaucuccagccagaucgagcuggccguccugcucuccaacgagggcaucaucaacucggaggacgagcaccuccuggcgcuggagcgcaagcugaagaagaugcuggggcccuccgccguggacaucggcaaugggugcuucgagaccaagcacaagugcaaccagacgugccucgaccggaucgccgccggcaccuuuaacgccggggaguucagccugcccaccuucgacucccugaacaucaccgcggccagccucaaugacgacggccuggacaaccacaccauccugcuguacuacuccacggccgccaguucccucgccgugacccugaugcuggcgaucuucaucgucuacauggugagccgcgacaacguguccugcagcaucugccucuga

SEQ ID NO: 14676 - RNA, 1758 nt, Artificial Sequence
  derived and/or modified CDS sequence (AUadapt) from InfluenzaB__AGQ16284__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugucccaagugccugaacugcaccgaccuggacguggcccucgggcgccccaagugcaccggcaagaucccguccgcccgggugucgauccugcacgaggcccgccccgucacguccggcugcuuccccaucaugcacgaccggaccaagauccgccagcugcccaaucuccugcggggguacgagcacaucaagcugagcacccacaacgugaucaacgcggagaacgccccgggcgggcccuacaagaucggcaccuccgggucgugccccaacgugacgaacggcaauggcuucuucgccaccauggccugggcgguccccaagaacgacaagaacaagaccgccaccaacccgcucacgaucgaggugcccuacaucugcaccgagggggaggaccagaucaccguguggggcuuccacuccgacaaugagacccagauggccaagcuguacggggacagcaagccccagaaguucacguccucggccaacggcgucaccacccacuacgugucccagaucggcggguuccccaaccagaccgaggacggcgggcugccgcagucgggccgcaucguggucgauuacauggugcagaaguccgggaagacgggcaccaucaccuaccagcggggcauccuccugccccagaagguguggugcgccagcgggcgcuccaaggucaucaagggcucgcugccccucaucggggaggcggacugccugcacgagaaguacggcgggcugaacaagucgaagcccuacuauaccggcgagcacgccaaggccaucggcaacugcccgaucugggugaagacgccccucaagcuggccaacgggaccaaguaccggccgcccgccaagcugcucaaggagcgcggcuucuucggggcgaucgccggcuuccuggagggcgggugggagggcaugaucgccggguggcacggcuacaccucccacggggcccacggcguggccgucgcggccgaucugaaguccacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucaguucccagaucgagcucgcggugcugcugagcaacgaggggaucaucaacuccgaggacgagcaccuccuggcccuggagcggaagcucaagaagaugcugggccccucggccguggagaucgggaacggcugcuucgagaccaagcacaagugcaaccagaccugucuggaccgcaucgccgcggggaccuucgacgccggcgaguucucccuccccacguucgacucgcugaacaucaccgccgccucccugaacgacgacggccucgacaaucacaccauccugcuguacuacagcaccgccgcguccucgcuggccgucacgcucaugaucgccaucuucgugguguacauggucucccgggacaacgugagcugcuccaucugccuguga

SEQ ID NO: 14677 - RNA, 1755 nt, Artificial Sequence; identical to SEQ ID NO: 14639
  derived and/or modified CDS sequence (AUadapt) from InfluenzaB__AGQ16285__HA

SEQ ID NO: 14678 - RNA, 1755 nt, Artificial Sequence; identical to SEQ ID NO: 14639
  derived and/or modified CDS sequence (AUadapt) from InfluenzaB__AGQ16286__HA

SEQ ID NO: 14679 - RNA, 1755 nt, Artificial Sequence
  derived and/or modified CDS sequence (AUadapt) from InfluenzaB__AGQ16287__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuauuucgccaaccugaaggggacgaagacccggggcaagcucugccccgacugccugaacugcaccgaccuggauguggcccucgggcgccccaugugcgugggcaccacgccguccgccaaggccucgauccugcacgagguccggcccgugaccuccggcugcuuccccaucaugcacgaccgcaccaagauccggcagcuggcgaaccuccugcgcggguaugagaacauccggcugagcacccagaacgugaucgacgccgagaaggcccccggcgggccguaccgccucggcacguccgggagcugccccaacgccaccuccaagaguggcuucuucgcgaccauggccugggccguccccaaggacaacaacaagaacgccaccaacccccugacgguggaggugccguacaucugugaggagggcgaggaccagaucaccgucuggggguuccacuccgacaacaagacccagaugaagaaccuguacggcgacaguaacccccagaaguucaccuccagcgccaacggggugacgacccacuacgugucccagaucggcggcuuccccgaccagaccgaggaugggggccucccccagagcgggcggaucgucguggacuacaugaugcagaagccgggcaagaccgggacgaucguguaccagcgcggcguccugcugccccagaagguguggugcgcguccggccggagcaaggugaucaaggggucgcucccccugaucggcgaggccgacugucugcacgagaaguacgggggccucaacaaguccaagcccuacuacaccggggagcacgccaaggccaucggcaacugcccgaucugggucaagacgccccugaagcuggccaauggcaccaaguaccgcccgcccgcgaagcuccugaaggagcggggguucuucggcgccaucgccggguuccuggagggcgggugggagggcaugaucgccggcuggcacggguacaccagccacggcgcccaugggguggcggucgccgccgaccucaaguccacccaggaggccaucaacaagaucaccaagaaccugaacagccuguccgagcucgaggugaagaaccugcagcgccugucgggcgccauggacgagcuccauaacgagauccuggagcuggacgagaagguggacgaccuccgggcggacaccaucuccagccagaucgagcuggccguccugcucuccaacgagggcaucaucaacagugaggacgagcaccuccuggcccuggagcgcaagcugaagaagaugcuggggcccuccgccguggacaucggcaacgggugcuucgagacgaagcacaagugcaaucagaccugccucgaccggaucgcggccggcaccuucaacgccggggaguucagccugcccaccuucgacucccugaauaucaccgccgccucgcucaacgacgacggccuggacaaccacacgauccugcuguacuauuccaccgcggccagcucccucgccgugacccugaugcuggccaucuucaucgucuacauggugagccgcgacaacguguccugcagcaucugccucuga

SEQ ID NO: 14680 - RNA, 1755 nt, Artificial Sequence; identical to SEQ ID NO: 14116
  derived and/or modified CDS sequence (AUadapt) from InfluenzaB__AGQ16289__HA

SEQ ID NO: 14681 - RNA, 1755 nt, Artificial Sequence; identical to SEQ ID NO: 14116
  derived and/or modified CDS sequence (AUadapt) from InfluenzaB__AGQ16290__HA

SEQ ID NO: 14682 - RNA, 1755 nt, Artificial Sequence
  derived and/or modified CDS sequence (AUadapt) from InfluenzaB__AGQ16291__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgaagacccggggcaagcucugccccgacugccugaacugcaccgaucuggacguggcccucgggcgccccaugugcgugggcaccacgccguccgccaaggccagcauccugcacgagguccggcccgugaccuccggcugcuuccccaucaugcacgaucgcaccaagauccggcagcuggcgaaccuccugcgcggguacgagaacauccggcugucgacccagaacgugaucgacgccgagaaggcccccggcgggccguaccgccucggcacguccgggagcugucccaacaccaccuccaagagcggcuucuucgccaccauggcgugggccguccccaaggacaacaacaagaaugccacgaacccccugaccguggaggugccguacaucugcgccgagggcgaggaccagaucgccgucuggggguuccacuccgacaacaagacccagaugaagaaucuguacggcgacagcaacccccagaaguucaccuccucggcgaacggggugacgacccauuacgugucccagaucggcggcuuccccgaccagaccgaggacgggggccucccccagagcgggcggaucgucguggacuacaugaugcagaagccgggcaagaccgggacgaucguguaccagcgcggcguccugcugccccagaagguguggugugccuccggccggagcaaggugaucaaggggagccucccccugaucggcgaggccgacugccugcacgagaaguacgggggccucaacaaguccaagcccuauuacaccggggagcacgccaaggccaucggcaacugcccgaucugggucaagacgccccugaagcuggcgaacggcaccaaguaccgcccgcccgccaagcuccugaaggagcggggguucuucggcgccaucgccggguuucuggagggcgggugggagggcaugaucgccggcuggcacggguacaccagccacggcgcgcacgggguggccgucgccgccgaccucaaguccacccaggaggccaucaacaagaucaccaagaaucugaacucgcuguccgagcucgaggugaagaaccugcagcgccugagcggcgcgauggacgagcuccacaacgagauccuggagcuggacgagaagguggaugaccuccgggccgacaccaucuccagccagaucgagcuggccguccugcucuccaacgagggcaucaucaacagcgaggacgagcaucuccuggcccuggagcgcaagcugaagaagaugcuggggcccuccgcgguggacaucggcaacgggugcuucgagacgaagcacaagugcaaccagaccugccucgaucggaucgccgccggcaccuucaacgccggggaguucucgcugcccaccuucgacucccugaacaucaccgccgcgagucucaacgacgacggccuggacaaccacacgauccugcuguacuacuccaccgccgccaguucccucgccgugacccugaugcuggccaucuucaucgucuacauggugagccgcgacaacguguccugcagcaucugccucuga

SEQ ID NO: 14683 - RNA, 1755 nt, Artificial Sequence
  derived and/or modified CDS sequence (AUadapt) from InfluenzaB__AGQ16292__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgaagacccggggcaagcucugccccgacugccugaacugcaccgaucuggacguggcccucgggcgccccaugugcgugggcaccacgccguccgccaaggccagcauccugcacgagguccggcccgugaccuccggcugcuuccccaucaugcacgaucgcaccaagauccggcagcuggcgaaccuccugcgcggguacgagaacauccggcugucgacccagaacgugaucgacgccgagaaggcccccggcgggccguaccgccucggcacguccgggagcugucccaacgccaccuccaagagcggcuucuucgcgaccauggccugggccguccccaaggacaacaacaagaaugccaccaacccccugacgguggaggugccguacaucugcgccgagggcgaggaccagaucgcggucuggggguuccacuccgacaacaagacccagaugaagaaucuguacggcgacagcaacccccagaaguucaccuccucggccaacggggugaccacgcauuacgugucccagaucggcggcuuccccgaccagaccgaggacgggggccucccccagagcgggcggaucgucguggacuacaugaugcagaagccgggcaagaccgggaccaucguguaccagcgcggcguccugcugccccagaagguguggugugccuccggccggagcaaggugaucaaggggagccucccccugaucggcgaggccgacugccugcacgagaaguacgggggccucaacaaguccaagcccuauuacacgggggagcacgccaaggcgaucggcaacugcccgaucugggucaagacgccccugaagcuggccaacggcaccaaguaccgcccgcccgccaagcuccugaaggagcggggguucuucggcgccaucgccggguuucuggagggcgggugggagggcaugaucgcgggcuggcacggguacaccagccacggcgcccacgggguggccgucgccgccgaccucaaguccacccaggaggcgaucaacaagaucaccaagaaucugaacucgcuguccgagcucgagaucaagaaccugcagcgccugagcggcgccauggacgagcuccacaacgagauccuggagcuggacgagaagguggaugaccuccgggccgacaccaucuccagccagaucgagcuggccgugcugcucuccaacgagggcaucaucaacagcgaggacgagcaucuccuggcgcuggagcgcaagcugaagaagaugcuggggcccuccgccgucgacaucggcaacgggugcuucgagaccaagcacaagugcaaccagacgugccucgaucggaucgccgccggcaccuucaacgccggggaguucucgcugcccaccuucgacucccugaacaucaccgcggccagucucaacgacgacggccuggacaaccacaccauccugcuguacuacuccacggccgccaguucccucgccgugacccugaugcuggcgaucuucaucguguacauggucagccgcgacaacguguccugcagcaucugccucuga

SEQ ID NO: 14684 - RNA, 1755 nt, Artificial Sequence; identical to SEQ ID NO: 14683
  derived and/or modified CDS sequence (AUadapt) from InfluenzaB__AGQ16293__HA

SEQ ID NO: 14685 - RNA, 1755 nt, Artificial Sequence; identical to SEQ ID NO: 14683
  derived and/or modified CDS sequence (AUadapt) from InfluenzaB__AGQ16294__HA

SEQ ID NO: 14686 - RNA, 1758 nt, Artificial Sequence
  derived and/or modified CDS sequence (AUadapt) from InfluenzaB__AGQ16295__HA
augaaggccaucaucgugcugcucauggucgugaccaguaacgccgaccgcaucugcaccggcaucacguccucgaacagcccccacguggucaagaccgcgacccagggggaggugaacgugaccggcgccaucccgcugacgaccacccccaccaagucgcacuucgccaaccugaaggggacggagacccggggcaagcucugucccaagugccugaacugcaccgaccuggacgucgcccucgggcgccccaagugcaccggcaagaucccguccgcccgggugucgauccugcacgaggugcgccccgucacguccggcugcuuccccaucaugcacgaccggaccaagauccgccagcugcccaaucuccugcggggguacgagcacauccgccugagcacccacaacgugaucaacgcggagaacgccccgggcgggcccuacaagaucggcaccuccgggucgugccccaacgugacgaacggcaauggcuucuucgccaccauggccugggcgguccccaagaacgacaagaacaagaccgagaccaacccgcucacgaucgaggugcccuacaucugcaccgaggaggaggaccagaucaccguguggggguuccacuccgacaaugagacccagauggccaagcuguacggcgacagcaagccccagaaguucacguccucggccaacggggucaccacccacuacgugucccagaucggcggcuuccccaaccagaccgaggacgggggccugccgcagucggggcggaucguggucgauuacauggugcagaaguccggcaagacggggaccaucaccuaccagcgcggcauccuccugccccagaagguguggugcgccagcggccgguccaaggucaucaaggggucgcugccccucaucggcgaggccgacugccugcacgagaaguacgggggccugaacaagucgaagcccuacuauaccggggagcacgcgaaggccaucggcaacugcccgaucugggugaagacgccccucaagcuggccaacggcaccaaguaccgcccgcccgccaagcugcucaaggagcggggguucuucggcgccaucgcgggguuccuggagggcgggugggagggcaugaucgccggcuggcacggguacaccucccacggcgcccacgggguggccgucgccgcggaucugaaguccacccaggaggccaucaacaagaucacgaagaaccucaacucccugagcgagcuggaggugaagaaccuccagcgccuguccggcgccauggacgagcugcacaacgagauccucgagcuggacgagaaggucgacgaccugcgggccgacaccaucaguucccagaucgagcucgccgugcugcugagcaacgagggcaucaucaacuccgaggacgagcaccuccuggcgcuggagcgcaagcucaagaagaugcuggggcccucggccguggagaucggcaacgggugcuucgagaccaagcacaagugcaaccagaccugucuggaccggaucgccgccggcaccuucgacgcgggggaguucucccuccccacguucgacucgcugaacaucaccgccgccucccugaacgacgacggccucgacaaucacaccauccugcuguacuacagcaccgccgccuccucgcuggcggucacgcucaugaucgccaucuucgugguguacauggucucccgcgacaacgugagcugcuccaucugccuguga

SEQ ID NO: 14687 - RNA, 1758 nt, Artificial Sequence; identical to SEQ ID NO: 14124
  derived and/or modified CDS sequence (AUadapt) from InfluenzaB__AGQ16296__HA

SEQ ID NO: 14688 - RNA, 1755 nt, Artificial Sequence; identical to SEQ ID NO: 14116
  derived and/or modified CDS sequence (AUadapt) from InfluenzaB__AGQ16297__HA

SEQ ID NO: 14689 - RNA, 1755 nt, Artificial Sequence
  derived and/or modified CDS sequence (AUadapt) from InfluenzaB__AGQ16298__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuauuucgccaaccugaaggggacgaagacccggggcaagcucugccccgacugccugaacugcaccgaccuggauguggcccucgggcgccccaugugcgugggcaccacgccguccgccaaggccucgauccugcacgagguccggcccgugaccuccggcugcuuccccaucaugcacgaccgcaccaagauccggcagcuggcgaaccuccugcgcggguaugagaacauccggcugagcacccagaacgugaucgacgccgagaaggcccccggcgggccguaccgccucggcacguccgggagcugccccaacgccaccuccaagaguggcuucuucgcgaccauggccugggccguccccaaggacaacaacaagaacgccaccaacccccugacgguggaggugccguacaucugugccgagggcgaggaccagaucaccgucuggggguuccacuccgacaacaagacccagaugaagaaccuguacggcgacaguaacccccagaaguucaccuccagcgcgaacggggugacgacccacuacgugucccagaucggcggcuuccccgaccagaccgaggaugggggccucccccagagcgggcggaucgucguggacuacaugaugcagaagccgggcaagaccgggacgaucguguaccagcgcggcguccugcugccccagaagguguggugcgccuccggccggagcaaggugaucaaggggucgcucccccugaucggcgaggccgacugucugcacgagaaguacgggggccucaacaaguccaagcccuacuacaccggggagcacgccaaggccaucggcaacugcccgaucugggucaagacgccccugaagcuggcgaauggcaccaaguaccgcccgcccgccaagcuccugaaggagcggggguucuucggcgccaucgccggguuccuggagggcgggugggagggcaugaucgccggcuggcacggguacaccagccacggcgcgcaugggguggccaucgccgccgaccucaaguccacccaggaggccaucaacaagaucaccaagaaccugaacagccuguccgagcucgaggucaagaaccugcagcgccugucgggcgcgauggacgagcuccauaacgagauccuggagcuggacgagaagguggacgaccuccgggccgacaccaucuccagccagaucgagcuggccgugcugcucuccaacgagggcaucaucaacagugaggacgagcaccuccuggcccuggagcgcaagcugaagaagaugcuggggcccuccgcggucgacaucggcaacgggugcuucgagacgaagcacaagugcaaucagaccugccucgaccggaucgccgccggcaccuucaacgccggggaguucagccugcccaccuucgacucccugaauaucaccgccgcgucgcucaacgacgacggccuggacaaccacacgauccugcuguacuauuccaccgccgccagcucccucgccgugacccugaugcuggccaucuucaucguguacauggucagccgcgacaacguguccugcagcaucugccucuga

SEQ ID NO: 14690 - RNA, 1755 nt, Artificial Sequence; identical to SEQ ID NO: 14639
  derived and/or modified CDS sequence (AUadapt) from InfluenzaB__AGQ16299__HA

SEQ ID NO: 14691 - RNA, 1755 nt, Artificial Sequence; identical to SEQ ID NO: 14639
  derived and/or modified CDS sequence (AUadapt) from InfluenzaB__AGQ16300__HA

SEQ ID NO: 14692 - RNA, 1755 nt, Artificial Sequence; identical to SEQ ID NO: 14116
  derived and/or modified CDS sequence (AUadapt) from InfluenzaB__AGQ16301__HA

SEQ ID NO: 14693 - RNA, 1755 nt, Artificial Sequence; identical to SEQ ID NO: 14116
  derived and/or modified CDS sequence (AUadapt) from InfluenzaB__AGQ16302__HA

SEQ ID NO: 14694 - RNA, 1755 nt, Artificial Sequence; identical to SEQ ID NO: 14116
  derived and/or modified CDS sequence (AUadapt) from InfluenzaB__AGQ16303__HA

SEQ ID NO: 14695 - RNA, 1755 nt, Artificial Sequence; identical to SEQ ID NO: 14116
  derived and/or modified CDS sequence (AUadapt) from InfluenzaB__AGQ16305__HA

SEQ ID NO: 14696 - RNA, 1758 nt, Artificial Sequence
  derived and/or modified CDS sequence (AUadapt) from InfluenzaB__AGQ16306__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugccccaagugucugaacugcaccgaccuggacguggcccucgggcgccccaagugcaccggcaagaucccguccgcccgggugucgauccugcacgagguccgccccgugacguccggcugcuuccccaucaugcacgaccggaccaagauccgccagcugcccaaccuccugcggggguacgagcauauccgccugagcacccacaacgugaucaacgccgagaacgcgccgggcgggcccuacaagaucggcaccuccgggucgugccccaacgucacgaacggcaacggcuucuucgccaccauggccugggccgugcccaagaaugacaagaacaagaccgagaccaacccgcucacgaucgaggugcccuacaucugcaaggagggggaggaccagaucaccgucuggggcuuccacuccgacaacgagacccagauggcgaagcuguacggggacagcaagccccagaaguucaccuccagugccaacggcgugacgacccacuacgugucccagaucggcggguuccccaaccagaccgaggacggcgggcugccgcagucgggccggaucgucguggacuacauggugcagaaguccgggaagaccggcacgaucaccuaccagcgcggcauccuccugccccagaaggucuggugcgccagcgggcgguccaaggugaucaagggcucgcugccccucaucggggaggccgauugccugcacgagaaguacggcgggcugaacaagucgaagcccuacuacaccggcgagcacgccaaggcgaucggcaacugcccgaucugggugaagacgccccucaagcuggccaacgggaccaaguaccgcccgcccgccaagcugcucaaggagcggggcuucuuuggggccaucgccggcuuccuggagggcgggugggagggcaugaucgcgggguggcacggcuacaccucccacggggcccacggcgucgccguggccgccgaccugaaguccacccaggaggcgaucaacaagaucaccaagaaccucaacucccugagcgagcuggaggucaagaaccuccagcgccuguccggcgccauggacgagcugcacaacgagauccucgagcuggaugagaagguggacgaccugcgggccgacacgaucucgucccagaucgagcucgccgugcugcugagcaacgaggggaucaucaacuccgaggacgagcaccuccuggcccuggagcgcaagcucaagaagaugcugggccccucggcggucgagaucgggaacggcugcuucgagaccaagcauaagugcaaccagaccugccuggaccggaucgccgccgggaccuucgacgccggcgaguucucccuccccaccuucgacucgcugaacaucacggcggccucccugaacgacgauggccucgacaaccacaccauccugcuguacuacagcaccgccgccuccucgcuggccgugacccucaugaucgcgaucuucguggucuacauggugucccgcgacaacgugagcugcuccaucugccuguga

SEQ ID NO: 14697 - RNA, 1755 nt, Artificial Sequence; identical to SEQ ID NO: 14116
  derived and/or modified CDS sequence (AUadapt) from InfluenzaB__AGQ16307__HA

SEQ ID NO: 14698 - RNA, 1758 nt, Artificial Sequence; identical to SEQ ID NO: 14124
  derived and/or modified CDS sequence (AUadapt) from InfluenzaB__AGQ16308__HA

SEQ ID NO: 14699 - RNA, 1755 nt, Artificial Sequence
  derived and/or modified CDS sequence (AUadapt) from InfluenzaB__AGQ16309__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgaagacccggggcaagcucugccccgacugccugaacuguaccgaccuggacguggcccucgggcgccccaugugcgugggcaccacgccguccgccaaggccagcauccugcacgagguccggcccgugaccuccggcugcuuccccaucaugcaugaccgcaccaagauccggcagcuggcgaaccuccugcgcggguacgagaacauccggcugucgacccagaacgugaucgacgccgagaaggcccccggcgggccguaucgccucggcacguccgggagcugccccaacgccaccuccaagagcggcuucuucgcgaccauggccugggccguccccaaggacaauaacaagaacgccaccaacccccugacgguggaggugccguacaucugcgccgagggcgaggaccagaucaccgucuggggguuccauuccgacaacaagacccagaugaagaaccuguacggcgacagcaacccccagaaguuuaccuccucggcgaacggggugacgacccacuacgugucccagaucggcggcuuccccgaccagaccgaggacgggggccucccccagagugggcggaucgucgccgacuacaugaugcagaagccgggcaagaccgggacgaucguguaccagcgcggcgugcugcugccccagaaggucuggugcgccuccggccggagcaaggugaucaaggggagccucccccugaucggcgaggccgacugucugcacgagaaguacgggggccucaacaaguccaagcccuacuacaccggggagcacgccaaggcgaucggcaacuguccgaucugggugaagacgccccugaagcuggccaacggcaccaaguaccgcccgcccgccaagcuccugaaggagcggggguucuucggcgccaucgccggguuccuggagggcgggugggagggcaugaucgcgggcuggcacggguacaccagucacggcgcccacggggucgccguggccgccgaccucaaguccacccaggaggcgaucaacaagaucaccaagaaccugaacucgcuguccgagcucgaggucaagaaucugcagcgccugagcggcgccauggacgagcuccacaacgagauccuggagcuggacgagaagguggacgaccuccgggccgauaccaucuccagccagaucgagcuggccgugcugcucuccaacgagggcaucaucaacagcgaggacgagcaccuccuggcgcuggagcgcaagcugaagaagaugcuggggcccuccgccgucgacaucggcaaugggugcuucgagacgaagcacaagugcaaccagaccugccucgaccggaucgccgccggcaccuuuaacgccggggaguucucgcugcccaccuucgacucccugaacaucaccgcggccagccucaaugacgacggccuggacaaccacacgauccugcuguacuacuccaccgccgccaguucccucgccgugacccugaugcuggcgaucuucaucguguacauggucagccgcgacaacguguccugcagcaucugccucuga

SEQ ID NO: 14700 - RNA, 1755 nt, Artificial Sequence
  derived and/or modified CDS sequence (AUadapt) from InfluenzaB__AGQ16310__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgaagacccggggcaagcucugccccgacugccugaacuguaccgaccuggacguggcccucgggcgccccaugugcgugggcaccacgccguccgccaaggccagcauccugcacgagguccggcccgugaccuccggcugcuuccccaucaugcaugaccgcaccaagauccggcagcuggcgaaccuccugcgcggguacgagaacauccggcugagcacccagaacgugaucgacgccgagaaggcccccggcgggccguaucgccucggcacguccgggucgugccccaacgccaccuccaagagcggcuucuucgcgaccauggccugggccguccccaaggacaauaacaagaacgccaccaacccccugacgguggaggugccguacaucugcgccgagggcgaggaccagaucaccgucuggggguuccauuccgacaacaagacccagaugaagaaccuguacggcgacagcaacccccagaaguuuaccuccagcgcgaacggggugacgacccacuacgugucccagaucggcggcuuccccgaccagaccgaggacgggggccucccccagagugggcggaucgucguggacuacaugaugcagaagccgggcaagaccgggacgaucguguaccagcgcggcguccugcugccccagaagguguggugcgccuccggccggagcaaggugaucaaggggucgcucccccugaucggcgaggccgacugucugcacgagaaguacgggggccucaacaaguccaagcccuacuacaccggggagcacgccaaggccaucggcaacuguccgaucugggucaagacgccccugaagcuggcgaacggcaccaaguaccgcccgcccgccaagcuccugaaggagcggggguucuucggcgccaucgccggguuccuggagggcgggugggagggcaugguggccggcuggcacggguacaccagucacggcgcgcacggggucgccguggccgccgaccucaaguccacccaggaggccaucaacaagaucaccaagaaccugaacagccuguccgagcucgaggugaagaaucugcagcgccugagcggcgcgauggacgagcuccacaacgagauccuggagcuggacgagaaggucgacgaccuccgggccgauaccaucuccagccagaucgagcuggccgugcugcucuccaacgagggcaucaucaacucggaggacgagcaccuccuggcccuggagcgcaagcugaagaagaugcuggggcccuccgcgguggacaucggcaaugggugcuucgagacgaagcacaagugcaaccagaccugccucgaccggaucgccgccggcaccuuuaacgccggggaguucagccugcccaccuucgacucccugaacaucaccgccgcgagccucaaugacgacggccuggacaaccacacgauccugcuguacuacuccaccgccgccaguucccucgccgucacccugaugcuggccaucuucaucguguacauggugagccgcgacaacgucuccugcagcaucugccucuga

SEQ ID NO: 14701 - RNA, 1758 nt, Artificial Sequence; identical to SEQ ID NO: 14124
  derived and/or modified CDS sequence (AUadapt) from InfluenzaB__AGQ16311__HA

SEQ ID NO: 14702 - RNA, 1755 nt, Artificial Sequence; identical to SEQ ID NO: 14116
  derived and/or modified CDS sequence (AUadapt) from InfluenzaB__AGQ16312__HA

SEQ ID NO: 14703 - RNA, 1755 nt, Artificial Sequence
  derived and/or modified CDS sequence (AUadapt) from InfluenzaB__AGQ16313__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuauuucgccaaccugaaggggacgaagacccggggcaagcucugccccgacugccugaacugcaccgaccuggauguggcccucgggcgccccaugugcgugggcaccacgccguccgccaaggccucgauccugcacgagguccggcccgugaccuccggcugcuuccccaucaugcacgaccgcaccaagauccggcagcuggcgaaccuccugcgcggguaugagaacauccggcugagcacccagaacgugaucgacgccgagaaggcccccggcgggccguaccgccucggcacguccgggagcugccccaacgccaccuccaagaguggcuucuucgcgaccauggccugggccguccccaaggacaacaacaagaacgccaccaacccccugacgguggaggugccguacaucugugccgagggcgaggaccagaucgcggucuggggguuccacuccgacaacaagacccagaugaagaaccuguacggcgacaguaacccccagaaguucaccuccagcgccaacggggugaccacgcacuacgugucccagaucggcggcuuccccgaccagaccgaggaugggggccucccccagagcgggcggaucgucguggacuacaugaugcagaagccgggcaagaccgggaccaucguguaccagcgcggcguccugcugccccagaagguguggugcgccuccggccggagcaaggugaucaaggggucgcucccccugaucggcgaggccgacugucugcacgagaaguacgggggccucaacaaguccaagcccuacuacacgggggagcacgccaaggcgaucggcaacugcccgaucugggucaagacgccccugaagcuggccaauggcaccaaguaccgcccgcccgccaagcuccugaaggagaagggguucuucggcgccaucgccggguuccuggagggcgggugggagggcaugaucgcgggcuggcacggguacaccagccacggcgcccaugggguggccgucgccgccgaccucaaguccacccaggaggcgaucaacaagaucaccaagaaccugaacagccuguccgagcucgaggugaagaaccugcagcggcugucgggcgccauggacgagcuccauaacgagauccuggagcuggacgagaagguggacgaccuccgcgccgacaccaucuccagccagaucgagcuggccguccugcucuccaacgagggcaucaucaacagugaggacgagcaccuccuggcgcuggagcggaagcugaagaagaugcuggggcccuccgccguggacaucggcaacgggugcuucgagaccaagcacaagugcaaucagacgugccucgaccgcaucgccgccggcaccuucaacgccggggaguucagccugcccaccuucgacucccugaauaucaccgcggccucgcucaacgacgacggccuggacaaccacaccauccugcuguacuauuccacggccgccagcucccucgccgugacccugaugcuggcgaucuucaucgucuacauggugagccgggacaacguguccugcagcaucugccucuga

SEQ ID NO: 14704 - RNA, 1758 nt, Artificial Sequence
  derived and/or modified CDS sequence (AUadapt) from InfluenzaB__AGQ16314__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugccccaagugucugaacugcaccgaccuggacguggcccucgggcgccccaagugcaccggcaagaucccguccgcccgggugucgauccugcacgagguccgccccgugacguccggcugcuuccccaucaugcacgaccggaccaagauccgccagcugcccaaccuccugcggggguacgagcauauccgccugagcacccacaacgugaucaacgccgagaacgcgccgggcgggcccuacaagaucggcaccuccgggucgugccccaacgucacgaacggcaacggcuucuucgccaccauggccugggccgugcccaagaaugacaagaacaagaccgagaccaacccgcucacgaucgaggugcccuacaucugcaccgaggaggaggaccagaucaccgucuggggguuccacuccgacaacgagacccagauggcgaagcuguacggcgacagcaagccccagaaguucacguccagugccaacggggugaccacccacuacgugucccagaucggcggcuuccccaaccagaccgaggacgggggccugccgcagucggggcggaucgucguggacuacauggugcagaaguccggcaagacggggaccaucaccuaccagcgcggcauccuccugccccagaaggucuggugcgccagcggccgguccaaggugaucaaggggucgcugccccucaucggcgaggccgauugccugcacgagaaguacgggggccugaacaagucgaagcccuacuacaccggggagcacgccaaggcgaucggcaacugcccgaucugggugaagacgccccucaagcuggccaacggcaccaaguaccgcccgcccgccaagcugcucaaggagcggggguucuuuggcgccaucgccggguuccuggagggcgggugggagggcaugaucgcgggcuggcacggguacaccucccacggcgcccacggggucgccguggccgccgaccugaaguccacccaggaggcgaucaacaagaucacgaagaaccucaacucccugagcgagcuggaggucaagaaccuccagcgccuguccggcgccauggacgagcugcacaacgagauccucgagcuggaugagaagguggacgaccugcgggccgacaccaucucgucccagaucgagcucgccgugcugcugagcaacgagggcaucaucaacuccgaggacgagcaccuccuggcccuggagcgcaagcucaagaagaugcuggggcccucggcggucgagaucggcaacgggugcuucgagaccaagcauaagugcaaccagaccugccuggaccggaucgccgccggcaccuucgacgccggggaguucucccuccccacguucgacucgcugaacaucaccgcggccucccugaacgacgauggccucgacaaccacaccauccugcuguacuacagcaccgccgccuccucgcuggccgugacgcucaugaucgcgaucuucguggucuacauggugucccgcgacaacgugagcugcuccaucugccuguga

SEQ ID NO: 14705 - RNA, 1755 nt, Artificial Sequence
  derived and/or modified CDS sequence (AUadapt) from InfluenzaB__AGQ16315__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuauuucgccaaccugaaggggacgaagacccggggcaagcucugccccgacugccugaacugcaccgaccuggauguggcccucgggcgccccaugugcgugggcaccacgccguccgccaaggccagcauccugcacgagguccggcccgugaccuccggcugcuuccccaucaugcacgaccgcaccaagauccggcagcuggcgaaccuccugcgcggguaugagaacauccggcugucgacccagacggugaucgacgccgagaaggcccccggcgggccguaccgccucggcaccuccgggagcugccccaacgccaccuccaagagcggcuuuuucgcgaccauggccugggccguccccaaggacaacaacaagaacgccacgaacccccugaccguggaggugccguacaucugcgccgagggcgaggaucagaucaccgucuggggguuccacuccgacaacaagacccagaugaagaaccuguacggcgacagcaauccccagaaguucacguccucggcgaacgggaucaccacccacuacgugucccagaucggcggcuuccccgaccagaccgaggacgggggccucccccagagugggcggaucguggucgacuacaugaugcagaagccgggcaagacggggaccaucguguaccagcgcggcgugcugcugccccagaaggucuggugcgccuccggccggagcaaggugaucaaggggagccucccccugaucggcgaggccgacugccugcaugagaaguacgggggccucaacaaguccaagcccuacuacaccggggagcacgccaaggccaucggcaacugcccgaucugggugaagacgccccugaagcuggcgaacggcaccaaguaucgcccgcccgccaagcuccugaaggagcggggguucuucggcgccaucgccggguuccuggagggcgggugggagggcaugaucgccggcuggcacggguacaccagccacggcgcgcacggggucgccguggccgccgaucucaaguccacccaggaggccaucaacaagaucaccaagaaccugaacucgcuguccgagcucgaggucaagaaccugcagcgccugagcggcgcgauggacgagcuccacaaugagauccuggagcuggacgagaagguggacgaccuccgggccgacacgaucuccagccagaucgagcuggccgugcugcucuccaacgagggcaucaucaacagcgaggaugagcaccuccuggcccuggagcgcaagcugaagaagaugcuggggcccuccgcggucgacaucggcaacgggugcuucgagaccaagcacaagugcaaccagaccugucucgaccggaucgccgccggcaccuucaacgccggggaguucucgcugcccaccuucgacucccugaacaucacggccgcgagucucaacgacgacggccuggacaaccacaucauccugcuguacuacuccaccgccgccaguucccucgccgugacccugaugcuggccaucuucaucguguacauggucagccgcgacaacguguccugcagcaucugccucuga

SEQ ID NO: 14706 - RNA, 1755 nt, Artificial Sequence; identical to SEQ ID NO: 14116
  derived and/or modified CDS sequence (AUadapt) from InfluenzaB__AGQ16316__HA

SEQ ID NO: 14707 - RNA, 1755 nt, Artificial Sequence; identical to SEQ ID NO: 14116
  derived and/or modified CDS sequence (AUadapt) from InfluenzaB__AGQ16317__HA

SEQ ID NO: 14708 - RNA, 1758 nt, Artificial Sequence; identical to SEQ ID NO: 14118
  derived and/or modified CDS sequence (AUadapt) from InfluenzaB__AGQ16318__HA

SEQ ID NO: 14709 - RNA, 1755 nt, Artificial Sequence
  derived and/or modified CDS sequence (AUadapt) from InfluenzaB__AGQ16319__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaaguccuacuucgccaaccugaaggggacgaagacccggggcaagcucugccccgggugccugaacuguaccgaccuggacguggcccucggccgccccaugugcgugggcaccacgccguccgccaaggccagcauccugcacgagguccggcccgugaccuccgggugcuuucccaucaugcacgaccgcaccaagauccggcagcuggcgaaccuccugcgcggcuacgagaacauccggcugagcacccagaacgugaucgaugccgagaaggcccccgggggcccguaccgccucgggacguccggcagcugccccaacgccaccuccaagagcggcuucuuugcgaccauggccugggccguccccaaggacaacaacaagaacgccaccaacccccugacgguggaggugccguacaucugcgccgagggggaggaucagaucgcggucuggggcuuccacuccgacaacaagacccagaugaagaaccuguacggggacaguaacccccagaaguucaccuccagcgccaacggcgugaccacgcacuacgugucccagaucggcggguuucccgaccagaccgaggacggcgggcucccccagagcggccggaucgucguggacuacaugaugcagaagccggggaagaccggcaccaucguguaccagcgcggcguccugcugccccagaagguguggugcgccuccgggcggaguaaggugaucaagggcagccucccccugaucggggaggccgacugccugcacgagaaguacggcgggcucaacaaguccaagcccuauuacacgggcgagcacgccaaggcgaucggcaacugcccgaucugggucaagacgccccugaagcuggccaacgggaccaaguaccgcccgcccgccaagcuccugaaggagcggggcuucuuuggggccaucgccggcuuccuggagggcgggugggagggcaugaucgcgggguggcacggcuacaccagccacggggcccacggcguggccgucgccgccgaucucaaguccacccaggaggcgaucaacaagaucaccaagaaccugaacagccuguccgagcucgaggugaagaaccugcagcgccugucgggcgccauggacgagcuccauaacgagauccuggagcuggacgagaagguggacgaccuccgggccgacaccaucuccagccagaucgagcuggccguccugcucuccaacgaggggaucaucaauagcgaggacgagcaccuccuggcgcuggagcgcaagcugaagaagaugcugggccccuccgccguggacaucgggaacggcugcuuugagaccaagcacaagugcaaccagacgugccucgaccggaucgccgccgggaccuucaacgccggcgaguuuagccugcccaccuucgacucccugaacaucaccgcggccagccucaacgaugacggccuggacaaccacaccauccugcuguacuacuccacggccgccagcucccucgccgugacccugaugcuggcgaucuuuaucgucuacauggugagccgcgacaacguguccugcagcaucugccucuga

SEQ ID NO: 14710 - RNA, 1755 nt, Artificial Sequence; identical to SEQ ID NO: 14639
  derived and/or modified CDS sequence (AUadapt) from InfluenzaB__AGQ16320__HA

SEQ ID NO: 14711 - RNA, 1755 nt, Artificial Sequence; identical to SEQ ID NO: 14116
  derived and/or modified CDS sequence (AUadapt) from InfluenzaB__AGQ16321__HA

SEQ ID NO: 14712 - RNA, 1755 nt, Artificial Sequence; identical to SEQ ID NO: 14116
  derived and/or modified CDS sequence (AUadapt) from InfluenzaB__AGQ16322__HA

SEQ ID NO: 14713 - RNA, 1758 nt, Artificial Sequence
  derived and/or modified CDS sequence (AUadapt) from InfluenzaB__AGQ16323__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccauuucgccucccugaaggggacggagacccggggcaagcucugccccaagugccugaacugcaccgaccuggacguggcccucgggcgccccaagugcaccggcaagaucccgucggcccggguguccauccugcaugagguccgccccgugacgagcggcugcuuccccaucaugcacgaccggaccaagauccgccagcugcccaaccuccugcggggguacgagcacauccgccuguccacccacaaugugaucaacgccgaggacgcgccgggcgggcccuacaagaucggcaccagcggguccugccccaacgucacgaacggcaacggcuucuuugccaccauggccugggccgugcccaagaacgacaagaacaagaccgcgaccaacccgcucacgaucgaggugcccuacaucugcaccgagggggaggaccagaucaccgucuggggcuuccacucggauaacgagacccagauggccaagcuguacggggacuccaagccccagaaguucacgagcuccgccaacggcgugaccacccacuacgugucgcagaucggcggguuucccaaccagaccgaggacggcgggcugccgcaguccggccggaucgucguggacuacauggugcagaaguccgggaagacgggcaccaucaccuaccagcgcggcauccuccugccccagaaggucuggugcgccuccgggcggagcaaggugaucaagggcagccugccccucaucggggaggccgacugucugcacgagaaguacggcgggcugaacaaguccaagcccuacuacaccggcgagcacgcgaaggccaucggcaacugcccgaucugggugaagacgccccucaagcuggccaacgggaccaaguaucgcccgcccgccaagcugcucaaggagcggggcuucuucggggccaucgcgggcuuccuggagggcgggugggagggcaugaucgccggguggcacggcuacaccucgcacggggcccacggcgucgccguggccgcggaccugaaguccacccaggaggccaucaauaagaucacgaagaaccucaacagccuguccgagcuggaggucaagaaccuccagcgccugucgggcgccauggacgagcugcacaacgagauccucgagcuggacgagaagguggacgaucugcgggccgacaccaucuccagccagaucgagcucgccgugcugcuguccaacgaggggaucaucaacagcgaggacgagcaccuccuggcgcuggagcgcaagcucaagaagaugcugggccccuccgccgucgagaucgggaacggcugcuuugagaccaagcacaagugcaaccagaccugccuggaccggaucgccgccgggaccuucgacgcgggcgaguucucgcuccccacguuugacucccugaacaucaccgccgccagccugaacgacgacggccucgacaaccacaccauccugcuguauuacuccaccgccgccucgucccuggcggugacgcucaugaucgccaucuucguggucuacauggugagccgcgacaacguguccugcagcaucugccuguga

SEQ ID NO: 14714 - RNA, 1755 nt, Artificial Sequence; identical to SEQ ID NO: 14116
  derived and/or modified CDS sequence (AUadapt) from InfluenzaB__AGQ16324__HA

SEQ ID NO: 14715 - RNA, 1755 nt, Artificial Sequence; identical to SEQ ID NO: 14116
  derived and/or modified CDS sequence (AUadapt) from InfluenzaB__AGQ16325__HA

SEQ ID NO: 14716 - RNA, 1755 nt, Artificial Sequence; identical to SEQ ID NO: 14116
  derived and/or modified CDS sequence (AUadapt) from InfluenzaB__AGQ16326__HA

SEQ ID NO: 14717 - RNA, 1755 nt, Artificial Sequence; identical to SEQ ID NO: 14116
  derived and/or modified CDS sequence (AUadapt) from InfluenzaB__AGQ16327__HA

SEQ ID NO: 14718 - RNA, 1758 nt, Artificial Sequence
  derived and/or modified CDS sequence (AUadapt) from InfluenzaB__AGQ16328__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuuugccaaccugaaggggacggagacccggggcaagcucugccccaagugccugaacugcaccgaccuggacguggcccucgggcgccccaagugcaccggcaagacgccguccgcccgggugagcauccugcacgagguccgccccgugaccuccggcuguuuccccaucaugcacgaccggaccaagauccgccagcugcccaaccuccugcggggguacgagcacauccgccugucgacccacaacgugaucaacgccgagaaugcgccgggcgggcccuacaagaucggcacguccgggagcugccccaacgucaccaacggcaacggcuucuucgccaccauggccugggccgugcccaagaacgacaagaauaagaccgcgacgaacccgcucaccaucgaggugcccuacaucugcaccgagggggaggaccagaucaccgucuggggcuuccacuccgacaacgagacgcagauggccaagcuguacggggacaguaacccccagaaguucaccuccagcgccaacggcgugaccacccacuacgugucccagaucggcggguuccccaaccagacggaggacggcgggcugccgcagucgggccggaucgucguggauuacauggugcagaaguccgggaagaccggcaccaucaccuaccagcgcggcauccuccugccccagaaggucuggugcgccagcgggcgguccaaggugaucaagggcucgcugccccucaucggggaggccgacugccugcacgagaaguacggcgggcugaacaagaguaagcccuacuacacgggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcauggcuacaccucccacggggcccacggcgucgccguggccgcggaccugaaguccacccaggaggccaucaacaagaucaccaagaaccucaacucccugucggagcuggaggucaagaaccuccagcgccuguccggcgccauggacgagcugcauaacgagauccucgagcuggacgagaagguggacgaccugcgggccgacaccaucagcucccagaucgagcucgccgugcugcugucgaacgaggggaucaucaacuccgaggacgagcaucuccuggcgcuggagcgcaagcucaagaagaugcugggccccagcgccgucgagaucgggaacggcugcuucgagaccaagcacaagugcaaccagaccugccuggaccggaucgccgccgggacguucgaugcgggcgaguucucccuccccaccuucgacucgcugaacaucaccgccgccucccugaacgacgacggccucgacaaccauaccauccugcuguacuacagcacggccgccuccucgcuggcggugacccucaugaucgccaucuucguggucuacauggugucccgcgacaacgugagcugcuccaucugccuguga

SEQ ID NO: 14719 - RNA, 1758 nt, Artificial Sequence
  derived and/or modified CDS sequence (AUadapt) from InfluenzaB__AGX15487__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggauguggcccucgggcgccccaagugcaccggcaacaucccguccgccaaggugucgauccugcacgagguccggcccgugacguccggcugcuuccccaucaugcacgaccgcaccaagauccggcagcugcccaaccuccugcgcggguacgagcacauccggcugucgacccacaacgugaucaacgccgagaaggcgccgggcgggcccuacaagaucggcaccuccgggagcugucccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacucggacaaugagacccagauggccaagcuguacggggacuccaagccccagaaguucacgucguccgccaacggcgugaccacccacuacgugagccagaucggcggguuccccaaccagaccgaggacggcgggcugccccaguccggccgcaucgucguggacuacauggugcagaaguccgggaagacgggcaccaucaccuaccagcggggcauccuccugccgcagaaggucuggugcgccuccgggcgcucgaaggugaucaagggcucgcugccccucaucggggaggccgauugccugcacgagaaguacggcgggcugaacaaguccaagcccuacuacaccggcgagcacgcgaaggccaucggcaacugccccaucugggugaagacgccgcucaagcuggccaacgggaccaaguaccggccgcccgccaagcugcucaaggagcgcggcuucuucggggccaucgcgggcuuccuggagggcgggugggagggcaugaucgccggguggcacggcuacaccagccauggggcccacggcgucgccguggccgcggaccugaaguccacccaggaggccaucaacaagaucacgaagaaccucaacucgcuguccgagcuggaggucaagaaccuccagcggcugucgggcgccauggacgagcugcacaacgagauccucgagcuggacgagaagguggacgaccugcgcgccgacaccaucuccagccagaucgagcucgccgugcugcuguccaacgaggggaucaucaauucggaggacgagcaccuccuggcgcuggagcggaagcucaagaagaugcugggccccuccgccgucgagaucgggaacggcugcuucgagaccaagcacaagugcaaccagaccugccuggaccgcaucgccgccgggaccuucgacgcgggcgaguucucgcuccccacguucgacucccugaauaucaccgccgccagccugaacgacgacggccucgacaaccacaccauccugcuguacuacuccaccgccgccucgucccuggcggugacgcucaugaucgccaucuucguggucuacauggugucgcgggacaacguguccugcagcaucugccuguga

SEQ ID NO: 14720 - RNA, 1758 nt, Artificial Sequence; identical to SEQ ID NO: 14719
  derived and/or modified CDS sequence (AUadapt) from InfluenzaB__AGX15496__HA

SEQ ID NO: 14721 - RNA, 1758 nt, Artificial Sequence
  derived and/or modified CDS sequence (AUadapt) from InfluenzaB__AGX15518__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccgcccccaccaagucgcacuucgccaaccugaaggggaccaagacgcggggcaagcucugccccaagugccugaacuguaccgaccuggacguggcccucgggcgccccaagugcaccggcaacaucccguccgccgaggugucgauccugcacgagguccggcccgugaccuccggcugcuuccccaucaugcacgaccgcacgaagauccggcagcugcccaaccuccugcgcggguacgagcacauccggcugagcacccacaaugugaucaacgcggagaaggccccgggcgggcccuacaagaucggcaccuccgggucgugccccaacgucaccaacggcaacggcuucuucgccacgauggccugggcggugcccaagaacgacaacaacaagaccgccaccaacucccucaccaucgaggugccguacaucuguacggagggggaggaccagaucaccaucuggggcuuccacucggacaacgagacccagauggccaagcuguacggggacuccaagccccagaaguucaccagcuccgccaacggcgucacgacccacuacgugucgcagaucggcggguuccccaaucagaccgaggacggcgggcugccccaguccggccgcaucguggucgacuacauggugcagaagccggggaagaccggcacgaucaccuaccagcggggcauccuccugccccagaagguguggugcgccagcgggcgcuccaaggucaucaagggcucgcugccccucaucggggaggcggacugccugcacgagaaguacggcgggcugaacaagucgaagcccuacuacaccggcgagcaugccaaggccaucggcaacugcccgaucugggugaagacgccccucaagcuggccaacgggaccaaguaccggccgcccgccaagcugcucaaggagcgcggcuucuucggggcgaucgccggcuuccuggagggcgggugggagggcaugaucgccggguggcacggcuacaccucccacggggcccacggcguggccgucgcggccgaccugaaguccacccaggaggccaucaacaagaucaccaagaaccucaacucccugagugagcuggaggugaagaaccuccagcggcuguccucggccauggacgagcugcacaacgagauccucgagcuggacgagaaggucgacgaccugcgcgccgacacgaucuccucgcagaucgagcucgcggugcugcuguccaacgagggcaucaucaacagcgaggacgagcaccuccuggcccuggagcggaagcucaagaagaugcuggggcccuccgccguggagaucggcaaugggugcuucgagaccaagcacaagugcaaccagaccugccuggaccgcaucgccgcgggcaccuucgacgccggggaguucucgcuccccaccuucgacucccugaacaucacggccgccucgcugaaugacgacggccucgacaaccacaccauccugcuguacuacuccaccgccgcgagcucccuggccgucacccucaugaucgccaucuucgugguguacauggucucgcgggacaacguguccugcagcaucugccuguga

SEQ ID NO: 14722 - RNA, 1758 nt, Artificial Sequence
  derived and/or modified CDS sequence (AUadapt) from InfluenzaB__AGX15529__HA
augaaggccaucaucgugcugcucauggucgugaccaguaacgccgaccgcgugugcaccggcaucacguccucgaacagcccccacgucgugaagaccgcgacccagggggaggugaacgucaccggcgugaucccgcugacgaccacccccaccaagucgcacuucgccaaccugaaggggacgaagacccggggcaagcucugccccaagugccugaacugcaccgaccuggauguggcccucgggcgccccaagugcaccggcaacaucccguccgccgaggucucgauccuguacgaggugcggcccgugacguccggcugcuuccccaucaugcacgaccgcaccaagauccggcagcugcccaaccuccugcgcggguacgagcacauccggcugagcacccacaacgucaucaacgccgagaaggcgccgggcgggcccuacaagaucggcaccuccgggucgugucccaacgugacgaacggcaacggcuucuucgccaccauggccugggccgugcccaagaacgacaacaacaagaccgcgaccaacucccucacgaucgaggucccguacaucugcaccgagggggaggaccagaucaccaucuggggcuuccacucggacaaugagacccagauggccaagcuguacggggacuccaagccccagaaguucacgagcuccgccaacggcgugaccacccacuacgugucgcagaucggcggguuccccaaccagaccgaggacggcgggcugccccaguccggccgcaucgucguggacuacauggugcagaaguccgggaagacgggcaccaucaccuaccagcggggcauccuccugccgcagaaggucuggugcgccuccgggcgcucgaaggugaucaagggcacccugccccucaucggggaggccgacugucugcacgagaaguacggcgggcugaacaagagcaagcccuacuacacgggcgagcacgcgaaggccaucggcaacugccccaucugggugaagaccccgcucaagcuggccaacgggaccaaguaccggccgcccgccaagcugcucaaggagcgcggcuucuucggggccaucgcgggcuuccuggagggcgggugggagggcaugaucgccggguggcacggcuacaccucccacggggcccauggcgucgccguggccgcggaccucaagucgacgcaggaggccaucaacaagaucaccaagaaccugaacucccugucggagcuggaggucaagaaccuccagcggcuguccggcgccauggacgagcugcacaacgagauccucgagcuggacgagaagguggacgaccugcgcgccgacaccaucagcucccagaucgagcucgccgugcugcugucgaacgaggggaucaucaauuccgaggacgagcaccuccuggcgcuggagcggaagcucaagaagaugcugggccccucggccgucgagaucgggaacggcugcuucgagaccaagcacaagugcaaccagaccugccuggaccgcaucgccgccgggacguucgacgcgggcgaguucucccuccccaccuucgacagccugaauaucaccgccgccucccugaacgacgacggccucgacaaccacaccauccugcuguacuacucgacggccgccuccucgcuggcggugacccucaugaucgccaucuucguggucuacauggugucccgggacaacgugagcugcuccaucugccuguga

SEQ ID NO: 14723 - RNA, 1758 nt, Artificial Sequence; identical to SEQ ID NO: 14313
  derived and/or modified CDS sequence (AUadapt) from InfluenzaB__AGX15541__HA

SEQ ID NO: 14724 - RNA, 1758 nt, Artificial Sequence
  derived and/or modified CDS sequence (AUadapt) from InfluenzaB__AGX15552__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugccccaagugucugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcauauccgccugucgacccacaacgugaucaacgccaagaacgcgccgggcgggcccuacaagaucggcaccuccgggucgugccccaacgucacgaacggcaacggcuucuucgccaccauggccugggccgugcccaagaaugacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguuuacgucguccgccaacggcgugaccacccacuacgugagccagaucggcggguuccccaaccagaccgaggacggcgggcugccccaguccggccggaucgucguggacuacauggugcagaaguccgggaagacgggcaccaucaccuaccagcgcggcauccuccugccgcagaaggucuggugcgccuccgggcggucgaaggugaucaagggcucgcugccccucaucggggaggccgauugccugcacgagaaguacggcgggcugaacaaguccaagcccuacuacaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuucuggagggcgggugggagggcaugaucgccggguggcacggcuacaccagccacggggcccacggcgucgccguggccgcggaccugaaguccacccaggaggccaucaacaagaucacgaagaaccucaacucgcuguccgagcuggaggucaagaaccuccagcgccugagcggcgccauggacgagcugcacaaugagauccucgagcuggacgagaagguggacgaccugcgggccgacaccaucuccucgcagaucgagcucgccgugcugcuguccaacgaggggaucaucaacucggaggacgagcaccuccuggcgcuggagcgcaagcucaagaagaugcugggccccuccgccgucgagaucgggaacggcugcuucgagaccaagcauaagugcaaccagaccugccuggaccggaucgccgccgggaccuucgacgcgggcgaguucagccuccccacguucgacucccugaacaucaccgccgccucgcugaacgacgauggccucgacaaccacaccauccugcuguacuacuccaccgccgccagcucccuggcggugacgcucaugaucgccaucuucguggucuacauggugucgcgcgacaacguguccugcagcaucugccuguga

SEQ ID NO: 14725 - RNA, 1758 nt, Artificial Sequence; identical to SEQ ID NO: 14322
  derived and/or modified CDS sequence (AUadapt) from InfluenzaB__AGX15563__HA

SEQ ID NO: 14726 - RNA, 1758 nt, Artificial Sequence; identical to SEQ ID NO: 14322
  derived and/or modified CDS sequence (AUadapt) from InfluenzaB__AGX15574__HA

SEQ ID NO: 14727 - RNA, 1758 nt, Artificial Sequence
  derived and/or modified CDS sequence (AUadapt) from InfluenzaB__AGX15607__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaucugaaggggacggagacccggggcaagcucugccccaagugccugaacugcaccgaccuggacguggcccucgggcgccccaagugcaccggcaacacgccguccgcccgggugagcauccugcacgagguccgccccgugaccuccggcugcuuucccaucaugcacgaccggaccaagauccgccagcugcccaaccuccugcggggguacgagcacauccgccugucgacccacaacgugaucaacgccgagaacgcgccgggcgggcccuacaagaucggcacguccgggaguugccccaacgucaccaacggcaacggcuucuucgccaccauggccugggccgugcccaagaacgacaacaacaagaccgcgacgaacucccucaccaucgaggugccguauaucugcaccgagggggaggaccagaucaccgucuggggcuuccacucggacaacgagacgcagauggccaagcuguacggggacuccaagccccagaaguucaccagcuccgccaauggcgugaccacccacuacgugucgcagaucggcggguuccccaaccagacggaggacggcgggcugccccaguccggccggaucgucguggacuacauggugcagaaguccgggaagaccggcaccaucaccuaccagcgcggcauccuccugccgcagaaggucuggugcgccuccgggcggagcaaggugaucaagggcucgcugccccucaucggggaggccgauugccugcacgagaaguacggcgggcugaacaaguccaagcccuacuacacgggcgagcacgcgaaggccaucggcaacugccccaucugggugaagaccccgcucaagcuggccaacgggaccaaguaccgcccgcccgccaagcugcucaaggagcggggcuuuuucggggccaucgcgggcuuccuggagggcgggugggagggcaugaucgccggguggcacggcuacaccucgcacggggcccacggcgucgccguggccgcggaccugaaguccacgcaggaggccaucaacaagaucaccaagaaccucaacagucuguccgagcuggaggucaagaaccuccagcgccugucgggcgccauggacgagcugcacaacgagauccucgagcuggacgagaagguggacgaccugcgggccgacaccaucuccagccagaucgagcucgccgugcugcuguccaacgaggggaucaucaauucggaggacgagcaccuccuggcgcuggagcgcaagcucaagaagaugcugggccccuccgccgucgagaucgggaacggcugcuucgagaccaagcacaagugcaaccagaccugccuggaccggaucgccgccgggacguuugacgcgggcgaguucagccuccccaccuucgacucccugaacaucaccgccgccucgcugaacgacgacggccucgacaaucacaccauccugcuguacuacuccacggccgccagcucccuggcggugacccucaugaucgccaucuucguggucuacauggugucgcgcgacaacguguccugcagcaucugccuguga

SEQ ID NO: 14728 - RNA, 1758 nt, Artificial Sequence
  derived and/or modified CDS sequence (AUadapt) from InfluenzaB__AGX15629__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugccccaagugccugaacuguaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugucgacccacaaugugaucaacgccgagaacgcgccgggcgggcccuacaagaucggcaccuccgggucgugccccaacgucacgaacggcaacggcuucuucgccaccauggccugggccgugcccaagaacgacaacaacaagaccgcgaccaacucccucacgaucgaggugccguauaucugcaccgagggggaggaccagaucaccgucuggggcuuccacagcgacaacgagauccagauggccaagcuguacggggacuccaagccccagaaguucaccucguccgccaacggcgugacgacccacuacgugagccagaucggcggguuucccaaccagaccgaggacggcgggcugccccaguccggccggaucgucguggacuacauggugcagaaguccgggaagaccggcacgaucaccuaccagcgcggcauccuccugccgcagaaggucuggugcaccuccgggcggucgaaggugaucaagggcucgcugccccucaucggggaggccgacugccugcacgagaaguacggcgggcugaacaaguccaagcccuacuacaccggcgagcacgccaaggcgaucggcaauugccccaucugggugaagacgccgcucaagcuggccaacgggaccaaguaccgcccgcccgccaagcugcucaaggagcggggcuucuucggggccaucgccggcuuccuggagggcgggugggagggcaugaucgcgggguggcacggcuacaccagccacggggcccacggcgucgccguggccgccgaccugaaguccacccaggaggcgaucaacaagaucacgaagaaccucaacagucuguccgagcuggaggucaagaaccuccagcgccugagcggcgccauggacgagcugcacaacgagauccucgagcuggacgagaagguggacgaccugcgggccgacaccaucuccucgcagaucgagcucgccgugcugcuguccaacgaggggaucaucaacucggaggacgagcaccuccuggcccuggagcgcaagcucaagaagaugcugggccccuccgcggucgagaucgggaauggcugcuucgagaccaagcacaagugcaaccagaccugccuggaccggaucgccgccgggaccuucgacgccggcgaguucagccuccccacguucgacucccugaacaucaccgcggccucgcugaaugacgacggccucgacaaccacaccauccugcuguacuacuccaccgccgccagcucccuggccgugacgcucaugaucgcgaucuucguggucuacauggugucgcgcgacaacguguccugcagcaucugccuguga

SEQ ID NO: 14729 - RNA, 1758 nt, Artificial Sequence; identical to SEQ ID NO: 14085
  derived and/or modified CDS sequence (AUadapt) from InfluenzaB__AGX15651__HA

SEQ ID NO: 14730 - RNA, 1758 nt, Artificial Sequence; identical to SEQ ID NO: 14085
  derived and/or modified CDS sequence (AUadapt) from InfluenzaB__AGX15675__HA

SEQ ID NO: 14731 - RNA, 1758 nt, Artificial Sequence; identical to SEQ ID NO: 14085
  derived and/or modified CDS sequence (AUadapt) from InfluenzaB__AGX15686__HA

SEQ ID NO: 14732 - RNA, 1758 nt, Artificial Sequence
  derived and/or modified CDS sequence (AUadapt) from InfluenzaB__AGX15697__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugccccaagugucugaacugcaccgaccuggacguggcccucgggcgccccaagugcaccggcaagaucccguccgcccgggugucgauccugcacgagguccgccccgugacguccggcugcuuccccaucaugcacgaccggaccaagauccgccagcugcccaaccuccugcggggguacgagcauauccgccugagcacccacaacgugaucaacgccgagaacgcgccgggcgggcccuacaagaucggcaccuccgggucgugccccaacaucacgaacggcaacggcuucuucgccaccauggccugggccguccccaagaacgauaagaacaagaccgcgaccaacccgcucacgaucgaggugcccuacaucugcaccgagggggaggaccagaucaccguguggggcuuccacuccgacaacgagaaccagauggccaagcuguacggggacagcaagccccagaaguuuaccuccucggccaacggcgucacgacccacuacgugucccagaucggcggguuccccaaccagaccgaggacggcgggcugccgcagucgggccggaucguggucgacuacauggugcagaaguccgggaagaccggcacgaucaccuaccagcgcggcauccuccugccccagaagguguggugcgccagcgggcgguccaaggucaucaagggcucgcugccccucaucggggaggccgauugccugcacgagaaguacggcgggcugaacaagucgaagcccuacuacaccggcgagcacgcgaaggccaucggcaacugcccgaucugggugaagacgccccucaagcuggccaacgggaccaaguaccgcccgcccgccaagcugcucaaggagcggggcuucuuuggggccaucgcgggcuuccuggagggcgggugggagggcaugaucgccggguggcacggcuacaccucccacggggcccacggcguggccgucgccgcggaccugaaguccacccaggaggccaucaacaagaucaccaagaaccucaacucccugagcgagcuggaggugaagaaccuccagcgccuguccggcgccauggacgagcugcacaaugagauccucgagcuggacgagaaggucgacgaccugcgggccgacacgaucucgucccagaucgagcucgccgugcugcugagcaacgaggggaucaucaacuccgaggacgagcaccuccuggcgcuggagcgcaagcucaagaagaugcugggccccucggccguggagaucgggaacggcugcuucgagaccaagcauaagugcaaccagaccugccuggaccggaucgccgccgggaccuucgacgcgggcgaguucucccuccccaccuucgacucgcugaacaucacggccgccucccugaacgacgauggccucgacaaccacaccauccugcuguacuacagcaccgccgccuccucgcuggcggucacccucaugaucgccaucuucgugguguacauggucucccgcgacaacgugagcugcuccaucugccuguga

SEQ ID NO: 14733 - RNA, 1758 nt, Artificial Sequence; identical to SEQ ID NO: 14085
  derived and/or modified CDS sequence (AUadapt) from InfluenzaB__AGX15708__HA

SEQ ID NO: 14734 - RNA, 1758 nt, Artificial Sequence; identical to SEQ ID NO: 14085
  derived and/or modified CDS sequence (AUadapt) from InfluenzaB__AGX15719__HA

SEQ ID NO: 14735 - RNA, 1758 nt, Artificial Sequence; identical to SEQ ID NO: 14254
  derived and/or modified CDS sequence (AUadapt) from InfluenzaB__AGX15730__HA

SEQ ID NO: 14736 - RNA, 1758 nt, Artificial Sequence; identical to SEQ ID NO: 14085
  derived and/or modified CDS sequence (AUadapt) from InfluenzaB__AGX15741__HA

SEQ ID NO: 14737 - RNA, 1758 nt, Artificial Sequence; identical to SEQ ID NO: 14085
  derived and/or modified CDS sequence (AUadapt) from InfluenzaB__AGX15753__HA

SEQ ID NO: 14738 - RNA, 1758 nt, Artificial Sequence
  derived and/or modified CDS sequence (AUadapt) from InfluenzaB__AGX15764__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugccccaagugucugaacugcaccgaccuggacguggcccucgggcgccccaagugcaccggcaagaucccguccgcccgggugucgauccugcacgagguccgccccgugacguccggcugcuuccccaucaugcacgaccggaccaagauccgccagcugcccaaccuccugcggggguacgagcauauccgccugagcacccacaacgugaucaacgccgagaacgcgccgggcgggcccuacaagaucggcaccuccgggucgugccccaacaucacgaacggcaacggcuucuucgccaccauggccugggccguccccaagaaugacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagugccaacggcgucaccacccacuacgugucccagaucggcggguuccccaaccagaccgaggacggcgggcugccgcagucgggccggaucguggucgacuacauggugcagaaguccgggaagacgggcaccaucaccuaccagcgcggcauccuccugccccagaagguguggugcgccagcgggcgguccaaggucaucaagggcucgcugccccucaucggggaggccgauugccugcacgagaaguacggcgggcugaacaagucgaagcccuacuacaccggcgagcacgcgaaggccaucggcaacugcccgaucugggugaagacgccccucaagcuggccaacgggaccaaguaccgcccgcccgccaagcugcucaaggagcggggcuucuuuggggccaucgcgggcuuccuggagggcgggugggagggcaugaucgccggguggcacggcuacaccucccacggggcccacggcguggccgucgccgcggaccugaaguccacccaggaggccaucaacaagaucacgaagaaccucaacucccugagcgagcuggaggugaagaaccuccagcgccuguccggcgccauggacgagcugcacaacgagauccucgagcuggaugagaaggucgacgaccugcgggccgacaccaucucgucccagaucgagcucgccgugcugcugagcaacgaggggaucaucaacuccgaggacgagcaccuccuggcgcuggagcgcaagcucaagaagaugcugggccccucggccguggagaucgggaacggcugcuucgagaccaagcauaagugcaaccagaccugccuggaccggaucgccgccgggaccuucgacgcgggcgaguucucccuccccacguucgacucgcugaacaucaccgccgccucccugaacgacgauggccucgacaaccacaccauccugcuguacuacagcaccgccgccuccucgcuggcgaucacgcucaugaucgccaucuucgucguguacauggugucccgcgacaacgucagcugcuccaucugccuguga

SEQ ID NO: 14739 - RNA, 1755 nt, Artificial Sequence
  derived and/or modified CDS sequence (AUadapt) from InfluenzaB__AGX15775__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacuguaccgaccuggacguggcccucgggcggcccaugugcgugggcaccacgccguccgccaaggccagcauccugcacgagguccgccccgugaccuccggcugcuuccccaucaugcaugaccggaccaagauccgccagcugcccaaccuccugcggggguacgagaacauccgccugagcacccagaacgugaucgacgcggagaaggccccgggcgggcccuaucggcucggcacguccgggagcugccccaacgccaccuccaagagcggcuucuucgccaccauggcgugggccguccccaaggacaauaacaagaacgccaccaacccgcugacgguggaggugcccuacaucugcaccgagggcgaggaccagaucaccgucuggggguuccauuccgacaacaagauccagaugaagaaccuguacggcgacucgaacccccagaaguuuaccuccagcgccaacggggugacgacccacuacgugucccagaucggcagcuuccccgaccagaccgaggauggcgggcucccgcaguccggccgcaucgucguggacuacaugaugcagaagcccgggaagaccggcacgaucguguaccagcgcgggguccugcugccccagcgcguguggugcgccagcggccggagcaaggugaucaagggcucccucccccugaucggggaggcggacugucugcacgagaaguacggcgggcucaacaagagcaagccguacuacaccggcgagcacgccaaggccaucgggaauugccccaucugggucaagacgccccugaagcuggccaacggcaccaaguaccggcccccggccaagcuccugaaggagcggggcuucuucggggcgaucgccggcuuccuggagggcgggugggaggggaugaucgccggcuggcacggcuauaccucccacggggcccacggcguggccgucgcggccgaccucaagagcacccaggaggccaucaacaagaucaccaagaaccugaacucccugagugagcucgaggugaagaaccugcagcgccuguccggggccauggacgagcuccacaacgagauccuggagcuggacgagaagguggacgaccuccgggccgauaccaucucgucccagaucgagcuggcgguccugcucagcaacgagggcaucaucaacuccgaggacgagcaccuccuggcccuggagcgcaagcugaagaagaugcugggccccagcgccguggagaucgggaauggcugcuucgagacgaagcacaagugcaaccagaccugccucgaccggaucgccgcggggaccuuuaacgccggcgaguucucccugcccaccuucgacagccugaacaucaccgccgccucccucaacgaugacgggcuggacaaccacacgauccugcuguacuacagcaccgccgcguccagucucgccgugacccugaugcuggccaucuucaucgucuacauggugucccgcgacaacgugagcugcagcaucugccucuga

SEQ ID NO: 14740 - RNA, 1758 nt, Artificial Sequence
  derived and/or modified CDS sequence (AUadapt) from InfluenzaB__AGX15786__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugccccaagugucugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcauauccgccugucgacccacaacgugaucaacgccgagaacgcgccgggcgggcccuacaagaucggcaccuccgggagcugccccaacaucacgaacggcaacggcuucuucgccaccauggccugggccguccccaagaacgauaagaacaagaccgcgaccaacccgcucacgaucgaggugcccuacaucugcaccgagggggaggaccagaucaccguguggggcuuccacuccgacaacgagacccagauggccaagcuguacggggacucgaagccccagaaguucacguccagugccaacggcgucaccacccacuacgugucccagaucggcggguuccccaaccagaccgaggacggcgggcugccgcagagcggccggaucguggucgacuacauggugcagaaguccgggaagacgggcaccaucaccuaccagcgcggcauccuccugccccagaagguguggugcgccucggggcgguccaaggucaucaagggcagccugccccucaucggggaggccgacugucugcacgagaaguacggcgggcugaacaagucgaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuucuggagggcgggugggagggcaugaucgccggguggcacggcuacaccucccacggggcccacggcguggccgucgccgcggaccugaaguccacccaggaggccaucaacaagaucacgaagaaccucaacucccugagcgagcuggaggugaagaaccuccagcgccuguccggcgccauggacgagcugcacaacgagauccucgagcuggaugagaaggucgacgaccugcgggccgacaccaucucgucccagaucgagcucgccgugcugcugucgaacgaggggaucaucaacuccgaggacgagcaccuccuggcgcuggagcgcaagcucaagaagaugcugggccccagcgccguggagaucgggaacggcugcuucgagaccaagcacaaguguaaccagaccugccuggaccggaucgccgccgggaccuucgacgcgggcgaguucuuccuccccacguucgacucccugaacaucaccgccgccucgcugaacgacgauggccucgacaaccacaccauccugcuguacuacuccaccgccgccagcucccuggcggucacgcucaugaucgccaucuucgugguguacauggucucgcgcgacaacguguccugcagcaucugccuguga

SEQ ID NO: 14741 - RNA, 1758 nt, Artificial Sequence; identical to SEQ ID NO: 14085
  derived and/or modified CDS sequence (AUadapt) from InfluenzaB__AGX15797__HA

SEQ ID NO: 14742 - RNA, 1758 nt, Artificial Sequence
  derived and/or modified CDS sequence (AUadapt) from InfluenzaB__AGX15808__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucccacuucgccaaccugaaggggacggagacccggggcaagcucugccccaagugucugaacugcaccgaccuggacguggcccucgggcgccccaagugcaccggcaagaucccguccgcccgggugucgauccugcacgagguccgccccgugacguccggcugcuuccccaucaugcacgaccggaccaagauccgccagcugcccaaccuccugcggggguaugagcacauccgccugagcacccacaacgugaucaacgccgagaacgcgccgggcgggcccuacaagaucggcaccuccgggucgugccccaacgucacgaacggcaacggcuuuuucgccaccauggccugggccgugcccaagaacgacaagaacaagaccgcgaccaacccgcucacgaucgaggugcccuacaucugcaccgagggggaggaccagaucaccgucuggggcuuccacuccgacaacgagacccagauggccaagcuguauggggacagcaagccccagaaguucacguccucggccaacggcgugaccacccacuacgugucccagaucggcggguuccccaaccagaccgaggacggcgggcugccgcagucgggccggaucgucguggacuauauggugcagaaguccgggaagacgggcaccaucaccuaccagcgcggcauccuccugccccagaaggucuggugcgccaucgggcggagcaaggugaucaagggcucccugccccucaucggggaggccgacugccugcacgagaaguacggcgggcugaacaagucgaagcccuacuacaccggcgagcacgcgaaggccaucggcaauugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccagccacggggcccacggcgucgccguggccgcggaccugaaguccacccaggaggccaucaauaagaucacgaagaaccucaacucgcuguccgagcuggaggucaagaaccuccagcgccugagcggcgccauggacgagcugcacaacgagauccucgagcuggacgagaagguggacgaccugcgggccgacaccaucuccagucagaucgagcucgccgugcugcuguccaacgaggggaucaucaacucggaggacgagcaccuccuggcgcuggagcgcaagcucaagaagaugcugggccccuccgccgucgagaucgggaacggcugcuucgagaccaagcacaagugcaaccagaccugccuggaucggaucgccgccgggaccuucgacgcgggcgaguucagccuccccacguucgacucccugaacaucaccgccgccucgcugaacgacgacggccucgacaaucacaccauccugcuguacuacuccaccgccgccagcucccuggcggugacgcucaugaucgccaucuucguggucuacauggugucgcgcgacaacguguccugcagcaucugccuguga

SEQ ID NO: 14743 - RNA, 1758 nt, Artificial Sequence; identical to SEQ ID NO: 14348
  derived and/or modified CDS sequence (AUadapt) from InfluenzaB__AGX15830__HA

SEQ ID NO: 14744 - RNA, 1758 nt, Artificial Sequence; identical to SEQ ID NO: 14348
  derived and/or modified CDS sequence (AUadapt) from InfluenzaB__AGX15841__HA

SEQ ID NO: 14745 - RNA, 1758 nt, Artificial Sequence; identical to SEQ ID NO: 14348
  derived and/or modified CDS sequence (AUadapt) from InfluenzaB__AGX15852__HA

SEQ ID NO: 14746 - RNA, 1758 nt, Artificial Sequence; identical to SEQ ID NO: 14348
  derived and/or modified CDS sequence (AUadapt) from InfluenzaB__AGX15863__HA

SEQ ID NO: 14747 - RNA, 1758 nt, Artificial Sequence
  derived and/or modified CDS sequence (AUadapt) from InfluenzaB__AGX15874__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuuugccaaccugaaggggacggagacccggggcaagcucugccccaagugccccaacugcaccgaccuggacguggcccuggggcgcccgaagugcaccggcaagauccccuccgcccgggugagcauccuccacgagguccgccccgugacguccggcugcuuucccaucaugcacgaccggaccaagauccgccagcugccgaaccugcuccggggguacgagcacauccgccugucgacccacaacgugaucaacgccgagaacgcgcccggcgggcccuacaagaucggcaccuccgggaguugccccaacgucacgaacggcaacggcuucuucgccaccauggccugggccgugccgaagaacgacaagaacaagaccgcgaccaacccccugacgaucgaggugcccuacaucuguaccgagggggaggaccagaucaccgucuggggcuuccacuccgacaacgagacccagauggccaagcucuacggggacucgaagccccagaaguucacguccucggccaacggcgugaccacccauuacgugucccagaucggcggguucccgaaccagaccgaggacggcgggcugccccagagcggccggaucgucguggacuacauggugcagaaguccgggaagacgggcaccaucaccuaccagcgcggcauccugcucccccagaaggucuggugcgccucggggcgguccaaggugaucaagggcagccugccccugaucggggaggccgauugccuccacgagaaguacggcgggcugaacaagucgaagccguacuacaccggcgagcacgcgaaggccaucggcaacugccccaucugggugaagacgccccugaagcucgccaacgggaccaaguaucggcccccggccaagcugcugaaggagcgcggcuucuucggggccaucgcgggcuuccucgagggcgggugggagggcaugaucgccggguggcacggcuacaccucccacggggcccacggcgucgccguggccgcggaccugaaguccacccaggaggccaucaacaagaucacgaagaaccugaacucccucagugagcuggaggucaagaaccugcagcgccucuccggcgccauggacgagcugcacaacgagauccuggagcucgacgagaagguggacgaccugcgggccgacaccaucucgucccagaucgagcuggccgugcuccugucgaacgaggggaucaucaauuccgaggacgagcaccuccuggcgcuggagcgcaagcugaagaagaugcucggccccagcgccgucgagaucgggaacggcugcuucgagaccaagcacaagugcaaccagaccugccuggaccggaucgccgccgggaccuuugacgcgggcgaguucucccugcccacguucgacucgcucaacaucaccgccgccucccugaacgacgacggccugaacaaccauaccauccuccuguacuacagcaccgccgccuccucgcuggcggugacgcugaugaucgccaucuucguggucuacauggugucccgcgacaacgugagcugcuccaucugccucuga

SEQ ID NO: 14748 - RNA, 1758 nt, Artificial Sequence; identical to SEQ ID NO: 14348
  derived and/or modified CDS sequence (AUadapt) from InfluenzaB__AGX15885__HA

SEQ ID NO: 14749 - RNA, 1758 nt, Artificial Sequence
  derived and/or modified CDS sequence (AUadapt) from InfluenzaB__AGX15896__HA
augaaggccaucaucgugcugcucauggucgugaccaguaacgccgaccgcaucugcaccggcaucacguccagcaacucgccccacguggucaagaccgcgacccagggggaggugaaugugaccggcgucaucccgcugacgaccacccccaccaagagccacuucgccaaccugaaggggacggagacccggggcaagcucugccccaagugccccaacugcaccgaucuggacguggcccuggggcgcccgaagugcaccggcaagauccccuccgcccgggugagcauccuccacgagguccgccccgugacguccggcugcuuccccaucaugcacgaccggaccaagauccgccagcugccgaaucugcuccggggguacgagcacauccgccugucgacccacaacgugaucaacgccgagaacgcgcccggcgggcccuacaagaucggcaccuccgggaguugccccaacgucacgaacggcaacggcuucuucgccaccauggccugggccgugccgaagaacgacaagaauaagaccgcgaccaacccccugacgaucgaggugcccuacaucugcaccgagggggaggaccagaucaccgucuggggcuuccacuccgacaacgagacccagauggccaagcucuauggggacucgaagccccagaaguucacguccagcgccaacggcgugaccgcccacuacgugucccagaucggcggguucccgaaucagaccgaggacggcgggcugccccagagcggccggaucgucguggacuacauggugcagaaguccgggaagaccggcacgaucaccuaccagcgcggcauccugcucccccagaaggucuggugcgccucggggcgguccaaggugaucaagggcagccugccccugaucggggaggcggauugccuccacgagaaguacggcgggcugaacaagagcaagccguacuacaccggcgagcaugccaaggccaucggcaacugccccaucugggugaagacgccccugaagcucgccaacgggaccaaguaccggcccccggccaagcugcugaaggagcgcggcuucuucggggcgaucgccggcuuccucgagggcgggugggagggcaugaucgccggguggcacggcuauaccucccacggggcccacggcgucgccguggcggccgaccugaaguccacccaggaggccaucaacaagaucaccaagaaccugaacucccucucggagcuggaggucaagaaccugcagcgccucuccggcgccauggaugagcugcacggggagauccuggagcucgacgagaagguggacgaccugcgggccgacacgaucagcucccagaucgagcuggcggugcuccugucgaacgagggcaucaucaauuccgaggacgagcaccuccuggcccuggagcgcaagcugaagaagaugcucgggcccagcgccgucgagaucggcaacgggugcuucgagaccaagcacaagugcaaucagaccugccuggaccggaucgccgcgggcaccuucgacgccggcgaguucucccugcccaccuucgacagccucaauaucacggccgccucccugaacgacgacgggcuggacaaccacaccauccuccuguacuacaguaccgccgcguccagccuggccgugacccugaugaucgccaucuucguggucuacauggugucccgcgacaacgugagcugcuccaucugccucuga

SEQ ID NO: 14750 - RNA, 1758 nt, Artificial Sequence; identical to SEQ ID NO: 14348
  derived and/or modified CDS sequence (AUadapt) from InfluenzaB__AGX15907__HA

SEQ ID NO: 14751 - RNA, 1758 nt, Artificial Sequence; identical to SEQ ID NO: 14348
  derived and/or modified CDS sequence (AUadapt) from InfluenzaB__AGX15918__HA

SEQ ID NO: 14752 - RNA, 1758 nt, Artificial Sequence
  derived and/or modified CDS sequence (AUadapt) from InfluenzaB__AGX15929__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugccccaagugucugaacugcaccgaccuggacguggcccucgggcgccccaagugcaccggcaagaucccguccgcccgggugucgauccugcacgagguccgccccgugacguccggcugcuuccccaucaugcacgaccggaccaagauccgccagcugcccaaccuccugcggggguacgagcauauccgccugagcaccaacaacgugaucaacgccgagaacgcgccgggcgggcccuacaagaucggcaccuccgggucgugccccaacgucacgaacggcaacggcuucuucgccaccauggccugggccgugcccaagaaugacaagaacaagaccgcgaccaacccgcucacgaucgaggugcccuacaucugcaccgagggggaggaccagaucaccgucuggggcuuccacuccgacaacgagacccagauggccaagcuguacggggacagcaagccccagaaguucacguccagugccaacggcgugaccacccacuacgugucccagaucggcggguuccccaaccagaccgaggacggcgggcugccgcagucgggccggaucgucguggacuacauggugcagaaguccgagaagacggggaccaucaccuaccagcgcggcauccuccugccccagaaggucuggugcgccagcggccgguccaaggugaucaaggggucgcugccccucaucggcgaggccgauugccugcacgagaaguacgggggccugaacaagucgaagcccuacuacaccggggagcacgcgaaggccaucggcaacugcccgaucugggugaagacgccccucaagcuggccaacggcaccaaguaccgcccgcccgccaagcugcucaaggagcggggguucuuuggcgccaucgcgggguuccuggagggcgggugggagggcaugaucgccggcuggcacggguacaccucccacggcgcccacggggucgccguggccgcggaccugaaguccacccaggaggccaucaacaagaucacgaagaaccucaacucccugagcgagcuggaggucaagaaccuccagcgccuguccggcgccauggacgagcugcacaacgagauccucgagcuggaugagaagguggacgaccugcgggccgacaccaucucgucccagaucgagcucgccgugcugcugagcaacgagggcaucaucaacuccgaggacgagcaccuccuggcgcuggagcgcaagcucaagaagaugcuggggcccucggccgucgagaucggcaacgggugcuucgagaccaagcauaagugcaaccagaccugccuggaccggaucgccgccggcaccuucgacgcgggggaguucucccuccccacguucgacucgcugaacaucaccgccgccucccugaacgacgauggccucgacaaccacaccauccugcuguacuacagcaccgccgccuccucgcuggcggugacgcucaugaucgccaucuucguggucuacauggugucccgcgacaacgugagcugcuccaucugccuguga

SEQ ID NO: 14753 - RNA, 1758 nt, Artificial Sequence; identical to SEQ ID NO: 14348
  derived and/or modified CDS sequence (AUadapt) from InfluenzaB__AGX15940__HA

SEQ ID NO: 14754 - RNA, 1758 nt, Artificial Sequence
  derived and/or modified CDS sequence (AUadapt) from InfluenzaB__AGX15962__HA
augaaggccaucaucgugcugcucauggucgugaccaguaacgccgaccgcaucugcaccggcaucacguccucgaacagcccccacaucgugaagaccgcgacccagggggaggucaacgugaccggcgugaucccgcugacgaccacccccaccaagucgcacuucgccaaccugaaggggacggagacccggggcaagcucugccccaagugccugaauugcaccgaccuggacgucgcccucgggcgccccaagugcaccggcaagaucccguccgcccgggugucgauccugcacgaggugcgccccgucacguccggcugcuuccccaucaugcacgaccggaccaagauccgccagcugcccaaccuccugcggggguacgagcacauccgccugagcacccacaaugugaucaacgccgagaacgcgccgggcgggcccuacaagaucggcaccuccgggucgugccccaacaucacgaacggcaacggcuucuucgccaccauggccugggccgugcccaagaacgacaagaacaagaccgcgaccaacccgcucacgaucgagguccccuacaucuguaccgagggggaggaccagaucaccguguggggcuuccacuccgacaacgagacccagauggccaagcuguacggggacucgaagccccagaaguucacguccagcgccaacggcgugaccacccacuacgucucccagaucggcggguuccccaaccagaccgaggauggcgggcugccgcagucgggccggaucgugguggacuacaugaugcagaaguccgggaagacgggcaccaucaccuaccagcgcggcauccuccugccccagaaggucuggugcgccucggggcgguccaaggugaucaagggcagccugccccucaucggggaggccgacugccugcacgagaaguacggcgggcugaacaagucgaagcccuacuacaccggcgagcaugcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagugagcuggaggugaagaaccuccagcgccuguccggcgccauggacgagcugcacaacgagauccucgagcuggacgagaaggucgacgaccugcgggccgacaccaucagcucccagaucgagcucgccgugcugcugucgaacgaggggaucaucaacuccgaggacgagcaccuccuggcgcuggagcgcaagcucaagaagaugcugggccccucggccgucgagaucgggaauggcugcuucgagaccaagcacaagugcaaccagaccugccuggaccggaucgccgccgggaccuucgacgcgggcgaguucucccuccccacguucgacagccugaacaucaccgccgccucccugaacgaugacggccucgacaaccacaccauccugcuguacuacucgaccgccgccuccucgcuggcggugacgcucaugaucgccaucuucguggucuacauggugucccgcgacaacgugagcugcuccaucugccuguga

SEQ ID NO: 14755 - RNA, 1758 nt, Artificial Sequence; identical to SEQ ID NO: 14118
  derived and/or modified CDS sequence (AUadapt) from InfluenzaB__AGX15973__HA

SEQ ID NO: 14756 - RNA, 1758 nt, Artificial Sequence; identical to SEQ ID NO: 14118
  derived and/or modified CDS sequence (AUadapt) from InfluenzaB__AGX15984__HA

SEQ ID NO: 14757 - RNA, 1758 nt, Artificial Sequence; identical to SEQ ID NO: 14423
  derived and/or modified CDS sequence (AUadapt) from InfluenzaB__AGX15995__HA

SEQ ID NO: 14758 - RNA, 1758 nt, Artificial Sequence; identical to SEQ ID NO: 14423
  derived and/or modified CDS sequence (AUadapt) from InfluenzaB__AGX16006__HA

SEQ ID NO: 14759 - RNA, 1758 nt, Artificial Sequence
  derived and/or modified CDS sequence (AUadapt) from InfluenzaB__AGX16017__HA
augaaggccaucaucgugcugcucauggucgugaccaguaacgccgaccgcaucugcaccggcaucacguccucgaacagcccccacaucgugaagaccgcgacccagggggaggucaacgugaccggcgugaucccgcugacgaccacccccaccaagucgcacuucgccaaccugaaggggacggagacccggggcaagcucugccccaagugccugaauugcaccgaccuggacgucgcccucgggcgccccaagugcaccggcaagaucccguccgcccgggugucgauccugcacgaggugcgccccgucacguccggcugcuuccccaucaugcacgaccggaccaagauccgccagcugcccaaccuccugcggggguacgagcacauccgccugagcacccacaaugugaucaacgccgagaacgcgccgggcgggcccuacaagaucggcaccuccgggucgugccccaacaucacgaacggcaacggcuucuucgccaccauggccugggccgugcccaagaacgacaagaacaagaccgcgaccaacccgcucacgaucgagguccccuacaucuguaccgagggggaggaccagaucaccguguggggcuuccacuccgacaacgagauccagauggccaagcuguacggggacagcaagccccagaaguucaccuccucggccaacggcgugacgacccacuacgucucccagaucggcggguuccccaaccagaccgaggauggcgggcugccgcagucgggccggaucgugguggacuacaugguccagaaguccgggaagaccggcacgaucaccuaccagcgcggcauccuccugccccagaagguguggugcgccagcgggcgguccaaggugaucaagggcucgcugccccucaucggggaggccgacugccugcacgagaaguacggcgggcugaacaagucgaagcccuacuacaccggcgagcaugcgaaggccaucggcaacugcccgaucugggucaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcguggccguggccgcggaccugaaguccacccaggaggccaucaacaagaucaccaagaaccucaacucccugagugagcuggaggucaagaaccuccagcgccuguccggcgccauggacgagcugcacaacgagauccucgagcuggacgagaagguggacgaccugcgggccgacacgaucucgucccagaucgagcucgccguccugcugagcaacgaggggaucaucaacuccgaggacgagcaccuccuggcgcuggagcgcaagcucaagaagaugcugggccccucggccguggagaucgggaauggcugcuucgagaccaagcacaagugcaaccagaccugccuggaccggaucgccgccgggaccuucgacgcgggcgaguucucccuccccaccuucgacucgcugaacaucacggccgccucccugaacgaugacggccucgacaaccacaccauccugcuguacuacagcaccgccgccuccucgcuggcggugacccucaugaucgccaucuucgucguguacauggugucccgcgacaacgucagcugcuccaucugccuguga

SEQ ID NO: 14760 - RNA, 1755 nt, Artificial Sequence; identical to SEQ ID NO: 14166
  derived and/or modified CDS sequence (AUadapt) from InfluenzaB__AGX16028__HA

SEQ ID NO: 14761 - RNA, 1755 nt, Artificial Sequence
  derived and/or modified CDS sequence (AUadapt) from InfluenzaB__AGX16039__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaaguccuacuucgccaaccugaaggggacgcggacccgcggcaagcucugccccgacugccugaauugcaccgaccuggacguggcccucgggcggcccaugugcgugggcaccacgccguccgccaaggccagcauccugcacgagguccgccccgugaccuccggcuguuuccccaucaugcacgaccggaccaagauccgccagcugcccaaccuccugcggggguacgagaacauccgccugagcacccagaaugugaucgacgcggagaaggccccgggcgggcccuaccggcucggcacguccgggagcugccccaacgccaccuccaagagcggcuucuuugccaccauggcgugggccguccccaaggacaacaacaagaacgccaccaacccgcugacgguggaggugcccuacaucuguaccgagggcgaggaccagaucaccgucuggggguuccacuccgacaacaagacccagaugaagaaccuguacggcgauucgaacccccagaaguucacguccagcgccaacggggugaccacccacuacgugucccagaucggcggcuuucccgaccagaccgaggacgggggccucccgcagagcgggcgcaucgucguggacuacaugaugcagaagcccggcaagacggggaccaucguguaccagcggggcguccugcugccccagaagguguggugugccuccggccgcagcaaggugaucaaggggagccucccccugaucggcgaggcggacugccugcacgagaaguacgggggccucaacaaguccaagccguauuacaccggggagcacgccaaggccaucggcaacugccccaucugggucaagacgccccugaagcuggccaacggcaccaaguaccggcccccggccaagcuccugaaggagcgcggguuuuucggcgcgaucgccggguuccuggagggcgggugggagggcaugaucgccggcuggcacggguacaccagccacggcgcccacgggguggccgucgcggccgaucucaaguccacccaggaggccaucaacaagaucaccaagaaccugaacagccuguccgagcucgaggugaagaaccugcagcggcugucgggcgccguggacgagcuccauaacgagauccuggagcuggacgagaaggucgacgaccuccgcgccgacacgaucuccagccagaucgagcuggcggugcugcucuccaaugagggcaucaucaacagcgaggacgagcaccuccuggcccuggagcggaagcugaagaagaugcuggggcccuccgccguggacaucggcaacgggugcuuugagaccaagcacaagugcaaccagaccugccucgaccgcaucgccgcgggcaccuucaacgccggggaguuuagccugcccaccuucgacucccugaacaucacggccgccagccucaacgaugacggccuggacaaccacaccauccugcuguacuacuccaccgccgcgagcucccucgccgucacccugaugcuggccaucuuuaucguguacauggugagccgggacaacgucuccugcagcaucugccucuga

SEQ ID NO: 14762 - RNA, 1755 nt, Artificial Sequence
  derived and/or modified CDS sequence (AUadapt) from InfluenzaB__AGX16050__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaaguccuacuucgccaaccugaaggggacgcggacccgcggcaagcucugccccgacugucugaacugcaccgaccuggacguggcccucgggcggcccaugugcgugggcaccacgccguccgccaaggccagcauccugcaugagguccgccccgugaccuccggcugcuuccccaucaugcacgaccggaccaagauccgccagcugcccaaccuccugcggggguacgagaacauccgccugaguacccagaacgugaucgacgcggagaacgccccgggcgggcccuaccggcucggcacguccgggagcugccccaaugccaccuccaagagcggcuucuucgccaccauggcgugggccguccccaaggacaacaacaagaaugccaccaacccgcugacgguggaggugcccuacaucugcaccgagggcgaggaccagaucaccgucuggggguuccacuccgauaacaagacccagaugaagaaccuguacggcgacagcaacccccagaaguucacguccagugccaacggggugaccacccacuacgugucccagaucggcggcuuccccgcccagaccgaggacgggggccucccgcagagcgggcgcaucgucguggauuacauggugcagaagccccggaagacgggcaccaucgucuaccagcgcggggugcugcugccccagaagguguggugcgcguccggccggagcaaggucaucaagggcucgcucccccugaucggggaggccgacugucugcacgagaaguacggcgggcucaacaaguccaagccguacuacaccggcgagcacgccaaggccaucgggaauugccccaucugggugaagacgccccugaagcuggccaacggcaccaaguaccggcccccggcgaagcuccugaaggagcgcggcuucuucggggccaucgccggcuuccuggagggcgggugggaggggaugaucgccggcuggcacggcuauaccagccacggggcccacggcgucgcgguggccgccgaccucaaguccacccaggaggccaucaacaagaucaccaagaaccugaauagccuguccgagcucgaggugaagaaccugcagcgccugagcggggccauggacgagcuccacaacgagauccuggagcuggaugagaaggucgacgaccuccgggcggacacgaucuccagccagaucgagcuggccgugcugcucuccaacgagggcaucaucaacagugaggacgagcaccuccuggcccuggagcgcaagcugaagaagaugcugggccccuccgccguggacaucgggaacggcugcuucgagaccaagcacaaguguaaccagaccugccucgaccggaucgcggccgggaccuucaacgccggcgaguucagucugcccaccuucgacucccugaacaucacggccgccagccucaacgacgaugggcuggacaaccacaccauccugcuguacuacuccaccgcggccagcucccucgccgucacccugaugcuggccaucuuuaucguguacauggugagccgcgacaacgucuccugcagcaucugccucuga

SEQ ID NO: 14763 - RNA, 1755 nt, Artificial Sequence
  derived and/or modified CDS sequence (AUadapt) from InfluenzaB__AGX16061__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacuguaccgaccuggacguggcccucgggcggcccaugugcgugggcaccacgccguccgccaaggccagcauccugcacgagguccgccccgugaccuccggcugcuuccccaucaugcaugaccggaccaagauccgccagcugcccaaccuccugcggggguacgagaacauccgccugagcacccagaacgugaucgacgcggagaaggccccgggcgggcccuaucggcucggcacguccgggucgugccccaacgccaccuccaagagcggcuucuucgccaccauggcgugggccguccccaaggacaauaacaagaacgccaccaacccgcugacgguggaggugcccuacaucugcaccgagggcgaggaccagaucaccgucuggggguuccauuccgacaacaagacccagaugaagaaccuguacggcgacagcaacccccagaaguuuacguccagcgccaacggggugaccacccacuacgugucccagaucggcggcuuccccgaccagaccgaggacgggggccucccgcagagugggcgcaucgucguggacuacaugaugcagaagcccggcaagacggggaccaucguguaccagcggggcguccugcugccccagaagguguggugcgccuccggccgcagcaaggugaucaaggggucgcucccccugaucggcgaggcggacugucugcacgagaaguacgggggccucaacaaguccaagccguacuacaccggggagcacgccaaggccaucggcaacugucccaucugggucaagacgccccugaagcuggccaacggcaccaaguaccggcccccggccaagcuccugaaggagcgcggguucuucggcgcgaucgccggguuccuggagggcgggugggagggcaugaucgccggcuggcacggguacaccagucacggcgcccacgggguggccgucgcggccgaccucaaguccacccaggaggccaucaacaagaucaccaagaaccugaacagccuguccgagcucgaggugaagaaucugcagcggcugagcggcgccauggacgagcuccacaacgagauccuggagcuggacgagaagguggacgaccuccgcgccgauacgaucuccagccagaucgagcuggcgguccugcucuccaacgagggcaucaucaacucggaggacgagcaccuccuggcccuggagcggaagcugaagaagaugcuggggcccuccgccguggacaucggcaaugggugcuucgagaccaagcacaagugcaaccagaccugccucgaccgcaucgccgcgggcaccuuuaacgccggggaguucagccugcccaccuucgacucccugaacaucacggccgccagccucaaugacgacggccuggacaaccacaccauccugcuguacuacuccaccgccgcgaguucccucgccgugacccugaugcuggccaucuucaucgucuacauggugagccgggacaacguguccugcagcaucugccucuga

SEQ ID NO: 14764 - RNA, 1755 nt, Artificial Sequence
  derived and/or modified CDS sequence (AUadapt) from InfluenzaB__AGX16083__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacuguaccgaccuggacguggcccucgggcggcccaugugcgugggcaccacgccguccgccaaggccagcauccugcacgagguccgccccgugaccuccggcugcuuccccaucaugcaugaccggaccaagauccgccagcugcccaaccuccugcggggguacgagaacauccgccugagcacccagaacgugaucgacgcggagaaggccccgggcgggcccuaucggcucggcacguccgggucgugccccaacgccaccuccaagagcggcuucuucgccaccauggcgugggccguccccaaggacaauaacaagaacgccaccaacccgcugacgguggaggugcccuacaucugcaccgagggcgaggaccagaucaccgucuggggguuccauuccgacaacaagacccagaugaagaaccuguacggcgacagcaacccccagaaguuuacguccagcgccaacggggugaccacccacuacgugucccagaucggcggcuuccccgaccagaccgaggacgggggccucccgcagagugggcgcaucgucguggacuacaugaugcagaagcccggcaagacggggaccaucguguaccagcggggcguccugcugccccagaagguguggugcgccuccggccgcagcaaggugaucaaggggucgcucccccugaucggcgaggcggacugucugcacgagaaguacgggggccucaacaaguccaagccguacuacaccggggagcacgccaaggccaucggcaacugucccaucugggucaagacgccccugaagcuggccaacggcaccaaguaccggcccccggccaagcuccugaaggagcgcggguucuucggcgcgaucgccggguuccuggagggcgggugggagggcaugaucgccggcuggcacggguacaccagucacggcgcccacgggguggccgucgcggccgaccucaaguccacccaggaggccaucaacaagaucaccaagaaccugaacagccuguccgagcucgaggugaagaaucugcagcggcugagcggcgccauggacgagcuccacaacgagauccuggagcuggacgagaagguggacgaccuccgcgccgauacgaucuccagccagaucgagcuggcgguccugcucuccaacgagggcaucaucaacucggaggacgagcaccuccuggcccuggagcggaagcugaagaagaugcuggggcccuccgccguggagaucggcaacggguguuucgagaccaagcacaagugcaaccagaccugccucgaccgcaucgccgcgggcaccuucaaugccggggaguucagccugcccaccuucgacucccugaacaucacggccgccagccucaacgaugacggccuggacaaccacaccauccugcuguacuacuccaccgccgcgagcucccucgccgugacccugaugcuggccaucuuuaucgucuacauggugagccgggacaacguguccugcagcaucugccucuga

SEQ ID NO: 14765 - RNA, 1755 nt, Artificial Sequence
  derived and/or modified CDS sequence (AUadapt) from InfluenzaB__AGX16105__HA
augaaggccaucaucgugcugcucauggucgugaccaguaacgccgaccgcaucugcaccggcaucacguccagcuccagcccccacguggucaagaccgcgacccagggggaggugaaugugaccggcgucaucccgcugacgaccacccccaccaaguccuacuucgccaaccugaaggggacgcggacccgcggcaagcucugccccgacugccugaauugcaccgaccuggacguggcccucgggcggcccaugugcgugggcaccacgccgagcgccaaggccuccauccugcacgagguccgccccgugaccaguggcugcuuccccaucaugcacgaccggaccaagauccgccagcugcccaaccuccugcggggguacgagaauauccgccuguccacccagaacgugaucgacgcggagaaggccccgggcgggcccuaccggcucggcacgagcggguccugccccaacgccaccagcaaguccggcuuuuucgccaccauggcgugggccguccccaaggacaacaacaagaacgccaccaacccgcugacgguggaggugcccuauaucugcaccgagggcgaggaccagaucaccgucuggggguuccacagcgacaauaagacccagaugaagaaccuguacggcgacuccaacccccagaaguucacgagcuccgccaauggggugaccacccacuacgugagccagaucggcggcuuccccgaccagaccgaggacgggggccucccgcaguccgggcgcaucgucguggauuacaugaugcagaagcccggcaagacggggaccaucguguaccagcggggcguccugcugccccagaagguguggugcgccagcggccgcagcaaggugaucaaggggucccucccccugaucggcgaggcggacugccugcaugagaaguacgggggccucaacaagagcaagccguacuacaccggggagcacgccaaggccaucggcaauugccccaucugggucaagacgccccugaagcuggccaacggcaccaaguaccggcccccggccaagcuccugaaggagcgcggguucuucggcgcgaucgccggguuccuggagggcgggugggagggcaugaucgccggcuggcauggguacaccucccacggcgcccacgggguggccgucgcggccgaccucaagagcacccaggaggccaucaacaagaucaccaagaaucugaacucccugagcgagcucgaggugaagaaccugcagcggcuguccggcgccauggacgagcuccacagcgagauccuggagcuggaugagaagguggacgaccuccgcgccgacacgaucuccagccagaucgagcuggcgguccugcucuccaacgagggcaucaucaacagcgaggaugagcaccuccuggcccuggagcggaagcugaagaagaugcuggggcccuccgccguggacaucggcaacgggugcuucgagaccaagcacaaguguaaccagaccugccucgaccgcaucgccgcgggcaccuucaacgccggggaguucagucugcccaccuucgacucccugaacaucacggccgccagccucaacgacgauggccuggacaaccacaccauccugcuguacuacuccaccgccgcgagcucccucgccgugacccugaugcuggccaucuuuaucgucuacauggugagccgggacaacgugagcugcuccaucugccucuga

SEQ ID NO: 14766 - RNA, 1755 nt, Artificial Sequence
  derived and/or modified CDS sequence (AUadapt) from InfluenzaB__AGX16116__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaaguccuacuucgccaaccugaaggggacgcggacccgcggcaagcucugccccgacugucugaacugcaccgaccuggacguggcccucgggcggcccaugugcgugggcaccacgccguccgccaaggccagcauccugcaugagguccgccccgugaccuccggcugcuuccccaucaugcacgaccggaccaagauccgccagcugcccaaccuccugcggggguacgagaacauccgccugaguacccagaacgugaucgacgcggagaacgccccgggcgggcccuaccggcucggcacguccgggagcugccccaaugccaccuccaagagcggcuucuucgccaccauggcgugggccguccccaaggacaacaacaagaaugccaccaacccgcugacgguggaggugcccuacgucugcaccgagggcgaggaccagaucaccguguggggguuccacuccgauaacaagacccagaugaagaaccuguacggcgacagcaacccccagaaguucacguccagugccaacggggugaccacccacuacgucucccagaucggcggcuuccccgcccagaccgaggacgggggccucccgcagagcgggcgcaucgugguggauuacaugguccagaagccccggaagacgggcaccaucguguaccagcgcggggugcugcugccccagaaggucuggugcgcguccggccggagcaaggugaucaagggcucgcucccccugaucggggaggccgacugucugcacgagaaguacggcgggcucaacaaguccaagccguacuacaccggcgagcacgccaaggccaucgggaauugccccaucugggucaagacgccccugaagcuggccaacggcaccaaguaccggcccccggcgaagcuccugaaggagcgcggcuucuucggggccaucgccggcuuccuggagggcgggugggaggggaugaucgccggcuggcacggcuauaccagccacggggcccacggcguggcgguggccgccgaccucaaguccacccaggaggccaucaacaagaucaccaagaaccugaauagccuguccgagcucgagaucaagaaccugcagcgccugagcggggccauggacgagcuccacaacgagauccuggagcuggaugagaaggucgacgaccuccgggcggacacgaucuccagccagaucgagcuggccgugcugcucuccaacgagggcaucaucaacagugaggacgagcaccuccuggcccuggagcgcaagcugaagaagaugcugggccccuccgccguggacaucgggaacggcugcuucgagaccaagcacaaguguaaccagaccugccucgaccggaucgcggccgggaccuucaacgccggcgaguucagucugcccaccuucgacucccugaacaucacggccgccagccucaacgacgaugggcuggacaaccacaccauccugcuguacuacuccaccgcggccagcucccucgccgucacccugaugcuggccaucuuuaucguguacauggugagccgcgacaacgucuccugcagcaucugccucuga

SEQ ID NO: 14767 - RNA, 1755 nt, Artificial Sequence
  derived and/or modified CDS sequence (AUadapt) from InfluenzaB__AGX16127__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaaguccuacuucgccaaccugaaggggacgcggacccgcggcaagcucugccccgacugccugaauugcaccgaccuggacguggcccucgggcggcccaugugcgugggcaccacgccguccgccaaggccagcauccugcacgagguccgccccgugaccuccggcuguuuccccaucaugcacgaccggaccaagauccgccagcugcccaaccuccugcggggguacgagaacauccgccugagcacccagaaugugaucgacgcggagaacgccccgggcgggcccuaccggcucggcacguccgggagcugccccaacgccaccuccaagagcggcuuuuucgccaccauggcgugggccguccccaaggacaacaacaagaacgccaccaacccgcugacgguggaggugcccuaugucugcaccgagggcgaggaccagaucaccguguggggguuccacuccgacaacaagauccagaugaagaaccuguauggcgacagcaacccccagaaguucaccuccagcgccaacggggugacgacccacuaugucucccagaucggcggcuuccccgcccagaccgaggacgggggccucccgcagagcgggcgcaucgugguggacuacaugguccagaagccccggaagaccggcacgaucguguaccagcgcggggugcugcugccccagaaggucuggugugcguccggccggagcaaggugaucaagggcucgcucccccugaucggggaggccgacugccugcacgagaaguacggcgggcucaacaaguccaagccguauuacaccggcgagcacgccaaggccaucgggaacugccccaucugggucaagacgccccugaagcuggccaacggcaccaaguaccggcccccggcgaagcuccugaaggagcgcggcuuuuucggggccaucgccggcuuccuggagggcgggugggaggggaugaucgccggcuggcacggcuacaccagccacggggcccacggcguggcgguggccgccgaucucaaguccacccaggaggccaucaacaagaucaccaagaaccugaacagccuguccgagcucgagaucaagaaccugcagcgccugagcggggccauggacgagcuccauaacgagauccuggagcuggacgagaaggucgacgaccuccgggcggacaccaucuccagccagaucgagcuggccgugcugcucuccaaugagggcaucaucaacagcgaggacgagcaccuccuggcccuggagcgcaagcugaagaagaugcugggccccuccgccguggacaucgggaacggcugcuuugagacgaagcacaagugcaaccagaccugccucgaccggaucgcggccgggaccuucaacgccggcgaguuuagccugcccaccuucgacucccugaacaucaccgccgccagccucaacgaugacgggcuggacaaccacacgauccugcuguacuacuccaccgcggccagcucccucgccgucacccugaugcuggccaucuuuaucguguacauggugagccgcgacaacgucuccugcagcaucugccucuga

SEQ ID NO: 14768 - RNA, 1755 nt, Artificial Sequence; identical to SEQ ID NO: 14766
  derived and/or modified CDS sequence (AUadapt) from InfluenzaB__AGX16138__HA

SEQ ID NO: 14769 - RNA, 1755 nt, Artificial Sequence; identical to SEQ ID NO: 14763
  derived and/or modified CDS sequence (AUadapt) from InfluenzaB__AGX16149__HA

SEQ ID NO: 14770 - RNA, 1755 nt, Artificial Sequence; identical to SEQ ID NO: 14764
  derived and/or modified CDS sequence (AUadapt) from InfluenzaB__AGX16160__HA

SEQ ID NO: 14771 - RNA, 1755 nt, Artificial Sequence; identical to SEQ ID NO: 14764
  derived and/or modified CDS sequence (AUadapt) from InfluenzaB__AGX16182__HA

SEQ ID NO: 14772 - RNA, 1755 nt, Artificial Sequence; identical to SEQ ID NO: 14166
  derived and/or modified CDS sequence (AUadapt) from InfluenzaB__AGX16193__HA

SEQ ID NO: 14773 - RNA, 1755 nt, Artificial Sequence; identical to SEQ ID NO: 14166
  derived and/or modified CDS sequence (AUadapt) from InfluenzaB__AGX16215__HA

SEQ ID NO: 14774 - RNA, 1755 nt, Artificial Sequence; identical to SEQ ID NO: 14166
  derived and/or modified CDS sequence (AUadapt) from InfluenzaB__AGX16226__HA

SEQ ID NO: 14775 - RNA, 1755 nt, Artificial Sequence
  derived and/or modified CDS sequence (AUadapt) from InfluenzaB__AGX16237__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacugcaccgaucuggacguggcccucgggcggcccaugugcgugggcaccacgccguccgccaaggccagcauccugcacgagguccgccccgugaccuccggcugcuuccccaucaugcacgaucggaccaagauccgccagcugcccaaccuccugcggggguacgagaacauccgccugucgacccagaacgugaucgacgcggagaaggccccgggcgggcccuaccggcucggcacguccgggagcugucccaacgccaccuccaagagcggcuucuucgccaccauggcgugggccguccccaaggacaacaacaagaaugccaccaacccgcugacgguggaggugcccuacaucugcaccgagggcgaggaccagaucaccgucuggggguuccacuccgacaacaagacccagaugaagaaucuguacggcgacagcaacccccagaaguucacguccucggccaacggggugaccacccauuacgugucccagaucggcggcuuccccgaccagaccgaggacgggggccucccgcagagcgggcgcaucgucguggacuacaugaugcagaagcccggcaagacggggaccaucguguaccagcggggcguccugcugccccagaagguguggugugccuccggccgcagcaaggugaucaaggggagccucccccugaucggcgaggcggacugccugcacgagaaguacgggggccucaacaaguccaagccguauuacaccggggagcacgccaaggccaucggcaacugccccaucugggucaagacgccccugaagcuggccaacggcaccaaguaccggcccccggccaagcuccugaaggagcgcggguucuucggcgcgaucgccggguuucuggagggcgggugggagggcaugaucgccggcuggcacggguacaccagccacggcgcccacgggguggccgucgcggccgaccucaaguccacccaggaggccaucaacaagaucaccaagaaucugaacucgcuguccgagcucgaggugaagaaccugcagcggcugagcggcgccauggacgagcuccacaacgagauccuggagcuggacgagaagguggaugaccuccgcgccgacacgaucuccagccagaucgagcuggcgguccugcucuccaacgagggcaucaucaacagcgaggacgagcaucuccuggcccuggagcggaagcugaagaagaugcuggggcccuccgccguggacaucggcaacgggugcuucgagaccaagcacaagugcaaccagaccugccucgaucgcaucgccgcgggcaccuucaacgccggggaguucucgcugcccaccuucgacucccugaacaucacggccgccagucucaacgacgacggccuggacaaccacaccauccugcuguacuacuccaccgccgcgaguucccucgccaucacccugaugcuggccaucuucaucguguacauggucagccgggacaacguguccugcagcaucugccucuga

SEQ ID NO: 14776 - RNA, 1755 nt, Artificial Sequence; identical to SEQ ID NO: 14166
  derived and/or modified CDS sequence (AUadapt) from InfluenzaB__AGX16248__HA

SEQ ID NO: 14777 - RNA, 1755 nt, Artificial Sequence; identical to SEQ ID NO: 14166
  derived and/or modified CDS sequence (AUadapt) from InfluenzaB__AGX16259__HA

SEQ ID NO: 14778 - RNA, 1755 nt, Artificial Sequence
  derived and/or modified CDS sequence (AUadapt) from InfluenzaB__AGX16270__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacugcaccgaucuggacguggcccucgggcggcccaugugcgugggcaccacgccguccgccaaggccagcauccugcacgagguccgccccgugaccuccggcugcuuccccaucaugcacgaucggaccaagauccgccagcuggcgaaccuccugcggggguacgagaacauccgccugucgacccagaacgugaucgacgccgagaaggcccccggcgggccguaccggcucggcacguccgggagcugucccaacgccaccuccaagagcggcuucuucgcgaccauggccugggccguccccaaggacaacaacaagaaugccaccaacccccugacgguggaggugccguacaucugcaaggagggcgaggaccagaucaccgucuggggguuccacuccgacaacaagacccagaugaagaaucuguacggcgacagcaacccccagaaguucaccuccucggccaacggggugacgacccauuacgugucccagaucggcggcuuccccgaccagaccgaggacgggggccucccccagagcgggcgcaucgucguggacuacaugauccagaagccgggcaagaccgggacgaucguguaccagcggggcguccugcugccccagaagguguggugugcguccggccgcagcaaggugaucaaggggagccucccccugaucggcgaggccgacugccugcacgagaaguacgggggccucaacaaguccaagcccuauuacaccggggagcacgccaaggccaucggcaacugcccgaucugggucaagacgccccugaagcuggccaacggcaccaaguaccggccgcccgcgaagcuccugaaggagcgcggguucuucggcgccaucgccggguuucuggagggcgggugggagggcaugaucgccggcuggcacggguacaccagccacggcgcccacgggguggcggucgccgccgaccucaaguccacccaggaggccaucaacaagaucaccaagaaucugaacucgcuguccgagcucgaggugaagaaccugcagcggcugagcggcgccauggacgagcuccacaacgagauccuggagcuggacgagaagguggaugaccuccgcgcggacaccaucuccagccagaucgagcuggccguccugcucuccaacgagggcaucaucaacagcgaggacgagcaucuccuggcccuggagcggaagcugaagaagaugcuggggcccuccgccguggacaucggcaacgggugcuucgagacgaagcacaagugcaaccagaccugccucgaucgcaucgcggccggcaccuucaacgccggggaguucucgcugcccaccuucgacucccugaacaucaccgccgccagucucaacgacgacggccuggacaaccacacgauccugcuguacuacuccaccgcggccaguucccucgccgugacccugaugcuggccaucuucaucgucuacauggugagccgggacaacguguccugcagcaucugccucuga

SEQ ID NO: 14779 - RNA, 1755 nt, Artificial Sequence; identical to SEQ ID NO: 14778
  derived and/or modified CDS sequence (AUadapt) from InfluenzaB__AGX16281__HA

SEQ ID NO: 14780 - RNA, 1755 nt, Artificial Sequence
  derived and/or modified CDS sequence (AUadapt) from InfluenzaB__AGX16292__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacuguaccgaccuggacguggcccucgggcggcccaugugcgugggcaccacgccguccgccaaggccagcauccugcacgagguccgccccgugaccuccggcugcuuccccaucaugcaugaccggaccaagauccgccagcuggcgaaccuccugcggggguacgagaacauccgccugagcaaccagaacgugaucgaugccgagaaggcccccggcgggccguaccggcucggcaccuccgggucgugccccaacgccacguccaagagcggcuucuucgcgaccauggccugggccguccccaaggauaacaacaagaacgccaccaacccccugaccguggaggugccguacaucugcacggagggcgaggaccagaucaccgucuggggguuucacuccgacaacaagacccagaugaagaaccuguacggcgacagcaauccccagaaguucaccuccagcgccaacggggugacgacccacuacgugucccagaucggcggcuuccccgaccagaccgaggaugggggccucccccagagcgggcgcaucgucguggacuacaugaugcagaagccgggcaagaccgggacgaucguguaccagcggggcguccugcugccccagaagguguggugcgcguccggccgcucgaaggugaucaagggggcccucccccugaucggcgaggccgacugucugcacgagaaguacgggggccucaacaagagcaagcccuacuacaccggggagcacgccaaggccaucggcaauugcccgaucugggucaagacgccccugaagcuggcgaacggcaccaaguaccggccgcccgccaagcuccugaaggagcgcggguucuucggcgccaucgccggguuccuggagggcgggugggagggcaugaucgccggcuggcacggguauaccucccacggcgcgcacgggguggccgucgccgccgaccucaagagcacccaggaggccaucaacaagaucaccaagaaccugaacucccugagugagcucgaggugaagaaccugcagcggcuguccggcgcgauggacgagcuccacaacgagauccuggagcuggacgagaagguggacgaccuccgcgccgauaccaucagcucccagaucgagcuggccguccugcucucgaacgagggcaucaucaacuccgaggacgagcaccuccuggcccuggagcggaagcugaagaagaugcuggggcccagcgcgguggauaucggcaacgggugcuucgagacgaagcacaagugcaaccagaccugccucgaucgcaucgccgccggcaccuucaacgccggggaguucucccugcccaccuucgacagccugaacaucaccgccgcgucccucaaugacgacggccuggacaaccacacgauccugcuguacuacaguaccgccgccuccagccucgccgugacccugaugcuggccaucuucaucgucuacauggugucccgggacaacgugagcugcuccaucugccucuga

SEQ ID NO: 14781 - RNA, 1758 nt, Artificial Sequence; identical to SEQ ID NO: 14254
  derived and/or modified CDS sequence (AUadapt) from InfluenzaB__AGX16303__HA

SEQ ID NO: 14782 - RNA, 1755 nt, Artificial Sequence; identical to SEQ ID NO: 14166
  derived and/or modified CDS sequence (AUadapt) from InfluenzaB__AGX16314__HA

SEQ ID NO: 14783 - RNA, 1755 nt, Artificial Sequence; identical to SEQ ID NO: 14166
  derived and/or modified CDS sequence (AUadapt) from InfluenzaB__AGX16325__HA

SEQ ID NO: 14784 - RNA, 1755 nt, Artificial Sequence; identical to SEQ ID NO: 14471
  derived and/or modified CDS sequence (AUadapt) from InfluenzaB__AGX16336__HA

SEQ ID NO: 14785 - RNA, 1755 nt, Artificial Sequence; identical to SEQ ID NO: 14471
  derived and/or modified CDS sequence (AUadapt) from InfluenzaB__AGX16347__HA

SEQ ID NO: 14786 - RNA, 1755 nt, Artificial Sequence; identical to SEQ ID NO: 14471
  derived and/or modified CDS sequence (AUadapt) from InfluenzaB__AGX16358__HA

SEQ ID NO: 14787 - RNA, 1755 nt, Artificial Sequence
  derived and/or modified CDS sequence (AUadapt) from InfluenzaB__AGX16369__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuauuucgccaaccugaaggggacgcggacccgcggcaagcucugccccgacugccugaacugcaccgaccuggauguggcccucgggcggcccaugugcgugggcaccacgccguccgccaaggccucgauccugcacgagguccgccccgugaccuccggcugcuuccccaucaugcacgaccggaccaagauccgccagcugcccaaccuccugcggggguaugagaacauccgccugagcacccagaacgugaucgacgcggagaaggccccgggcgggcccuaccggcucggcacguccgggagcugccccaacgccaccuccaagaguggcuucuucgccaccauggcgugggccguccccaaggacaacaacaagaacgccaccaacccgcugacgguggaggugcccuacaucuguaccgagggcgaggaccagaucaccgucuggggguuccacuccgacaacaagacccagaugaagaaccuguacggcgacaguaacccccagaaguucacguccagcgccaacggggugaccacccacuacgugucccagaucggcagcuuccccgaucagaccgaggacggcgggcucccgcaguccggccgcaucgucguggacuacaugaugcagaagcccgggaagacgggcaccaucguguaccagcgggggauccugcugccccagaaggucuggugcgccagcggccgcucgaaggugaucaagggcucccucccccugaucggggaggcggacugucugcacgagaaguacggcgggcucaacaagagcaagccguacuacaccggcgagcacgccaaggccaucgggaacugucccaucugggugaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccucccacggggcccauggcgucgccguggcggccgaccucaagagcacccaggaggccaucaacaagaucaccaagaaccugaacucccugagcgagcucgaggucaagaaccugcagcggcuguccggggccauggacgagcuccauaacgagauccuggagcuggacgagaagguggacgaccuccgcgccgacacgaucucgucccagaucgagcuggcggugcugcucagcaacgagggcaucaucaauuccgaggacgagcaccuccuggcccuggagcggaagcugaagaagaugcugggccccagcgccgucgagaucgggaacggcugcuucgagaccaagcacaagugcaaucagaccugccucgaccgcaucgccgcggggaccuucaacgccggcgaguucucccugcccaccuucgacagccugaauaucacggccgccucccucaacgacgacgggcuggacaaccacaccauccugcuguacuacaguaccgccgcguccagccucgccgugacccugaugcuggccaucuucaucguguacauggucucccgggacaacgugagcugcagcaucugccucuga

SEQ ID NO: 14788 - RNA, 1755 nt, Artificial Sequence
  derived and/or modified CDS sequence (AUadapt) from InfluenzaB__AGX16380__HA
augaaggccaucgugguccugcucaugguggugaccaguaacgccgaccgcaucugcaccggcaucacguccagcaacagcccccaugucgugaagaccgcgacccagggggaggugaacgucaccggcgugaucccgcugacgaccacccccaccaaguccuacuucgccaaccugaaggggacgcggacccgcggcaagcucugccccgacugccugaauugcaccgaccuggacguggcccucgggcggcccaugugcgucggcgccaccccguccgccaaggcgagcauccugcacgaggugcgccccgugacguccggcuguuuccccaugaugcacgaccggaccaagauccgccagcugcccaaccuccugcggggguacgagaacauccgccugagcacccagaaugucaucgacgccgagaaggccccgggcgggcccuaccggcucggcaccuccgggagcugccccaacgccacguccaagagcggcuucuuugcgaccauggccugggccgugcccaaggacaacaacaagaacgccaccaacccgcugaccguggagguccccuacaucuguacggagggcgaggaccagaucaccguguggggguuccacuccgacaacaagacccagaugaagaaccuguacggcgauucgaacccccagaaguucaccuccagcgccaacggggugacgacccacuacgucucccagaucggcaguuuccccgaccagaccgaggacggcgggcucccgcaguccggccgcaucgugguggacuacaugaugcagaagcccgggaagaccggcacgaucgucuaccagcgcggggugcugcugccccagaagguguggugugcgagcggccggagcaaggucaucaagggcucccucccccugaucggggaggccgacugccugcacgagaaguacggcgggcucaacaagaguaagccguacuacaccggcgagcacgccaaggccaucgggaacugccccaucugggugaagacgccccugaagcuggccaacggcaccaaguaucggcccccggcgaagcuccugaaggagcgcggcuucuucggggccaucgccggcuuccuggagggcgggugggaggggaugaucgccggcuggcacggcuacaccucccacggggcccacggcgucgcgguggccgccgaucucaagagcacccaggaggccaucaacaagaucaccaagaaccugaacucccugagcgagcucgaggugaagaaccugcagcggcuguccggggccauggacgagcuccauaacgagauccuggagcuggacgagaaggucgacgaccuccgcgcggacaccaucucgucccagaucgagcuggccgugcugcucaguaacgagggcaucaucaacuccgaggacgagcaccuccuggcccuggagcggaagcugaagaagaugcugggccccagcgccguggagaucgggaacggcugcuuugagacgaagcacaagugcaaccagaccugccucgaccgcaucgcggccgggaccuucaacgccggcgaguuuucccugcccaccuucgacagccugaacaucaccgccgccucccucaacgacgaugggcuggacaaccacacgauccugcuguacuacagcaccgcggccuccagccucgccgucacccugaugcuggccaucuuuaucguguacauggugucccgggacaacgucagcugcagcaucugccucuga

SEQ ID NO: 14789 - RNA, 1755 nt, Artificial Sequence; identical to SEQ ID NO: 14307
  derived and/or modified CDS sequence (AUadapt) from InfluenzaB__AGX16391__HA

SEQ ID NO: 14790 - RNA, 1755 nt, Artificial Sequence
  derived and/or modified CDS sequence (AUadapt) from InfluenzaB__AGX16402__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacugcaccgaucuggacguggcccucgggcggcccaugugcgugggcaccacgccguccgccaaggccagcauccugcacgagguccgccccgugaccuccggcugcuuccccaucaugcacgaucggaccaagauccgccagcugcccaaccuccugcggggguacgagaacauccgccugagcacccagaacgugaucgacgcggagaaggccccgggcgggcccuaccggcucggcacguccgggagcugucccaacgccaccuccaagaucggcuucuucgccaccauggcgugggccguccccaaggacaacuacaagaacgccaccaauccgcugacgguggaggugcccuacaucugcaccgagggcgaggaccagaucaccgucuggggguuccacagcgacaacaagccccagaugaagaaucuguacggcgacuccaacccccagaaguucaccucguccgccaacggggugacgacccacuaugugagccagaucggcgacuucccggaccagaccgaggacggcgggcucccccaguccggccgcaucgucguggacuacaugaugcagaagcccgggaagaccggcacgaucguguaccagcgcgggguccugcugccccagaagguguggugugccagcggccgguccaaggugaucaagggcagccucccgcugaucggggaggcggacugccugcacgagaaguacggcgggcucaacaagaguaagcccuacuacaccggcgagcacgccaaggccaucgggaacugccccaucugggucaagacgccccugaagcuggccaacggcaccaaguaccggccgcccgccaagcuccugaaggagcgcggcuucuuuggggcgaucgccggcuuccuggagggcgggugggaggggaugaucgccggcuggcacggcuacaccucccacggggcccacggcguggccgucgcggccgaccucaagagcacccaggaggccaucaauaagaucaccaagaaccugaacucccugagcgagcucgaggugaagaaccugcagcggcuguccggggccauggacgagcuccacaacgagauccuggagcuggacgagaagguggaugaccuccgcgccgacaccaucucgucccagaucgagcuggcgguccugcucagcaacgagggcaucaucaacuccgaggacgagcaucuccuggcccuggagcggaagcugaagaagaugcugggccccagcgccguggacaucgggaacggcugcuucgagacgaagcacaagugcaaccagaccugucucgaccgcaucgccgcggggaccuucaacgccggcgaguucucccugcccaccuucgacagccugaauaucaccgccgccucccucaacgacgacgggcuggacaaccacacgauccugcuguacuacaguaccgccgcguccagccucgccgugacccugaugcuggccaucuucaucgucuacauggugucccgggacaacgugagcugcuccaucugccucuga

SEQ ID NO: 14791 - RNA, 1755 nt, Artificial Sequence; identical to SEQ ID NO: 14117
  derived and/or modified CDS sequence (AUadapt) from InfluenzaB__AGX16413__HA

SEQ ID NO: 14792 - RNA, 1755 nt, Artificial Sequence; identical to SEQ ID NO: 14117
  derived and/or modified CDS sequence (AUadapt) from InfluenzaB__AGX16423__HA

SEQ ID NO: 14793 - RNA, 1755 nt, Artificial Sequence; identical to SEQ ID NO: 14117
  derived and/or modified CDS sequence (AUadapt) from InfluenzaB__AGX16434__HA

SEQ ID NO: 14794 - RNA, 1755 nt, Artificial Sequence; identical to SEQ ID NO: 14117
  derived and/or modified CDS sequence (AUadapt) from InfluenzaB__AGX16445__HA

SEQ ID NO: 14795 - RNA, 1755 nt, Artificial Sequence; identical to SEQ ID NO: 14117
  derived and/or modified CDS sequence (AUadapt) from InfluenzaB__AGX16456__HA

SEQ ID NO: 14796 - RNA, 1755 nt, Artificial Sequence
  derived and/or modified CDS sequence (AUadapt) from InfluenzaB__AGX16467__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaaguccuacuucgccaaccugaaggggacgcggacccgcggcaagcucugccccgacugccugaauugcaccgaccuggacguggcccucgggcggcccaugugcgugggcaccacgccguccgccaaggccagcauccugcacgagguccgccccgugaccuccggcuguuuccccaucaugcacgaccggaccaagauccgccagcugcccaaccuccugcggggguacgagaacauccgccugagcacccagaaugugaucgacgcggagaaggccccgggcgggcccuaccggcucggcacguccgggagcugccccaacgccaccuccaagagcggcuucuuugccaccauggcgugggccguccccaaggacaacaacaagaacgccaccaacccgcugacgguggaggugcccuacaucuguaccgagggcgaggaccagaucaccgucuggggguuccacuccgacaacaagacccagaugaagaaccuguacggcgauucgaacccccagaaguucacguccagcgccaacggggugaccacccacuacgugucccagaucggcaguuuccccgaccagaccgaggacggcgggcucccgcaguccggccgcaucgucguggacuacaugaugcagaagcccgggaagacgggcaccaucguguaccagcgcgggguccugcugccccagcgcguguggugugccagcggccggagcaaggugaucaagggcucccucccccugaucggggaggcggacugccugcacgagaaguacggcgggcucaacaagaguaagccguacuacaccggcgagcacgccaaggccaucgggaacugccccaucugggucaagacgccccugaagcuggccaacggcaccaaguaucggcccccggccaagcuccugaaggagcggggcuucuucggggcgaucgccggcuuccuggagggcgggugggaggggaugaucgccggcuggcacggcuacaccucccacggggcccacggcguggccgucgcggccgaucucaagagcacccaggaggccaucaacaagaucaccaagaaccugaacucccugagcgagcucgaggugaagaaccugcagcgccuguccggggccauggacgagcuccauaacgagauccuggagcuggacgagaagguggacgaccuccgggccgacacgaucucgucccagaucgagcuggcgguccugcucaguaacgagggcaucaucaacuccgaggacgagcaccuccuggcccuggagcgcaagcugaagaagaugcugggccccagcgccguggagaucgggaacggcugcuuugagaccaagcacaagugcaaccagaccugccucgaccggaucgccgcggggaccuucaacgccggcgaguuuucccugcccaccuucgacagccugaacaucacggccgccucccucaacgacgaugggcuggacaaccacaccauccugcuguacuacagcaccgccgcguccagccucgccgugacccugaugcuggccaucuuuaucgucuacauggugucccgcgacaacgugagcugcagcaucugccucuga

SEQ ID NO: 14797 - RNA, 1755 nt, Artificial Sequence; identical to SEQ ID NO: 14117
  derived and/or modified CDS sequence (AUadapt) from InfluenzaB__AGX16478__HA

SEQ ID NO: 14798 - RNA, 1755 nt, Artificial Sequence; identical to SEQ ID NO: 14307
  derived and/or modified CDS sequence (AUadapt) from InfluenzaB__AGX16489__HA

SEQ ID NO: 14799 - RNA, 1758 nt, Artificial Sequence; identical to SEQ ID NO: 14719
  derived and/or modified CDS sequence (AUadapt) from InfluenzaB__AGX16500__HA

SEQ ID NO: 14800 - RNA, 1758 nt, Artificial Sequence; identical to SEQ ID NO: 14719
  derived and/or modified CDS sequence (AUadapt) from InfluenzaB__AGX16511__HA

SEQ ID NO: 14801 - RNA, 1758 nt, Artificial Sequence; identical to SEQ ID NO: 14719
  derived and/or modified CDS sequence (AUadapt) from InfluenzaB__AGX16522__HA

SEQ ID NO: 14802 - RNA, 1758 nt, Artificial Sequence
  derived and/or modified CDS sequence (AUadapt) from InfluenzaB__AGX16533__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggauguggcccucgggcgccccaagugcaccggcaacaucccguccgccaaggugucgauccugcacgagguccggcccgugacguccggcugcuuccccaucaugcacgaccgcaccaagauccggcagcugcccaaccuccugcgcggguacgagcacauccggcugucgacccacaacgugaucaacgccgagaaggcgccgggcgggcccuacaagaucggcaccuccgggagcugucccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacucggacaaggagacccagauggccaagcuguauggggacuccaagccccagaaguucacgucguccgccaacggcgugaccacccacuacgugagccagaucggcggguuccccaaccagaccgaggacggcgggcugccccaguccggccgcaucgucguggacuacauggugcagaaguccgggaagacgggcaccaucaccuaccagcggggcauccuccugccgcagaaggucuggugcgccuccgggcgcucgaaggugaucaagggcucgcugccccucaucggggaggccgacugucugcacgagaaguacggcgggcugaacaaguccaagcccuacuacaccggcgagcacgcgaaggccaucggcaacugccccaucugggugaagacgccgcucaagcuggccaacgggaccaaguaccggccgcccgccaagcugcucaaggagcgcggcuucuucggggccaucgcgggcuuccuggagggcgggugggagggcaugaucgccggguggcacggcuacaccagccacggggcccauggcgucgccguggccgcggaccugaaguccacccaggaggccaucaacaagaucacgaagaaccucaacucgcuguccgagcuggaggucaagaaccuccagcggcugucgggcgccauggacgagcugcacaacgagauccucgagcuggacgagaagguggacgaccugcgcgccgacaccaucuccagccagaucgagcucgccgugcugcuguccaacgaggggaucaucaacagugaggacgagcaccuccuggcgcuggagcggaagcucaagaagaugcugggccccuccgccgucgagaucgggaacggcugcuucgagaccaagcacaagugcaaccagaccugccuggaccgcaucgccgccgggaccuucgacgcgggcgaguucucgcuccccacguucgacucccugaacaucaccgccgccagucugaacgacgacggccucgacaaccacaccauccugcuguacuacuccaccgccgccucgucccuggcggugacgcucaugaucgccaucuucguggucuacauggugucgcgggacaacguguccugcagcaucugccuguga

SEQ ID NO: 14803 - RNA, 1758 nt, Artificial Sequence
  derived and/or modified CDS sequence (AUadapt) from InfluenzaB__AGX16555__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacgaagacccggggcaagcucugccccaagugccugaacuguaccgaccuggacguggcccucgggcgccccaagugcaccggcaacaucccguccgccaaggugucgauccugcacgagguccggcccgugacguccggcugcuuccccaucaugcacgaccgcaccaagauccggcagcugcccaaccuccugcgcggguacgagcacauccggcugagcacccacaaugugaucaacgccgagaaggcgccgggcgggcccuacaagaucggcaccuccgggucgugccccaacgucacgaacggcaacggcuucuucgccaccauggccugggccgugcccaagaacgacaacaacaagaccgcgaccaacucccucacgaucgaggugccguacaucuguaccgagggggaggaccagaucaccgucuggggcuuccacucggacaacgaggcccagauggccaagcuguacggggacuccaagccccagaaguucaccagcuccgccaacggcgugacgacccacuacgugucgcagaucggcggguuccccaaucagaccgaggacggcgggcugccccaguccggccgcaucgucguggacuacauggugcagaaguccgggaagaccggcacgaucaccuaccagcggggcauccuccugccgcagaaggucuggugcgccuccgggcgcagcaaggugaucaagggcucgcugccccucaucggggaggcggacugccugcacgagaaguacggcgggcugaacaaguccaagcccuacuacaccggcgagcacgccaaggccaucggcaauugccccaucugggugaagaccccgcucaagcuggccaacgggacgaaguaccggccgcccgccaagcugcucaaggagcgcggcuucuucggggcgaucgccggcuuccuggagggcgggugggagggcaugaucgccggguggcacggcuacaccucgcacggggcccacggcgucgccguggcggccgaccugaaguccacccaggaggccaucaacaagaucaccaagaaccucaacagucuguccgagcuggaggucaagaaccuccagcggcugucgggcgccauggacgagcugcacaacgagauccucgagcuggacgagaagguggacgaccugcgcgccgacacgaucuccucgcagaucgagcucgcggugcugcuguccaacgaggggaucaucaacagcgaggacgagcaccuccuggcccuggagcggaagcucaagaagaugcugggccccuccgccgucgagaucgggaauggcugcuucgagaccaagcacaagugcaaccagaccugccuggaccgcaucgccgcggggaccuucgacgccggcgaguucucgcuccccaccuucgacucccugaacaucacggccgccucgcugaaugacgacggccucgacaaccacaccauccugcuguacuacuccaccgccgcgagcucccuggccgugacccucaugaucgccaucuucguggucuacauggugucgcgggacaacguguccugcagcaucugccuguga

SEQ ID NO: 14804 - RNA, 1758 nt, Artificial Sequence
  derived and/or modified CDS sequence (AUadapt) from InfluenzaB__AGX16566__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaauaucccguccgccaaggugucgauccugcacgagguccggcccgugacguccggcugcuuccccaucaugcacgaccgcaccaagauccggcagcugcccaaccuccugcgcggguacgagcacauccggcugucgacccacaacgugaucaacgccgagaaggcgccgggcgggcccuacaagaucggcaccuccgggagcugccccaacgucacgaacggcaacggcuucuuugccaccauggccugggccgugcccaagaacgacaacaacaagaccgcgaccaacucccucacgaucgaggugccguacaucugcaccgagggggaggaccagaucaccgucuggggcuuccacucggacaacgagauccagauggccaagcuguacggggacuccaagccccagaaguucaccucguccgccaacggcgugacgacccacuacgugagucagaucggcggguuccccaaccagaccgaggacggcgggcugccccaguccggccgcaucgucguggacuacauggugcagaaguccgggaagaccggcacgaucaccuaccagcggggcauccuccugccgcagaaggucuggugcgccuccgggcgcucgaaggugaucaagggcucgcugccccucaucggggaggccgacugccugcacgagaaguacggcgggcugaacaaguccaagcccuacuacaccggcgagcacgcgaaggccaucggcaacugccccaucugggugaagaccccgcucaagcuggccaaugggacgaaguaccggccgcccgccaagcugcucaaggagcgcggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucaccaagaaccucaacucgcuguccgagcuggaggucaagaaccuccagcggcugucgggcgccauggacgagcugcacaacgagauccucgagcuggacgagaagguggaugaccugcgcgccgacacgaucuccagccagaucgagcucgccgugcugcuguccaacgaggggaucaucaacucggaggacgagcaccuccuggcgcuggagcggaagcucaagaagaugcugggccccuccgccgucgagaucgggaacggcugcuucgagaccaagcacaagugcaaccagaccugccuggaccgcaucgccgccgggaccuucgacgcgggcgaguucucgcuccccaccuuugacucccugaacaucacggccgccagccugaacgacgacggccucgacaaccacaccauccugcuguacuacuccaccgccgccucgucccuggcggugacccucaugaucgccaucuucguggucuacauggugucgcgggacaacguguccugcagcaucugccuguga

SEQ ID NO: 14805 - RNA, 1758 nt, Artificial Sequence; identical to SEQ ID NO: 14719
  derived and/or modified CDS sequence (AUadapt) from InfluenzaB__AGX16577__HA

SEQ ID NO: 14806 - RNA, 1758 nt, Artificial Sequence
  derived and/or modified CDS sequence (AUadapt) from InfluenzaB__AGX16588__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccaaggugucgauccugcacgagguccggcccgugacguccggcugcuuucccaucaugcacgaccgcaccaagauccggcagcugcccaaccuccugcgcggguacgagcacauccggcugucgacccacaacgugaucaacgccgagaaggcgccgggcgggcccuacaagaucggcaccuccgggucgugccccaacgucacgaacggcaacggcuucuucgccaccauggccugggccgugcccaagaacgacaacaacaagaccgcgaccaacucccucacgaucgaggugccguacaucuguaccgagggggaggaccagaucaccgucuggggcuuccacagcgacaacgagauccagauggccaagcuguacggggacuccaagccccagaaguucaccucguccgccaacggcgugacgacccacuacgugucgcagaucggcggguuccccaaccagaccgaggacggcgggcugccccaguccggccgcaucgucguggacuacauggugcagaaguccgggaagaccggcacgaucaccuaccagcggggcauccuccugccgcagaaggucuggugcgccuccgggcgcagcaaggugaucaagggcucgcugccccucaucggggaggccgauugccugcacgagaaguacggcgggcugaacaaguccaagcccuacuacaccggcgagcacgcgaaggccaucggcaacugccccaucugggugaagaccccgcucaagcuggccaacgggacgaaguaccggccgcccgccaagcugcucaaggagcgcggcuucuucggggccaucgcgggcuuccuggagggcgggugggagggcaugaucgccggguggcacggcuacaccucgcacggggcccacggcgucgccguggccgcggaccugaaguccacccaggaggccaucaacaagaucaccaagaaccucaacagucuguccgagcuggaggucaagaaccuccagcggcugagcggcgccauggacgagcugcacaacgagauccucgagcuggacgagaagguggacgaccugcgcgccgacacgaucuccucgcagaucgagcucgccgugcugcuguccaacgaggggaucaucaacucggaggacgagcaccuccuggcgcuggagcggaagcucaagaagaugcugggccccuccgccaucgagaucgggaacggcugcuucgagaccaagcacaagugcaaccagaccugccuggaccgcaucgccgccgggaccuuugacgcgggcgaguucucgcuccccaccuucgacucccugaacaucacggccgccagccugaacgacgacggccucgacaaccacaccauccugcuguacuacuccaccgccgccucgucccuggcggucacccucaugaucgccaucuucgugguguacauggucucgcgggacaacguguccugcagcaucugccuguga

SEQ ID NO: 14807 - RNA, 1758 nt, Artificial Sequence; identical to SEQ ID NO: 14719
  derived and/or modified CDS sequence (AUadapt) from InfluenzaB__AGX16599__HA

SEQ ID NO: 14808 - RNA, 1758 nt, Artificial Sequence; identical to SEQ ID NO: 14802
  derived and/or modified CDS sequence (AUadapt) from InfluenzaB__AGX16610__HA

SEQ ID NO: 14809 - RNA, 1758 nt, Artificial Sequence; identical to SEQ ID NO: 14719
  derived and/or modified CDS sequence (AUadapt) from InfluenzaB__AGX16621__HA

SEQ ID NO: 14810 - RNA, 1758 nt, Artificial Sequence
  derived and/or modified CDS sequence (AUadapt) from InfluenzaB__AGX16654__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccaaggugucgauccugcacgagguccggcccgugacguccggcugcuuucccaucaugcacgaccgcaccaagauccggcagcugcccaaccuccugcgcggguacgagcacauccggcugucgacccacaacgugaucaacgccgagaaggcgccgggcgggcccuacaagaucggcaccuccgggucgugccccaacgucacgaacggcaacggcuucuucgccaccauggccugggccgugcccaagaacgacaacaacaagaccgcgaucaacucccucaccaucgaggugccguacaucuguacggagggggaggaccagaucaccgucuggggcuuccacagcgacaacgagacccagauggccaagcuguacggggacuccaagccccagaaguucaccucguccgccaacggcgugacgacccacuacgugucgcagaucggcggguuccccaaccagaccgaggacggcgggcugccccaguccggccgcaucgucguggacuacauggugcagaaguccgggaagaccggcacgaucaccuaccagcggggcauccuccugccgcagaaggucuggugcgccuccgggcgcagcaaggugaucaagggcucgcugccccucaucggggaggccgauugccugcacgagaaguacggcgggcugaacaaguccaagcccuacuacaccggcgagcacgcgaaggccaucggcaacugccccaucugggugaagaccccgcucaagcuggccaacgggacgaaguaccggccgcccgccaagcugcucaaggagcgcggcuucuucggggccaucgcgggcuuccuggagggcgggugggagggcaugaucgccggguggcacggcuacaccucgcacggggcccacggcgucgccguggccgcggaccugaaguccacccaggaggccaucaacaagaucaccaagaaccucaacagucuguccgagcuggaggucaagaaccuccagcggcugagcggcgccauggacgagcugcacaacgagauccucgagcuggacgagaagguggacgaccugcgcgccgacacgaucuccucgcagaucgagcucgccgugcugcuguccaacgaggggaucaucaacucggaggacgagcaccuccuggcgcuggagcggaagcucaagaagaugcugggccccuccgccaucgagaucgggaacggcugcuucgagaccaagcacaagugcaaccagaccugccuggaccgcaucgccgccgggaccuuugacgcgggcgaguucucgcuccccaccuucgacucccugaacaucacggccgccagccugaacgacgacggccucgacaaccacaccauccugcuguacuacuccaccgccgccucgucccuggcggucacccucaugaucgccaucuucgugguguacauggucucgcgggacaacguguccugcagcaucugccuguga

SEQ ID NO: 14811 - RNA, 1758 nt, Artificial Sequence; identical to SEQ ID NO: 14719
  derived and/or modified CDS sequence (AUadapt) from InfluenzaB__AGX16665__HA

SEQ ID NO: 14812 - RNA, 1758 nt, Artificial Sequence; identical to SEQ ID NO: 14719
  derived and/or modified CDS sequence (AUadapt) from InfluenzaB__AGX16676__HA

SEQ ID NO: 14813 - RNA, 1758 nt, Artificial Sequence; identical to SEQ ID NO: 14719
  derived and/or modified CDS sequence (AUadapt) from InfluenzaB__AGX16687__HA

SEQ ID NO: 14814 - RNA, 1758 nt, Artificial Sequence; identical to SEQ ID NO: 14719
  derived and/or modified CDS sequence (AUadapt) from InfluenzaB__AGX16698__HA

SEQ ID NO: 14815 - RNA, 1758 nt, Artificial Sequence
  derived and/or modified CDS sequence (AUadapt) from InfluenzaB__AGX16709__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccgagaauaucccguccgccaaggugucgauccugcacgagguccggcccgugacguccggcugcuuccccaucaugcacgaccgcaccaagauccggcagcugcccaaccuccugcgcggcuacgagcacauccggcugucgacccacaacgugaucaacgccgagaaggcgcccgggggccccuacaagaucgggaccuccggcucgugccccaacgucacgaacgggaacggcuucuuugccaccauggccugggccgugcccaagaacgacaacaacaagaccgcgaccaacucccucacgaucgaggugccguacaucugcaccgagggcgaggaccagaucaccgucuggggguuccacagcgacaacgagacccagauggccaagcuguacggcgacuccaagccccagaaguucacgucguccgccaacggggugaccacccacuacgugagucagaucggcggcuuccccaaccagaccgaggacgggggccugccccaguccgggcgcaucgucguggacuacauggugcagaaguccggcaagacggggaccaucaccuaccagcggggcauccuccugccgcagaaggucuggugcgccuccggccgcagcaaggugaucaaggggucgcugccccucaucggcgaggccgacugccugcacgagaaguacgggggccugaacaaguccaagcccuacuacaccggggagcacgcgaaggccaucggcaacugccccaucugggugaagacgccgcucaagcuggccaauggcaccaaguaccggccgcccgccaagcugcucaaggagcgcggguucuucggcgccaucgcgggguuccuggagggcgggugggagggcaugaucgccggcuggcacggguacaccucgcacggcgcccacggggucgccguggccgcggaccugaaguccacccaggaggccaucaacaagaucacgaagaaccucaacucgcuguccgagcuggaggucaagaaccuccagcggcugagcggcgccauggacgagcugcacaacgagauccucgagcuggacgagaagguggaugaccugcgcgccgacaccaucuccucgcagaucgagcucgccgugcugcuguccaacgagggcaucaucaacucggaggacgagcaccuccuggcgcuggagcggaagcucaagaagaugcuggggcccuccgccgucgagaucggcaacgggugcuucgagaccaagcacaagugcaaccagaccugccuggaccgcaucgccgccggcaccuucgacgcgggggaguucucgcucccgacguuugacucccugaacaucaccgccgccagccugaacgacgacggccucgacaaccacaccauccugcuguacuacuccaccgccgccucgucccuggcggugacgcucaugaucgccaucuucguggucuacauggugucgcgggacaacguguccugcagcaucugccuguga

SEQ ID NO: 14816 - RNA, 1758 nt, Artificial Sequence; identical to SEQ ID NO: 14719
  derived and/or modified CDS sequence (AUadapt) from InfluenzaB__AGX16720__HA

SEQ ID NO: 14817 - RNA, 1758 nt, Artificial Sequence; identical to SEQ ID NO: 14719
  derived and/or modified CDS sequence (AUadapt) from InfluenzaB__AGX16731__HA

SEQ ID NO: 14818 - RNA, 1758 nt, Artificial Sequence
  derived and/or modified CDS sequence (AUadapt) from InfluenzaB__AGX16742__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaauaucccguccgccaaggugucgaucauccacgagguccggcccgugacguccggcugcuuccccaucaugcacgaccgcaccaagauccggcagcugcccaaccugcuccgcggguacgagcacauccggcugucgacccacaacgugaucaacgccgagaaggcgccgggcgggcccuacaagaucggcaccuccgggucgugccccaacgucacgaacggcaacggcuucuuugccaccauggccugggccgugcccaagaacgacaacaacaagaccgcgaccaacucccugacgaucgaggugccguacaucugcaccgagggggaggaccagaucaccgucuggggcuuccacagcgacaacgagacccagauggccaagcucuacggggacuccaagccccagaaguucacgucguccgccaacggcgugaccacccacuacgugagucagaucggcggguuccccaaccagaccgaggacggcgggcugccccaguccggccgcaucgucguggacuacauggugcagaaguccgggaagacgggcaccaucaccuaccagcggggcauccugcucccgcagaaggucuggugcgccuccgggcgcagcaaggugaucaagggcucgcugccccugaucggggaggccgacugccuccacgagaaguacggcgggcugaacaaguccaagcccuacuacaccggcgagcacgcgaaggccaucggcaacugccccaucugggugaagacgccgcugaagcucgccaaugggaccaaguaccggccgcccgccaagcugcugaaggagcgcggcuucuucggggccaucgcgggcuuccucgagggcgggugggagggcaugaucgccggguggcacggcuacaccucgcacggggcccacggcgucgccguggccgcggaccugaaguccacccaggaggccaucaacaagaucacgaagaaccugaacucgcucuccgagcuggaggucaagaaccugcagcggcucagcggcgccauggacgagcugcacaacgagauccuggagcucgacgagaagguggaugaccugcgcgccgacaccaucuccucgcagaucgagcuggccgugcuccuguccaacgaggggaucaucaacucggaggacgagcaccuccuggcgcuggagcggaagcugaagaagaugcucggccccuccgccgucgagaucgggaacggcugcuucgagaccaagcacaagugcaaccagaccugccuggaccgcaucgccgccgggaccuucgacgcgggcgaguucucgcugcccacguuugacucccucaacaucaccgccgccagccugaacgacgacggccuggacaaccacaccauccuccuguacuacuccaccgccgccucgucccuggcggugacgcugaugaucgccaucuucguggucuacauggugucgcgggacaacguguccugcagcaucugccucuga

SEQ ID NO: 14819 - RNA, 1758 nt, Artificial Sequence; identical to SEQ ID NO: 14719
  derived and/or modified CDS sequence (AUadapt) from InfluenzaB__AGX16753__HA

SEQ ID NO: 14820 - RNA, 1758 nt, Artificial Sequence; identical to SEQ ID NO: 14719
  derived and/or modified CDS sequence (AUadapt) from InfluenzaB__AGX16764__HA

SEQ ID NO: 14821 - RNA, 1758 nt, Artificial Sequence; identical to SEQ ID NO: 14719
  derived and/or modified CDS sequence (AUadapt) from InfluenzaB__AGX16775__HA

SEQ ID NO: 14822 - RNA, 1758 nt, Artificial Sequence
  derived and/or modified CDS sequence (AUadapt) from InfluenzaB__AGX16797__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggauguggcccucgggcgccccaagugcaccggcaacaugccguccgccaaggugucgauccugcacgagguccggcccgugacguccggcugcuuccccaucaugcacgaccgcaccaagauccggcagcugcccaaccuccugcgcggguacgagcacauccggcugucgacccacaacgugaucaacgccgagaaggcgccgggcgggcccuacaagaucggcaccuccgggagcugucccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacucggacaaugagacccagauggccaagcuguacggggacuccaagccccagaaguucacgucguccgccaacggcgugaccacccacuacgugagccagaucggcggguuccccaaccagaccgaggacggcgggcugccccaguccggccgcaucgucguggacuacauggugcagaaguccgggaagacgggcaccaucaccuaccagcggggcauccuccugccgcagaaggucuggugcgccuccgggcgcucgaaggugaucaagggcucgcugccccucaucggggaggccgauugccugcacgagaaguacggcgggcugaacaaguccaagcccuacuacaccggcgagcacgcgaaggccaucggcaacugccccaucugggugaagacgccgcucaagcuggccaacgggaccaaguaccggccgcccgccaagcugcucaaggagcgcggcuucuucggggccaucgcgggcuuccuggagggcgggugggagggcaugaucgccggguggcacggcuacaccagccauggggcccacggcgucgccguggccgcggaccugaaguccacccaggaggccaucaacaagaucacgaagaaccucaacucgcuguccgagcuggaggucaagaaccuccagcggcugucgggcgccauggacgagcugcacaacgagauccucgagcuggacgagaagguggacgaccugcgcgccgacaccaucuccagccagaucgagcucgccgugcugcuguccaacgaggggaucaucaauucggaggacgagcaccuccuggcgcuggagcggaagcucaagaagaugcugggccccuccgccgucgagaucgggaacggcugcuucgagaccaagcacaagugcaaccagaccugccuggaccgcaucgccgccgggaccuucgacgcgggcgaguucucgcuccccacguucgacucccugaauaucaccgccgccagccugaacgacgacggccucgacaaccacaccauccugcuguacuacuccaccgccgccucgucccuggcggugacgcucaugaucgccaucuucguggucuacauggugucgcgggacaacguguccugcagcaucugccuguga

SEQ ID NO: 14823 - RNA, 1758 nt, Artificial Sequence; identical to SEQ ID NO: 14719
  derived and/or modified CDS sequence (AUadapt) from InfluenzaB__AGX16808__HA

SEQ ID NO: 14824 - RNA, 1758 nt, Artificial Sequence
  derived and/or modified CDS sequence (AUadapt) from InfluenzaB__AGX16819__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacgaagacccggggcaagcucugccccaagugccugaacugcaccgaccuggauguggcccucgggcgccccaagugcaccggcaacaucccguccgccaaggugucgauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggucgugucccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacucggacuccgagacccagauggccaagcuguauggggacagcaagccccagaaguucacguccucggccaacggcgugaccacccacuacgugucccagaucggcggguuccccaaccagaccgaggacggcgggcugccccagucgggccgcaucgucguggacuacauggugcagaaguccgggaagacgggcaccaucaccuaccagcggggcauccuccugccgcagaaggucuggugcgccagcgggcgcucgaaggugaucaagggcucccugccccucaucggggaggccgauugccugcacgagaaguacggcgggcugaacaagucgaagcccuacuacaccggcgagcacgcgaaggccaucggcaacugccccaucugggugaagacgccgcucaagcuggccaacgggaccaaguaccggccgcccgccaagcugcucaaggagcgcggcuucuucggggccaucgcgggcuuccuggagggcgggugggagggcaugaucgccggguggcacggcuacaccucccauggggcccacggcgucgccguggccgcggaccugaaguccacccaggaggccaucaacaagaucacgaagaaccucaacucccugagcgagcuggaggucaagaaccuccagcggcuguccggcgccauggacgagcugcacaacgagauccucgagcuggacgagaagguggacgaccugcgcgccgacaccaucucgucccagaucgagcucgccgugcugcugucgaacgaggggaucaucaauuccgaggacgagcaccuccuggcgcuggagcggaagcucaagaagaugcugggccccagcgccgucgagaucgggaacggcugcuucgagaccaagcacaagugcaaccagaccugccuggaccgcaucgccgccgggaccuucgacgcgggcgaguucucccuccccacguucgacucgcugaauaucaccgccgccucccugaacgacgacggccucgacaaccacaccauccugcuguacuacucgaccgccgccuccagccuggcggugacgcucaugaucgccaucuucaucguguacauggucucccgggacaacgugucgugcagcaucugccuguga

SEQ ID NO: 14825 - RNA, 1758 nt, Artificial Sequence; identical to SEQ ID NO: 14719
  derived and/or modified CDS sequence (AUadapt) from InfluenzaB__AGX16830__HA

SEQ ID NO: 14826 - RNA, 1758 nt, Artificial Sequence
  derived and/or modified CDS sequence (AUadapt) from InfluenzaB__AGX16841__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggauguggcccucgggcgccccaagugcaccggcaacaucccguccgccaaggugucgauccugcacgagguccggcccgugacguccggcugcuuccccaucaugcacgaccgcaccaagauccggcagcugcccaaccuccugcgcggguacgagcacauccggcugucgacccacaacgugaucaacgccgagaaggcgccgggcgggcccuacaagaucggcaccuccgggagcugucccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacucggacaaugagacccagauggccaagcuguacggggacuccaagccccagaaguucacgucguccgccaacggcaugaccacccacuacgugagccagaucggcggguuccccaaccagaccgaggacggcgggcugccccaguccggccgcaucguggucgacuacauggugcagaaguccgggaagacgggcaccaucaccuaccagcggggcauccuccugccgcagaagguguggugcgccuccgggcgcucgaaggucaucaagggcucgcugccccucaucggggaggccgauugccugcacgagaaguacggcgggcugaacaaguccaagcccuacuacaccggcgagcacgcgaaggccaucggcaacugccccaucugggugaagacgccgcucaagcuggccaacgggaccaaguaccggccgcccgccaagcugcucaaggagcgcggcuucuucggggccaucgcgggcuuccuggagggcgggugggagggcaugaucgccggguggcacggcuacaccagccauggggcccacggcguggccgucgccgcggaccugaaguccacccaggaggccaucaacaagaucacgaagaaccucaacucgcuguccgagcuggaggugaagaaccuccagcggcugucgggcgccauggacgagcugcacaacgagauccucgagcuggacgagaaggucgacgaccugcgcgccgacaccaucuccagccagaucgagcucgccgugcugcuguccaacgaggggaucaucaauucggaggacgagcaccuccuggcgcuggagcggaagcucaagaagaugcugggccccuccgccguggagaucgggaacggcugcuucgagaccaagcacaagugcaaccagaccugccuggaccgcaucgccgccgggaccuucgacgcgggcgaguucucgcuccccacguucgacucccugaauaucaccgccgccagccugaacggcgacgggcucgacaaccacaccauccugcuguacuacuccaccgccgccucgucccuggcggucacgcucaugaucgccaucuucgugguguacauggucucgcgggacaacguguccugcagcaucugccuguga

SEQ ID NO: 14827 - RNA, 1758 nt, Artificial Sequence
  derived and/or modified CDS sequence (AUadapt) from InfluenzaB__AGX16852__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaauaucccguccgccaaggugucgauccugcacgagguccggcccgugacguccggcugcuuccccaucaugcacgaccgcaccaagauccggcagcugcccaaccuccugcgcggguacgagcacauccggcugucgacccacaacgugaucaacgccgagaaggcgccgggcgggcccuacaagaucggcaccuccgggucgugccccaacgucacgaacggcaacggcuucuuugccaccauggccugggccgugcccaagaacgacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgucguccgccaacggcgugaccacccacuacgugagucagaucggcggguuccccaaccagaccgaggacggcgggcugccccaguccggccgcaucgucguggacuacauggugcagaaguccgggaagacgggcaccaucaccuaccagcggggcauccuccugccgcagaaggucuggugcgccuccgggcgcagcaaggugaucaagggcucgcugccccucaucggggaggccgacugccugcacgagaaguacggcgggcugaacaaguccaagcccuacuacaccggcgagcacgcgaaggccaucggcaacugccccaucugggugaagacgccgcucaagcuggccaaugggaccaaguaccggccgcccgccaagcugcucaaggagcgcggcuucuucggggccaucgcgggcuuccuggagggcgggugggagggcaugaucgccggguggcacggcuacaccucgcacggggcccacggcgucgccguggccgcggaccugaaguccacccaggaggccaucaacaagaucacgaagaaccucaacucgcuguccgagcuggaggucaagaaccuccagcggaucagcggcgccauggacgagcugcacaacgagauccuggagcucgacgagaagguggaugaccugcgcgccgacaccaucuccucgcagaucgagcuggccgugcuccuguccaacgaggggaucaucaacucggaggacgagcaccuccuggcgcuggagcggaagcugaagaagaugcucggccccuccgccgucgagaucgggaacggcugcuucgagaccaagcacaagugcaaccagaccugccuggaccgcaucgccgccgggaccuucgacgcgggcgaguucucgcugcccacguuugacucccucaacaucaccgccgccagccugaacgacgacggccuggacaaccacaccauccuccuguacuacuccaccgccgccucgucccuggcggugacgcugaugaucgccaucuucguggucuacauggugucgcgggacaacguguccugcagcaucugccucuga

SEQ ID NO: 14828 - RNA, 1758 nt, Artificial Sequence; identical to SEQ ID NO: 14719
  derived and/or modified CDS sequence (AUadapt) from InfluenzaB__AGX16863__HA

SEQ ID NO: 14829 - RNA, 1758 nt, Artificial Sequence; identical to SEQ ID NO: 14719
  derived and/or modified CDS sequence (AUadapt) from InfluenzaB__AGX16874__HA

SEQ ID NO: 14830 - RNA, 1758 nt, Artificial Sequence
  derived and/or modified CDS sequence (AUadapt) from InfluenzaB__AGX16885__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaauaucccguccgccaaggugucgauccugcacgagguccggcccgugacguccggcugcuuccccaucaugcacgaccgcaccaagauccggcagcugcccaaccuccugcgcggguacgagcacauccggcugucgacccacaacgugaucaacgccgagaaggcgccgggcgggcccuacaagaucggcaccuccgggucgugccccaacgucacgaacggcaacggcuucuuugccaccauggccugggccgugcccaagaacgacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgucguccgccaacggcgugaccacccacuacgugagucagaucggcggguuccccaaccagaccgaggacggcgggcugccccaguccggccgcaucgucguggacuacauggugcagaaguccgggaagacgggcaccaucaccuaccagcggggcauccuccugccgcagaaggucuggugcgccuccgggcgcagcaaggugaucaagggcucgcugccccucaucggggaggccgacugccugcacgagaaguacggcgggcugaacaaguccaagcccuacuacaccggcgagcacgcgaaggccaucggcaacugccccaucugggugaagacgccgcucaagcuggccaaugggaccaaguaccggccgcccgccaagcugcucaaggagcgcggcuucuucggggccaucgcgggcuuccuggagggcgggugggagggcaugaucgccggguggcacggcuacaccucgcacggggcccacggcgucgccguggccgcggaccugaaguccacccaggaggccaucaacaagaucacgaagaaccucaacucgcuguccgagcuggaggucaagaaccuccagcggcugagcggcgccauggacgagcugcacaacgagauccucgagcuggacgagaagguggaugaccugcgcgccgacaccaucuccucgcagaucgagcucgccgugcugcuguccaacgaggggaucaucaacucggaggacgagcaccuccuggcgcuggagcggaagcucaagaagaugcugggccccuccgccaucgagaucgggaacggcugcuucgagaccaagcacaagugcaaccagaccugccuggaccgcaucgccgccgggaccuucgacgcgggcgaguucucgcuccccacguuugacucccugaacaucaccgccgccagccugaacgacgacggccucgacaaccacaccauccugcuguacuacuccaccgccgccucgucccuggcggucacgcucaugaucgccaucuucgugguguacauggucucgcgggacaacguguccugcagcaucugccuguga

SEQ ID NO: 14831 - RNA, 1758 nt, Artificial Sequence; identical to SEQ ID NO: 14830
  derived and/or modified CDS sequence (AUadapt) from InfluenzaB__AGX16896__HA

SEQ ID NO: 14832 - RNA, 1758 nt, Artificial Sequence; identical to SEQ ID NO: 14719
  derived and/or modified CDS sequence (AUadapt) from InfluenzaB__AGX16907__HA

SEQ ID NO: 14833 - RNA, 1758 nt, Artificial Sequence; identical to SEQ ID NO: 14804
  derived and/or modified CDS sequence (AUadapt) from InfluenzaB__AGX16918__HA

SEQ ID NO: 14834 - RNA, 1758 nt, Artificial Sequence; identical to SEQ ID NO: 14719
  derived and/or modified CDS sequence (AUadapt) from InfluenzaB__AGX16940__HA

SEQ ID NO: 14835 - RNA, 1758 nt, Artificial Sequence; identical to SEQ ID NO: 14830
  derived and/or modified CDS sequence (AUadapt) from InfluenzaB__AGX16951__HA

SEQ ID NO: 14836 - RNA, 1758 nt, Artificial Sequence
  derived and/or modified CDS sequence (AUadapt) from InfluenzaB__AGX16962__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccgagagccacuucgccaaccugaaggggacgaagacccggggcaagcucugccccaagugccugaacugcaccgaccuggauguggcccucgggcgccccaagugcaccggcaacaucccguccgccaaggugucgauccugcacgagguccggcccgugacguccggcugcuuccccaucaugcacgaccgcaccaagauccggcagcugcccaaccuccugcgcggguacgagcacauccggcugucgacccacaacgugaucaacgccgagaaggcgccgggcgggcccuacaagaucggcaccuccgggagcugucccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacucggacaaugagacccagauggccaagcuguacggggacuccaagccccagaaguucacgucguccgccaacggcgugaccacccacuacgugagccagaucggcggguuccccaaccagaaggaggacggcgggcugccccaguccggccgcaucgucguggacuacauggugcagaaguccgggaacaccggcacgaucaccuaccagcggggcauccuccugccgcagaaggucuggugcgccuccgggcgcucgaaggugaucaagggcucgcugccccucaucggggaggccgauugccugcacgagaaguacggcgggcugaacaaguccaagcccuacuacaccggcgagcacgcgaaggccaucggcaacugccccaucugggugaagaccccgcucaagcuggccaacgggacgaaguaccggccgcccgccaagcugcucaaggagcgcggcuucuucggggccaucgcgggcuuccuggagggcgggugggagggcaugaucgccggguggcacggcuacaccagccauggggcccacggcgucgccguggccgcggaccugaaguccacccaggaggccaucaacaagaucaccaagaaccucaacucgcuguccgagcuggaggucaagaaccuccagcggcugucgggcgccauggacgagcugcacaacgagauccucgagcuggacgagaagguggacgaccugcgcgccgacacgaucuccagccagaucgagcucgccgugcugcuguccaacgaggggaucaucaauucggaggacgagcaccuccuggcgcuggagcggaagcucaagaagaugcugggccccuccgccgucgagaucgggaacggcugcuucgagaccaagcacaagugcaaccagaccugccuggaccgcaucgccgccgggaccuucgacgcgggcgaguucucgcuccccaccuucgacucccugaauaucacggccgccagccugaacgacgacggccucgacaaccacaccauccugcuguacuacuccaccgccgccucgucccuggcggugacccucaugaucgccaucuucguggucuacauggugucgcgggacaacguguccugcagcaucugccuguga

SEQ ID NO: 14837 - RNA, 1758 nt, Artificial Sequence; identical to SEQ ID NO: 14719
  derived and/or modified CDS sequence (AUadapt) from InfluenzaB__AGX16973__HA

SEQ ID NO: 14838 - RNA, 1758 nt, Artificial Sequence
  derived and/or modified CDS sequence (AUadapt) from InfluenzaB__AGX16995__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacgaagacccggggcaagcucugccccaagugccugaacugcaccgaccuggauguggcccucgggcgccccaagugcaccggcaacaucccguccgccaaggugucgauccugcacgagguccggcccgugacguccggcugcuuccccaucaugcacgaccgcaccaagauccggcagcugcccaaccuccugcgcggguacgagcacauccggcugagcacccacaacgugaucaacgccgagaaggcgccgggcgggcccuacaagaucggcaccuccgggucgugucccaacgucacgaacggcaacggcuucuucgccaccauggccugggccgugcccaagaacgacaacaacaagaccgcgaccaacucccucacgguggaggucccguacaucugcaccgagggggaggaccagaucaccguguggggcuuccacucggacaaugagauccagauggccaagcuguacggggacuccaagccccagaaguucaccagcuccgccaacggcgugacgacccacuacgucucgcagaucggcggguuccccaaccagaccgaggacggcgggcugccccaguccggccgcaucgugguggacuacaugguccagaaguccgggaagaccggcacgaucaccuaccagcggggcauccuccugccgcagaagguguggugcgccuccgggcgcagcaaggugaucaagggcucgcugccccucaucggggaggccgauugccugcacgagaaguacggcgggcugaacaaguccaagcccuacuacaccggcgagcacgcgaaggccaucggcaacugccccaucugggucaagaccccgcucaagcuggccaacgggacgaaguaccggccgcccgccaagcugcucaaggagcgcggcuucuucggggccaucgcgggcuuccuggagggcgggugggagggcaugaucgccggguggcacggcuacaccucgcauggggcccacggcguggccgucgccgcggaccugaaguccacccaggaggccaucaacaagaucaccaagaaccucaacagccuguccgagcuggaggugaagaaccuccagcggcugucgggcgccauggacgagcugcacaacgagauccucgagcuggacgagaagguggacgaccugcgcgccgacacgaucuccucgcagaucgagcucgccguccugcuguccaacgaggggaucaucaauagcgaggacgagcaccuccuggcgcuggagcggaagcucaagaagaugcugggccccuccgccguggagaucgggaacggcugcuucgagaccaagcacaagugcaaccagaccugccuggaccgcaucgccgccgggaccuucgacgcgggcgaguucucgcuccccaccuucgacucccugaauaucacggccgccucgcugaacgacgacggccucgacaaccacaccauccugcuguacuacuccaccgccgccagcucccuggcggugacccucaugaucgccaucuucgucguguacauggugucgcgggacaacgucuccugcagcaucugccuguga

SEQ ID NO: 14839 - RNA, 1758 nt, Artificial Sequence
  derived and/or modified CDS sequence (AUadapt) from InfluenzaB__AGX17006__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaauaucccguccgccaaggugucgauccugcacgagguccggcccgugacguccggcugcuuccccaucaugcacgaccgcaccaagauccggcagcugcccaaccuccugcgcggguacgagcacauccggcugucgacccacaacgugaucaacgccgagaaggcgccgggcgggcccuacaagaucggcaccuccgggucgugccccaacgucacgaacggcaacggcuucuuugccaccauggccugggccgugcccaagaacgacaacaacaagaccgcgaccaacucccucacgaucgaggugccguacaucugcaccgagggggaggaccagaucaccgucuggggcuuccacagcgacaacgagaaccagauggccaagcuguacggggacuccaagccccagaaguucaccucguccgccaacggcgugacgacccacuaugugucgcagaucggcggguuccccaaccagaccgaggacggcgggcugccccaguccggccgcaucgucguggacuacauggugcagaaguccgggaagaccggcacgaucaccuaccagcggggcauccuccugccgcagaaggucuggugcgccuccgggcgcagcaaggugaucaagggcucgcugccccucaucggggaggccgacugccugcacgagaaguacggcgggcugaacaaguccaagcccuacuacaccggcgagcacgcgaaggccaucggcaacugccccaucugggugaagaccccgcucaagcuggccaaugggacgaaguaccggccgcccgccaagcugcucaaggagcgcggcuucuucggggccaucgcgggcuuccuggagggcgggugggagggcaugaucgccggguggcacggcuacaccucgcacggggcccacggcgucgccguggccgcggaccugaaguccacccaggaggccaucaacaagaucaccaagaaccucaacucgcuguccgagcuggaggucaagaaccuccagcggcugagcggcgccauggacgagcugcacaacgagauccucgagcuggacgagaagguggaugaccugcgcgccgacacgaucuccucgcagaucgagcucgccgugcugcuguccaacgaggggaucaucaacucggaggacgagcaccuccuggcgcuggagcggaagcucaagaagaugcugggccccuccgccgucgagaucgggaacggcugcuucgagaccaagcacaagugcaaccagaccugccuggaccgcaucgccgccgggaccuucgacgcgggcgaguucucgcuccccaccuuugacucccugaacaucacggccgccagccugaacgacgacggccucgacaaccacaccauccugcuguacuacuccaccgccgccucgucccuggcggugacccucaugaucgccaucuucguggucuacauggugucgcgggacaacguguccugcagcaucugccuguga

SEQ ID NO: 14840 - RNA, 1758 nt, Artificial Sequence; identical to SEQ ID NO: 14719
  derived and/or modified CDS sequence (AUadapt) from InfluenzaB__AGX17017__HA

SEQ ID NO: 14841 - RNA, 1758 nt, Artificial Sequence; identical to SEQ ID NO: 14719
  derived and/or modified CDS sequence (AUadapt) from InfluenzaB__AGX17028__HA

SEQ ID NO: 14842 - RNA, 1758 nt, Artificial Sequence
  derived and/or modified CDS sequence (AUadapt) from InfluenzaB__AGX17039__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccgagagccacuucgccaaccugaaggggacgaagacccggggcaagcucugccccaagugccugaacugcaccgaccuggauguggcccucgggcgccccaagugcaccggcaacaucccguccgccaaggugucgauccugcacgagguccggcccgugacguccggcugcuuccccaucaugcacgaccgcaccaagauccggcagcugcccaaccuccugcgcggguacgagcacauccggcugucgacccacaacgugaucaacgccgagaaggcgccgggcgggcccuacaagaucggcaccuccgggagcugucccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacucggacaaugagacccagauggccaagcuguacggggacuccaagccccagaaguucacgucguccgccaacggcgugaccacccacuacgugagccagaucggcggguuccccaaccagaccgaggacggcgggcugccccaguccggccgcaucgucguggacuacauggugcagaaguccgggaacacgggcaccaucaccuaccagcggggcauccuccugccgcagaaggucuggugcgccuccgggcgcucgaaggugaucaagggcucgcugccccucaucggggaggccgauugccugcacgagaaguacggcgggcugaacaaguccaagcccuacuacaccggcgagcacgcgaaggccaucggcaacugccccaucugggugaagacgccgcucaagcuggccaacgggaccaaguaccggccgcccgccaagcugcucaaggagcgcggcuucuucggggccaucgcgggcuuccuggagggcgggugggagggcaugaucgccggguggcacggcuacaccagccauggggcccacggcgucgccguggccgcggaccugaaguccacccaggaggccaucaacaagaucacgaagaaccucaacucgcuguccgagcuggaggucaagaaccuccagcggcugucgggcgccauggacgagcugcacaacgagauccucgagcuggacgagaagguggacgaccugcgcgccgacaccaucuccagccagaucgagcucgccgugcugcuguccaacgaggggaucaucaauucggaggacgagcaccuccuggcgcuggagcggaagcucaagaagaugcugggccccuccgccgucgagaucgggaacggcugcuucgagaccaagcacaagugcaaccagaccugccuggaccgcaucgccgccgggaccuucgacgcgggcgaguucucgcuccccacguucgacucccugaauaucaccgccgccagccugaacgacgacggccucgacaaccacaccaucaugcuguacuacuccaccgccgccucgucccuggcggugacgcugaugaucgccaucuucguggucuacauggugucgcgggacaacguguccugcagcaucugccucuga

SEQ ID NO: 14843 - RNA, 1758 nt, Artificial Sequence; identical to SEQ ID NO: 14719
  derived and/or modified CDS sequence (AUadapt) from InfluenzaB__AGX17050__HA

SEQ ID NO: 14844 - RNA, 1758 nt, Artificial Sequence
  derived and/or modified CDS sequence (AUadapt) from InfluenzaB__AGX17061__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaauaucccguccgccaaggugucgauccugcacgagguccggcccgugacguccggcugcuuccccaucaugcacgaccgcaccaagauccggcagcugcccaaccuccugcgcggguacgagcggauccgccugucgaaccacaacgugaucaacgccgagaaggcgccgggcgggcccuacaagaucggcaccuccgggucgugccccaacgucaccaacggcaacggcuucuuugccacgauggccugggccgugcccaagaacgagaacaacaagaccgcgaccaacucccucaccaucgaggugccguacaucugcacggagggggaggaccagaucaccgucuggggcuuccacagcgacaacgagacccagauggccaagcuguacggggacuccaagccccagaaguucaccucguccgccaacggcgugacgacccacuacgugagucagaucggcggguuccccaaccagaccgaggacggcgggcugccccaguccggccggaucgucguggacuacauggugcagaaguccgggaagaccggcacgaucaccuaccagcgcggcauccuccugccgcagaaggucuggugcgccuccgggcggagcaaggugaucaagggcucgcugccccucaucggggaggccgacugccugcacgagaaguacggcgggcugaacaaguccaagcccuacuacaccggcgagcacgcgaaggccaucggcaacugccccaucugggugaagaccccgcucaagcuggccaacgggacgaaguaucgcccgcccgccaagcugcucaaggagcggggcuucuucggggccaucgcgggcuuccuggagggcgggugggagggcaugaucgccggguggcacggcuacaccucgcacggggcccacggcgucgccguggccgcggaccugaaguccacccaggaggccaucaacaagaucaccaagaaccucaacucgcuguccgagcuggaggucaagaaccuccagcgccugagcggcgccauggacgagcugcacaacgagauccucgagcuggacgagaagguggaugaccugcgggccgacacgaucuccucgcagaucgagcucgccgugcugcuguccaacgaggggaucaucaacucggaggacgagcaccuccuggcgcuggagcgcaagcucaagaagaugcugggccccuccgccgucgagaucgggaacggcugcuucgagaccaagcacaagugcaaccagaccugccuggaccggaucgccgccgggaccuucaacgcgggcgaguucucgcuccccaccuuugacucccugaacaucacggccgccagccugaacgacgacggccucgacaaccacaccauccugcuguacuacuccaccgccgccucgucccuggcggugacccucaugaucgccaucuucguggucuacauggugucgcgcgacaacguguccugcagcaucugccuguga

SEQ ID NO: 14845 - RNA, 1758 nt, Artificial Sequence
  derived and/or modified CDS sequence (AUadapt) from InfluenzaB__AGX17072__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccgagucgcacuucgccaaccugaaggggacgaagacccggggcaagcucugccccaagugccugaacuguaccgaccuggacguggcccucgggcgccccaagugcaccggcaacaucccguccgccaaggugucgauccugcacgagguccggcccgugacguccggcugcuuccccaucaugcacgaccgcaccaagauccggcagcugcccaaccuccugcgcggguacgagcacauccggcugagcacccacaaugugaucaacgccgagaaggcgccgggcgggcccuacaagaucggcaccuccgggucgugccccaacgucacgaacggcaacggcuucuucgccaccauggccugggccgugcccaagaacgacaacaacaagaccgcgaccaacucccucacgaucgaggugccguacaucuguaccgagggggaggaccagaucaccgucuggggcuuccacucggacaacgagacccagauggccaagcuguacggggacuccaagccccagaaguucacgagcuccgccaacggcgugaccacccacuacgugucgcagaucggcggguuccccaaucagaccgaggacggcgggcugccccaguccggccgcaucgucguggacuacauggugcagaaguccgggaacacgggcaccaucaccuaccagcggggcauccuccugccgcagaaggucuggugcgccuccgggcgcagcaaggugaucaagggcucgcugccccucaucggggaggccgacugccugcacgagaaguacggcgggcugaacaaguccaagcccuacuacaccggcgagcacgcgaaggccaucggcaauugccccaucugggugaagacgccgcucaagcuggccaacgggaccaaguaccggccgcccgccaagcugcucaaggagcgcggcuucuucggggccaucgcgggcuuccuggagggcgggugggagggcaugaucgccggguggcacggcuacaccucgcacggggcccacggcgucgccguggccgcggaccugaaguccacccaggaggccaucaacaagaucacgaagaaccucaacagucuguccgagcuggaggucaagaaccuccagcggcugucgggcgccauggacgagcugcacaacgagauccucgagcuggacgagaagguggacgaccugcgcgccgacaccaucuccucgcagaucgagcucgccgugcugcuguccaacgaggggaucaucaacagcgaggacgagcaccuccuggcgcuggagcggaagcucaagaagaugcugggccccuccgccgucgagaucgggaauggcugcuucgagaccaagcacaagugcaaccagaccugccuggaccgcaucgccgccgggaccuucgacgcgggcgaguucucgcuccccacguucgacucccugaacaucaccgccgccucgcugaaugacgacggccucgacaaccacaccauccugcuguacuacuccaccgccgccagcucccuggcggugacgcucaugaucgccaucuucguggucuacauggugucgcgggacaacguguccugcagcaucugccuguga

SEQ ID NO: 14846 - RNA, 1758 nt, Artificial Sequence; identical to SEQ ID NO: 14830
  derived and/or modified CDS sequence (AUadapt) from InfluenzaB__AGX17083__HA

SEQ ID NO: 14847 - RNA, 1758 nt, Artificial Sequence
  derived and/or modified CDS sequence (AUadapt) from InfluenzaB__AGX17094__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacgaagacccggggcaagcucugccccaagugccugaacuguaccgaccuggacguggcccucgggcgccccaagugcaccggcaacaucccguccgccaaggugucgauccugcacgagguccggcccgugacguccggcugcuuccccaucaugcacgaccgcaccaagauccggcagcugcccaaccuccugcgcggguacgagcacauccggcugagcacccacaaugugaucaacgccgagaaggcgccgggcgggcccuacaagaucggcaccuccgggucgugccccaacgucacgaacggcaacggcuucuucgccaccauggccugggccgugcccaagaacgacaacaacaagaccgcgaccaacucccucacgaucgaggugccguacaucuguaccgagggggaggaccagaucaccgucuggggcuuccacagcgacuccgagacccagauggccaagcuguacggggacucgaagccccagaaguucacguccucggccaacggcgugaccacccacuacgugucccagaucggcggguuccccaaccagaccgaggauggcgggcugccccagagcggccgcaucgucguggacuacauggugcagaaguccgggaagacgggcaccaucaccuaccagcggggcauccuccugccgcagaaggucuggugcgccucggggcgcagcaaggugaucaagggcucccugccccucaucggggaggccgacugccugcacgagaaguacggcgggcugaacaagucgaagcccuacuacaccggcgagcaugcgaaggccaucggcaacugccccaucugggugaagacgccgcucaagcuggccaacgggaccaaguaccggccgcccgccaagcugcucaaggagcgcggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagugagcuggaggucaagaaccuccagcggcuguccggcgccauggacgagcugcacaacgagauccucgagcuggacgagaagguggacgaccugcgcgccgacaccaucagcucccagaucgagcucgccgugcugcugucgaacgaggggaucaucaacuccgaggacgagcaccuccuggcgcuggagcggaagcucaagaagaugcugggccccagcgccgucgagaucgggaauggcugcuucgagaccaagcacaagugcaaccagaccugccuggaccgcaucgccgccgggaccuucgacgcgggcgaguucucccuccccacguucgacucgcugaacaucaccgccgccucccugaacgaugacggccucgacaaccacaccauccugcuguacuacucgaccgccgccuccagccuggcggugacgcucaugaucgccaucuucguggucuacauggugucccgggacaacgugucgugcagcaucugccuguga

SEQ ID NO: 14848 - RNA, 1758 nt, Artificial Sequence
  derived and/or modified CDS sequence (AUadapt) from InfluenzaB__AGX17105__HA
augaaggccaucaucgugcugcucauggucgugaccaguaacgccgaccgcaucugcaccggcaucacguccucgaacucgccccacguggucaagaccgcgacccagggggagaucaacgugaccggcgugaucccgcugacgaccacccccaccaagucgcacuucgccaaccugaaggggacgaagacccggggcaagcucugccccaagugccugaacugcaccgaccuggacgucgcccucgggcgccccaagugcaccggcaacaucccguccgccaaggugucgauccugcacgaggugcggcccgucacguccggcugcuuccccaucaugcacgaccgcaccaagauccggcagcugcccaaccuccugcgcggguacgagcauauccggcugagcacccacaacgugaucaacgccgagaaggcgccgggcgggcccuacaagaucggcaccuccgggucgugccccaacgugacgaacggcaacggcuucuucgccaccauggccugggccguccccaagaacgacaacaacaagaccgcgaccaacucccucacgaucgaggugccgcacaucugcaccgagggggaggaccagaucaccguguggggcuuccacucggacaacgagauccagauggccaagcuguacggggacuccaagccccagaaguucaccaguuccgccaacggcgucacgacccacuacaucucgcagaucggcggguuccccaaccagaccgaggacggcgggcugccccaguccggccgcaucgugguggacuacaugguccagaaguccgggaagaccggcacgaucaccuaccagcggggcauccuccugccgcagaagguguggugcgccuccgggcgcagcaaggugaucaagggcucgcugccccucaucggggaggccgacugccugcacgagaaguacggcgggcugaacaaguccaagcccuacuacaccggcgagcacgcgaaggccaucggcaacugccccaucugggucaagaccccgcucaagcuggccaacgggacgaaguaccggccgcccgccaagcugcucaaggagcgcggcuucuucggggccaucgcgggcuuccuggagggcgggugggagggcaugaucgccggguggcauggcuacaccucgcacggggcccacggcguggccguggccgcggaccugaaguccacccaggaggccaucaacaagaucaccaagaaccucaacucgcuguccgagcuggaggucaagaaccuccagcggcugucgggcgccauggacgagcugcacaacgagauccucgagcuggacgagaagguggacgaccugcgcgccgacacgaucuccucgcagaucgagcucgccguccugcuguccaacgaggggaucaucaacagcgaggacgagcaccuccuggcgcuggagcggaagcucaagaagaugcugggccccuccgccaucgagaucgggaacggcugcuucgagaccaagcacaaguguaaccagaccugccuggaccgcaucgccgccgggaccuucgacgcgggcgaguucucgcuccccaccuucgacucccugaacaucacggccgccucgcugaacgacgacggccucgacaaccacaccauccugcuguacuacuccaccgccgccucgucccuggcggugacccucaugaucgccaucuucguggucuacauggugucgcgggacaacguguccugcagcaucugccuguga

SEQ ID NO: 14849 - RNA, 1758 nt, Artificial Sequence; identical to SEQ ID NO: 14830
  derived and/or modified CDS sequence (AUadapt) from InfluenzaB__AGX17116__HA

SEQ ID NO: 14850 - RNA, 1758 nt, Artificial Sequence
  derived and/or modified CDS sequence (AUadapt) from InfluenzaB__AGX17127__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccgagagccacuucgccaaccugaaggggacgaagacccggggcaagcucugccccaagugccugaacugcaccgaccuggauguggcccucgggcgccccaagugcaccggcaacaucccguccgccaaggugucgauccugcacgagguccggcccgugacguccggcugcuuccccaucaugcacgaccgcaccaagauccggcagcugcccaaccuccugcgcggguacgagcacauccggcugucgacccacaacgugaucaacgccgagaaggcgccgggcgggcccuacaagaucggcaccuccgggagcugucccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacucggacaacgagaaucagauggccaagcuguacggggacuccaagccccagaaguucaccucguccgccaacggcgugacgacccacuacgugagccagaucggcggguuccccaaccagaccgaggacggcgggcugccccaguccggccgcaucgucguggacuacauggugcagaaguccgggaacaccggcacgaucaccuaccagcggggcauccuccugccgcagaaggucuggugcgccuccgggcgcucgaaggugaucaagggcagucugccccucaucggggaggccgacugccugcacgagaaguacggcgggcugaacaaguccaagcccuacuacaccggcgagcacgcgaaggccaucggcaacugccccaucugggugaagaccccgcucaagcuggccaacgggacgaaguaccggccgcccgccaagcugcucaaggagcgcggcuucuucggggccaucgcgggcuuccuggagggcgggugggagggcaugaucgccggguggcacggcuacaccagucacggggcccacggcgucgccguggccgcggaccugaaguccacccaggaggccaucaacaagaucaccaagaaccucaacucgcuguccgagcuggaggucaagaaccuccagcggcugucgggcgccauggacgagcugcacaacgagauccucgagcuggacgagaagguggacgaccugcgcgccgacacgaucuccagccagaucgagcucgccgugcugcuguccaacgaggggaucaucaauucggaggacgagcaccuccuggcgcuggagcggaagcucaagaagaugcugggccccuccgccgucgagaucgggaacggcugcuucgagaccaagcacaagugcaaccagaccugccuggaccgcaucgccgccgggaccuucgacgcgggcgaguucucgcuccccaccuucgacucccugaauaucacggccgccagccugaacgacgacggccucgacaaccacaccauccugcuguacuacuccaccgccgccucgucccuggcggugacccucaugaucgccaucuucguggucuacauggugucgcgggacaacguguccugcagcaucugccuguga

SEQ ID NO: 14851 - RNA, 1758 nt, Artificial Sequence; identical to SEQ ID NO: 14839
  derived and/or modified CDS sequence (AUadapt) from InfluenzaB__AGX17138__HA

SEQ ID NO: 14852 - RNA, 1758 nt, Artificial Sequence; identical to SEQ ID NO: 14839
  derived and/or modified CDS sequence (AUadapt) from InfluenzaB__AGX17149__HA

SEQ ID NO: 14853 - RNA, 1758 nt, Artificial Sequence
  derived and/or modified CDS sequence (AUadapt) from InfluenzaB__AGX17160__HA
augaaggccaucaucgugcugcucauggucgugaccaguaacgccgaccgcaucugcaccggcaucacguccucgaacucgccccacguggucaagaccgcgacccagggggaggugaacgugaccggcaugaucccgcugacgaccacccccaccaagagccacuucgccaaccugaaggggacgaagacccggggcaagcucugccccaagugccugaacugcaccgaccuggacgucgcccucgggcgccccaagugcaccggcaauaucccguccgccaaggugucgauccugcacgaggugcggcccgucacguccggcugcuuccccaucaugcacgaccgcaccaagauccggcagcugcccaaccuccugcgcggguacgagcacauccggcugucgacccacaacgugaucaacgccgagaaggcgccgggcgggcccuacaagaucggcaccuccgggucgugccccaacgugacgaacggcaacggcuucuuugccaccauggccugggccguccccaagaacgacaacaacaagaccgcgaccaacucccucacgaucgaggugccguacaucugcaccgagggggaggaccagaucaccguguggggcuuccacagcgacaacgagacccagauggccaagcuguacggggacuccaagccccagaaguucacgucguccgccaacggcgucaccacccacuacgugagucagaucggcggguuccccaaccagaccgaggacggcgggcugccccaguccggccgcaucguggucgacuacauggugcagaaguccgggaagacgggcaccaucaccuaccagcggggcauccuccugccgcagaagguguggugcgccuccgggcgcagcaaggucaucaagggcucgcugccccucaucggggaggccgacugccugcacgagaaguacggcgggcugaacaaguccaagcccuacuacaccggcgagcacgcgaaggccaucggcaacugccccaucugggugaagacgccgcucaagcuggccaaugggaccaaguaccggccgcccgccaagcugcucaaggagcgcggcuucuucggggccaucgcgggcuuccuggagggcgggugggagggcaugaucgccggguggcacggcuacaccucgcacggggcccacggcguggccgucgccgcggaccugaaguccacccaggaggccaucaacaagaucacgaagaaccucaacucgcuguccgagcuggaggugaagaaccuccagcggcugagcggcgccauggacgagcugcacaacgagauccucgagcuggacgagaaggucgaugaccugcgcgccgacaccaucuccucgcagaucgagcucgccgugcugcuguccaacgaggggaucaucaacucggaggacgagcaccuccuggcgcuggagcggaagcucaagaagaugcugggccccuccgccguggagaucgggaacggcugcuucgagaccaagcacaagugcaaccagaccugccuggaccgcaucgccgccgggaccuucgacgcgggcgaguucucgcuccccacguuugacucccugaacaucaccgccgccagccugaacgacgacggccucgacaaccacaccauccugcuguacuacuccaccgccgccucgucccuggcggucacgcucaugaucgccaucuucgugguguacauggucucgcgggacaacguguccugcagcaucugccuguga

SEQ ID NO: 14854 - RNA, 1758 nt, Artificial Sequence
  derived and/or modified CDS sequence (AUadapt) from InfluenzaB__AGX17171__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccgagucgcacuucgccaaccugaaggggacgaagacccggggcaagcucugccccaagugccugaacuguaccgaccuggacguggcccucgggcgccccaagugcaccggcaacaucccguccgccaaggugucgauccugcacgagguccggcccgugacguccggcugcuuccccaucaugcacaaccgcaccaagauccggcagcugcccaaccuccugcgcggguacgagcacauccggcugagcacccacaaugugaucaacgccgagaaggcgccgggcgggcccuacaagaucggcaccuccgggucgugccccaacgucacgaacggcaacggcuucuucgccaccauggccugggccgugcccaagaacgacaacaacaagaccgcgaccaacucccucacgaucgaggugccguacaucuguaccgagggggaggaccagaucaccgucuggggcuuccacucggacaacgaggcccagauggccaagcuguacggggacuccaagccccagaaguucaccagcuccgccaacggcgugacgacccacuacgugucgcagaucggcggguuccccaaucagaccgaggacggcgggcugccccaguccggccgcaucgucguggacuacauggugcagaaguccgggaacaccggcacgaucaccuaccagcggggcauccuccugccgcagaaggucuggugcgccuccgggcgcagcaaggugaucaagggcucgcugccccucaucggggaggcggacugccugcacgagaaguacggcgggcugaacaaguccaagcccuacuacaccggcgagcacgccaaggccaucggcaauugccccaucugggugaagaccccgcucaagcuggccaacgggacgaaguaccggccgcccgccaagcugcucaaggagcgcggcuucuucggggcgaucgccggcuuccuggagggcgggugggagggcaugaucgccggguggcacggcuacaccucgcacggggcccacggcgucgccguggcggccgaccugaaguccacccaggaggccaucaacaagaucaccaagaaccucaacagucuguccgagcuggaggucaagaaccuccagcggcugucgggcgccauggacgagcugcacaacgagauccucgagcuggacgagaagguggacgaccugcgcgccgacacgaucuccucgcagaucgagcucgcggugcugcuguccaacgaggggaucaucaacagcgaggacgagcaccuccuggcccuggagcggaagcucaagaagaugcugggccccuccgccgucgagaucgggaauggcugcuucgagaccaagcacaagugcaaccagaccugccuggaccgcaucgccgcggggaccuucgacgccggcgaguucucgcuccccaccuucgacucccugaacaucacggccgccucgcugaaugacgacggccucgacaaccacaccauccugcuguacuacuccaccgccgcgagcucccuggccgugacccucaugaucgccaucuucguggucuacauggugucgcgggacaacguguccugcagcaucugccuguga

SEQ ID NO: 14855 - RNA, 1758 nt, Artificial Sequence; identical to SEQ ID NO: 14719
  derived and/or modified CDS sequence (AUadapt) from InfluenzaB__AGX17182__HA

SEQ ID NO: 14856 - RNA, 1758 nt, Artificial Sequence; identical to SEQ ID NO: 14719
  derived and/or modified CDS sequence (AUadapt) from InfluenzaB__AGX17193__HA

SEQ ID NO: 14857 - RNA, 1758 nt, Artificial Sequence; identical to SEQ ID NO: 14719
  derived and/or modified CDS sequence (AUadapt) from InfluenzaB__AGX17204__HA

SEQ ID NO: 14858 - RNA, 1758 nt, Artificial Sequence
  derived and/or modified CDS sequence (AUadapt) from InfluenzaB__AGX17215__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggauguggcccucgggcgccccaagugcaccggcaacaucccguccgccaaggugucgauccugcacgagguccggcccgugacguccggcugcuuccccaucaugcacgaccgcaccaagauccggcagcugcccaaccuccugcgcggguacgagcacauccggcugucgacccacaacgugaucaacgccgagaaggcgccgggcgggcccuacaagaucggcaccuccgggagcugucccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacucggacaaugaggcccagauggccaagcuguacggggacuccaagccccagaaguucaccucguccgccaacggcgugacgacccacuacgugagccagaucggcggguuccccaaccagaccgaggacggcgggcugccccaguccggccgcaucgucguggacuacauggugcagaaguccgggaagaccggcacgaucaccuaccagcggggcauccuccugccgcagaaggucuggugcgccuccgggcgcucgaaggugaucaagggcucgcugccccucaucggggaggcggauugccugcacgagaaguacggcgggcugaacaaguccaagcccuacuacaccggcgagcacgccaaggccaucggcaacugccccaucugggugaagaccccgcucaagcuggccaacgggacgaaguaccggccgcccgccaagcugcucaaggagcgcggcuucuucggggcgaucgccggcuuccuggagggcgggugggagggcaugaucgccggguggcacggcuacaccagccauggggcccacggcgucgccguggcggccgaccugaaguccacccaggaggccaucaacaagaucaccaagaaccucaacucgcuguccgagcuggaggucaagaaccuccagcggcugucgggcgccauggacgagcugcacaacgagauccucgagcuggacgagaagguggacgaccugcgcgccgacacgaucuccagccagaucgagcucgcggugcugcuguccaacgaggggaucaucaauucggaggacgagcaccuccuggcccuggagcggaagcucaagaagaugcugggccccuccgccaucgagaucgggaacggcugcuucgagaccaagcacaagugcaaccagaccugccuggaccgcaucgccgcggggaccuucgacgccggcgaguucucgcuccccaccuucgacucccugaauaucacggccgccagccugaacgacgacggccucgacaaccacaccauccugcuguacuacuccaccgccgcgucgucccuggccgucacccucaugaucgccaucuucgugguguacauggucucgcgggacaacguguccugcagcaucugccuguga

SEQ ID NO: 14859 - RNA, 1758 nt, Artificial Sequence; identical to SEQ ID NO: 14719
  derived and/or modified CDS sequence (AUadapt) from InfluenzaB__AGX17226__HA

SEQ ID NO: 14860 - RNA, 1758 nt, Artificial Sequence
  derived and/or modified CDS sequence (AUadapt) from InfluenzaB__AGX17237__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaacaucccguccgccaaggugucgauccugcacgagguccggcccgugacguccggcugcuuucccaucaugcacgaccgcaccaagauccggcagcugcccaaccuccugcgcggguacgagcacauccggcugucgacccacaacgugaucaacgccgagaaggcgccgggcgggcccuacaagaucggcaccuccgggucgugccccaacaucacgaacggcaacggcuucuucgccaccauggccugggccguccccaagaacgacaacaacaagaccgcgaccaacucccucacgaucgaggugccguacaucuguaccgagggggaggaccagaucaccguguggggcuuccacagcgacaacgagauccagauggccaagcuguacggggacuccaagccccagaaguucaccucguccgccaacggcgucacgacccacuacgugucgcagaucggcggguuccccaaccagaccgaggacggcgggcugccccaguccggccgcaucguggucgacuacauggugcagaaguccgggaagaccggcacgaucaccuaccagcggggcauccuccugccgcagaagguguggugcgccuccgggcgcagcaaggucaucaagggcucgcugccccucaucggggaggccgauugccugcacgagaaguacggcgggcugaacaaguccaagcccuacuacaccggcgagcacgcgaaggccaucggcaacugccccaucugggugaagaccccgcucaagcuggccaacgggacgaaguaccggccgcccgccaagcugcucaaggagcgcggcuucuucggggccaucgcgggcuuccuggagggcgggugggagggcaugaucgccggguggcacggcuacaccucgcacggggcccacggcguggccgucgccgcggaccugaaguccacccaggaggccaucaacaagaucaccaagaaccucaacagucuguccgagcuggaggugaagaaccuccagcggcugagcggcgccauggacgagcugcacaacgagauccucgagcuggacgagaaggucgacgaccugcgcgccgacacgaucuccucgcagaucgagcucgccgugcugcuguccaacgaggggaucaucaacucggaggacgagcaccuccuggcgcuggagcggaagcucaagaagaugcugggccccuccgccguggagaucgggaacggcugcuucgagaccaagcacaagugcaaccagaccugccuggaccgcaucgccgccgggaccuuugacgcgggcgaguucucgcuccccaccuucgacucccugaacaucacggccgccagccugaacgacgacggccucgacaaccacaccauccugcuguacuacuccaccgccgccucgucccuggcggucacccucaugaucgccaucuucgugguguacauggucucgcgggacaacguguccugcagcaucugccuguga

SEQ ID NO: 14861 - RNA, 1758 nt, Artificial Sequence
  derived and/or modified CDS sequence (AUadapt) from InfluenzaB__AGX17248__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaauaucccguccgccaaggugucgauccugcacgagguccggcccgugacguccggcugcuuccccaucaugcacgaccgcaccaagauccggcagcugcccaaccuccugcgcggguacgagcacauccggcugucgacccacaacgugaucaacgccgagaaggcgccgggcgggcccuacaagaucggcaccuccgggucgugccccaacgucacgaacggcaacggcuucuuugccaccauggccugggccgugcccaagaacgacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgucguccgccaacggcgugaccacccacuacgugagucagaucggcggguuccccaaccagaccgaggacggcgggcugccccaguccggccgcaucgucguggacuacauggugcagaaguccgggaagacgggcaccaucaccuaccagcggggcauccuccugccgcagaaggucuggugcaccuccgggcgcagcaaggugaucaagggcucgcugccccucaucggggaggccgacugccugcacgagaaguacggcgggcugaacaaguccaagcccuacuacacgggcgagcacgccaaggcgaucggcaacugccccaucugggugaagaccccgcucaagcuggccaaugggaccaaguaccggccgcccgccaagcugcucaaggagcgcggcuucuucggggccaucgccggcuuccuggagggcgggugggagggcaugaucgcgggguggcacggcuacaccucgcacggggcccacggcgucgccguggccgccgaccugaaguccacgcaggaggcgaucaacaagaucaccaagaaccucaacucgcuguccgagcuggaggucaagaaccuccagcggcugagcggcgccauggacgagcugcacaacgagauccucgagcuggacgagaagguggaugaccugcgcgccgacaccaucuccucgcagaucgagcucgccgugcugcuguccaacgaggggaucaucaacucggaggacgagcaccuccuggcccuggagcggaagcucaagaagaugcugggccccuccgcggucgagaucgggaacggcugcuucgagaccaagcacaagugcaaccagaccugccuggaccgcaucgccgccgggacguucgacgccggcgaguucucgcuccccaccuuugacucccugaacaucaccgcggccagccugaacgacgacggccucgacaaccacaccauccugcuguacuacuccacggccgccucgucccuggccgugacccucaugaucgcgaucuucguggucuacauggugucgcgggacaacguguccugcagcaucugccuguga

SEQ ID NO: 14862 - RNA, 1758 nt, Artificial Sequence; identical to SEQ ID NO: 14803
  derived and/or modified CDS sequence (AUadapt) from InfluenzaB__AGX17270__HA

SEQ ID NO: 14863 - RNA, 1758 nt, Artificial Sequence; identical to SEQ ID NO: 14719
  derived and/or modified CDS sequence (AUadapt) from InfluenzaB__AGX17281__HA

SEQ ID NO: 14864 - RNA, 1758 nt, Artificial Sequence; identical to SEQ ID NO: 14719
  derived and/or modified CDS sequence (AUadapt) from InfluenzaB__AGX17292__HA

SEQ ID NO: 14865 - RNA, 1758 nt, Artificial Sequence; identical to SEQ ID NO: 14719
  derived and/or modified CDS sequence (AUadapt) from InfluenzaB__AGX17303__HA

SEQ ID NO: 14866 - RNA, 1758 nt, Artificial Sequence; identical to SEQ ID NO: 14845
  derived and/or modified CDS sequence (AUadapt) from InfluenzaB__AGX17314__HA

SEQ ID NO: 14867 - RNA, 1758 nt, Artificial Sequence; identical to SEQ ID NO: 14719
  derived and/or modified CDS sequence (AUadapt) from InfluenzaB__AGX17325__HA

SEQ ID NO: 14868 - RNA, 1758 nt, Artificial Sequence; identical to SEQ ID NO: 14830
  derived and/or modified CDS sequence (AUadapt) from InfluenzaB__AGX17336__HA

SEQ ID NO: 14869 - RNA, 1758 nt, Artificial Sequence; identical to SEQ ID NO: 14719
  derived and/or modified CDS sequence (AUadapt) from InfluenzaB__AGX17347__HA

SEQ ID NO: 14870 - RNA, 1758 nt, Artificial Sequence; identical to SEQ ID NO: 14719
  derived and/or modified CDS sequence (AUadapt) from InfluenzaB__AGX17358__HA

SEQ ID NO: 14871 - RNA, 1758 nt, Artificial Sequence
  derived and/or modified CDS sequence (AUadapt) from InfluenzaB__AGX17369__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagagccacuucgccaaccugaaggggacgaagacccggggcaagcucugccccaagugccugaacuguaccgaccuggacguggcccucgggcgccccaagugcaccggcaacaucccguccgccaaggugucgauccugcacgagguccggcccgugacguccggcugcuuccccaucaugcacgaccgcaccaagauccggcagcugcccaaccuccugcgcggguacgagcacauccggcugucgacccacaaugugaucaacgccgagaaggcgccgggcgggcccuacaagaucggcaccuccgggagcugccccaacgucacgaacggcaacggcuucuucgccaccauggccugggccgugcccaagaacgacaacaacaagaccgcgaccaacucccucacgaucgaggugccguacaucuguaccgagggggaggaccagaucaccgucuggggcuuccacucggacaacgagacccagauggccaagcuguacggggacuccaagccccagaaguucacgucguccgccaacggcgugaccacccacuacgugagccagaucggcggguuccccaaucagaccgaggacggcgggcugccccaguccggccgcaucgucgccgacuacauggugcagaaguccgggaagacgggcaccaucaccuaccagcggggcauccuccugccgcagaagguguggugcgccuccgggcgcucgaaggucaucaagggcucgcugccccucaucggggaggcggacugccugcacgagaaguacggcgggcugaacaaguccaagcccuacuacaccggcgagcacgccaaggccaucggcaauugccccaucugggugaagacgccgcucaagcuggccaacgggaccaaguaccggccgcccgccaagcugcucaaggagcgcggcuucuucggggcgaucgccggcuuccuggagggcgggugggagggcaugaucgccggguggcacggcuacaccagccacggggcccacggcguggccgucgcggccgaccugaaguccacccaggaggccaucaacaagaucacgaagaaccucaacagucuguccgagcuggaggugaagaaccuccagcggcugucgggcgccauggacgagcugcacaacgagauccucgagcuggacgagaaggucgacgaccugcgcgccgacaccaucuccagccagaucgagcucgcggugcugcuguccaacgaggggaucaucaacucggaggacgagcaccuccuggcccuggagcggaagcucaagaagaugcugggccccuccgccguggagaucgggaauggcugcuucgagaccaagcacaagugcaaccagaccugccuggaccgcaucgccgcggggaccuucgacgccggcgaguucucgcuccccacguucgacucccugaacaucaccgccgccagccugaaugacgacggccucgacaaccacaccauccugcuguacuacuccaccgccgcgucgucccuggccgucacgcucaugaucgccaucuucgugguguacauggucucgcgggacaacguguccugcagcaucugccuguga

SEQ ID NO: 14872 - RNA, 1758 nt, Artificial Sequence; identical to SEQ ID NO: 14845
  derived and/or modified CDS sequence (AUadapt) from InfluenzaB__AGX17380__HA

SEQ ID NO: 14873 - RNA, 1758 nt, Artificial Sequence; identical to SEQ ID NO: 14719
  derived and/or modified CDS sequence (AUadapt) from InfluenzaB__AGX17391__HA

SEQ ID NO: 14874 - RNA, 1758 nt, Artificial Sequence
  derived and/or modified CDS sequence (AUadapt) from InfluenzaB__AGX17400__HA
augaaggccaucaucgugcugcucauggucgugaccaguaacgccgaccgcaucugcaccggcaucacguccucgaacucgccccacauggugaagaccgcgacccagggggaggucaacgugaccggcgugaucccgcugacgaccacccccaccaagagccacuucgccaaccugaaggggacgaagacccggggcaagcucugccccaagugccugaacugcaccgaccuggacgucgcccucgggcgccccaagugcaccggcaauaucccguccgccaaggugucgauccugcacgaggugcggcccgucacguccggcugcuuccccaucaugcacgaccgcaccaagauccggcagcugcccaaccuccugcgcggguacgagcacauccggcugucgacccacaacgugaucaacgccgagaaggcgccgggcgggcccuacaagaucggcaccuccgggucgugccccaacgugacgaacggcaacggcuucuuugccaccauggccugggccguccccaagaacgacaacaacaagaccgcgaccaacucccucacgaucgaggugccguacaucugcaccgagggggaggaccagaucaccguguggggcuuccacagcgacaacgagacccagauggccaagcuguacggggacuccaagccccagaaguucacgucguccgccaacggcgucaccacccacuacgugagucagaucggcggguuccccaaccagaccgaggacggcgggcugccccaguccggccgcaucguggucgacuacauggugcagaaguccgggaagacgggcaccaucaccuaccagcggggcauccuccugccgcagaagguguggugcgccuccgggcgcagcaaggucaucaagggcucgcugccccucaucggggaggccgacugccugcacgagaaguacggcgggcugaacaaguccaagcccuacuacaccggcgagcacgcgaaggccaucggcaacugccccaucugggugaagacgccgcucaagcuggccaaugggaccaaguaccggccgcccgccaagcugcucaaggagcgcggcuucuucggggccaucgcgggcuuccuggagggcgggugggagggcaugaucgccggguggcacggcuacaccucgcacggggcccacggcguggccgucgccgcggaccugaaguccacccaggaggccaucaacaagaucacgaagaaccucaacucgcuguccgagcuggaggugaagaaccuccagcggcugagcggcgccauggacgagcugcacaacgagauccucgagcuggacgagaaggucgaugaccugcgcgccgacaccaucuccucgcagaucgagcucgccgugcugcuguccaacgaggggaucaucaacucggaggacgagcaccuccuggcgcuggagcggaagcucaagaagaugcugggccccuccgccguggagaucgggaacggcugcuucgagaccaagcacaagugcaaccagaccugccuggaccgcaucgccgccgggaccuucgacgcgggcgaguucucgcuccccacguuugacucccugaacaucaccgccgccagccugaacgacgacggccucgacaaccacaccauccugcuguacuacuccaccgccgccucgucccuggcggucacgcucaugaucgccaucuucgugguguacauggucucgcgggacaacguguccugcagcaucugccuguga

SEQ ID NO: 14875 - RNA, 1758 nt, Artificial Sequence; identical to SEQ ID NO: 14719
  derived and/or modified CDS sequence (AUadapt) from InfluenzaB__AGX17411__HA

SEQ ID NO: 14876 - RNA, 1758 nt, Artificial Sequence; identical to SEQ ID NO: 14719
  derived and/or modified CDS sequence (AUadapt) from InfluenzaB__AGX17422__HA

SEQ ID NO: 14877 - RNA, 1758 nt, Artificial Sequence; identical to SEQ ID NO: 14802
  derived and/or modified CDS sequence (AUadapt) from InfluenzaB__AGX17433__HA

SEQ ID NO: 14878 - RNA, 1758 nt, Artificial Sequence; identical to SEQ ID NO: 14719
  derived and/or modified CDS sequence (AUadapt) from InfluenzaB__AGX17444__HA

SEQ ID NO: 14879 - RNA, 1758 nt, Artificial Sequence; identical to SEQ ID NO: 14802
  derived and/or modified CDS sequence (AUadapt) from InfluenzaB__AGX17455__HA

SEQ ID NO: 14880 - RNA, 1758 nt, Artificial Sequence; identical to SEQ ID NO: 14845
  derived and/or modified CDS sequence (AUadapt) from InfluenzaB__AGX17466__HA

SEQ ID NO: 14881 - RNA, 1758 nt, Artificial Sequence; identical to SEQ ID NO: 14719
  derived and/or modified CDS sequence (AUadapt) from InfluenzaB__AGX17477__HA

SEQ ID NO: 14882 - RNA, 1758 nt, Artificial Sequence; identical to SEQ ID NO: 14804
  derived and/or modified CDS sequence (AUadapt) from InfluenzaB__AGX17488__HA

SEQ ID NO: 14883 - RNA, 1758 nt, Artificial Sequence; identical to SEQ ID NO: 14719
  derived and/or modified CDS sequence (AUadapt) from InfluenzaB__AGX17499__HA

SEQ ID NO: 14884 - RNA, 1758 nt, Artificial Sequence; identical to SEQ ID NO: 14845
  derived and/or modified CDS sequence (AUadapt) from InfluenzaB__AGX17510__HA

SEQ ID NO: 14885 - RNA, 1758 nt, Artificial Sequence; identical to SEQ ID NO: 14845
  derived and/or modified CDS sequence (AUadapt) from InfluenzaB__AGX17521__HA

SEQ ID NO: 14886 - RNA, 1758 nt, Artificial Sequence; identical to SEQ ID NO: 14847
  derived and/or modified CDS sequence (AUadapt) from InfluenzaB__AGX17532__HA

SEQ ID NO: 14887 - RNA, 1758 nt, Artificial Sequence
  derived and/or modified CDS sequence (AUadapt) from InfluenzaB__AGX17543__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccucccugaaggggacgaagacccggggcaagcucugccccaagugccugaacugcaccgaccuggacguggcccucgggcgccccaaguguaccggcaacaucccgucggccaagguguccauccugcacgagguccggcccgugacgagcggcugcuuccccaucaugcacgaccgcaccaagauccggcagcugcccaaccuccugcgcggguacgagcacauccggcuguccacccacaacgugaucaacgccgagaaggcgccgggcgggcccuacaagaucggcaccucgggguccugccccaaugucacgaacggcaacggcuucuucgccaccauggccugggccgugcccaagaacgacaacaacaagaccgcgaccaacucgcucacgaucgaggugccguacaucugcaccgagggggaggaccagaucaccgucuggggcuuccacuccgacaacgagacccagauggccaagcuguauggggacagcaagccccagaaguucacguccucggccaacggcgugaccacccacuacgugucccagaucggcggguuccccaaccagaccgaggacggcgggcugccccagucgggccgcaucgucguggacuacauggugcagaaguccgggaagacgggcaccaucaccuaccagcggggcauccuccugccgcagaaggucuggugcgccagcgggcgcucgaaggugaucaagggcucccugccccucaucggggaggccgauugccugcacgagaaguacggcgggcugaacaagucgaagcccuacuacaccggcgagcacgcgaaggccaucggcaacugccccaucugggugaagacgccgcucaagcuggccaacgggaccaaguaccggccgcccgccaagcugcucaaggagcgcggcuucuucggggccaucgcgggcuuccuggagggcgggugggagggcaugaucgccggguggcacggcuacaccucccauggggcccacggcgucgccguggccgcggaccugaaguccacccaggaggccaucaacaagaucacgaagaaccucaacucccugagcgagcuggaggucaagaaccuccagcggcuguccggcgccaugaacgagcugcacaacgagauccucgagcuggacgagaagguggacgaccugcgcgccgacaccaucucgucccagaucgagcucgccgugcugcugucgaacgaggggaucaucaauuccgaggacgagcaccuccuggcgcuggagcggaagcucaagaagaugcugggccccagcgccgucgagaucgggaacggcugcuucgagaccaagcacaagugcaaccagaccugccuggaccgcaucgccgccgggaccuucgacgcgggcgaguucucccuccccacguucgacucgcugaauaucaccgccgccucccugaacgacgacggccucgacaaccacaccauccugcuguacuacucgaccgccgccuccagccuggcggugacgcucaugaucgccaucuucguggucuacauggugucccgggacaacgugucgugcagcaucugccuguga

SEQ ID NO: 14888 - RNA, 1758 nt, Artificial Sequence
  derived and/or modified CDS sequence (AUadapt) from InfluenzaB__AGX17554__HA
augaaggccaucaucgugcugcuccuggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccucaaggggacgaagacccggggcaagcugugccccaagugccugaacuguaccgaccucgacguggcccuggggcgccccaagugcaccggcaacaucccguccgccaaggugucgauccugcacgagguccggcccgugacguccggcugcuuccccaucaugcacgaccgcaccaagauccggcagcuccccaaccugcugcgcggguacgagcacauccggcucagcacccacaaugugaucaacgccgagaaggcgccgggcgggcccuacaagaucggcaccuccgggucgugccccaacgucacgaacggcaacggcuucuucgccaccauggccugggccgugcccaagaacgacaacaacaagaccgcgaccaacucccugacgaucgaggugccguacaucuguaccgagggggaggaccagaucaccgucuggggcuuccacucggacaacgagacccagauggccaagcuguacggggacuccaagccccagaaguucacgagcuccgccaacggcgugaccacccacuacgugucgcagaucggcggguuccccaaucagaccgaggacggcgggcucccccaguccggccgcaucgucguggacuacauggugcagaaguccgggaagacgggcaccaucaccuaccagcggggcauccugcugccgcagaaggucuggugcgccuccgggcgcagcaaggugaucaagggcucgcucccccugaucggggaggccgacugccugcacgagaaguacggcgggcucaacaaguccaagcccuacuacaccggcgagcacgcgaaggccaucggcaauugccccaucugggugaagacgccgcugaagcuggccaacgggaccaaguaccggccgcccgccaagcuccugaaggagcgcggcuucuucggggccaucgcgggcuuccuggagggcgggugggagggcaugaucgccggguggcacggcuacaccucgcacggggcccacggcgucgccguggccgcggaccucaaguccacccaggaggccaucaacaagaucacgaagaaccugaacagucuguccgagcucgaggucaagaaccugcagcggcugucgggcgccauggacgagcuccacaacgagauccuggagcuggacgagaagguggacgaccuccgcgccgacaccaucuccucgcagaucgagcuggccgugcugcucuccaacgaggggaucaucaacagcgaggacgagcaccuccuggcgcuggagcggaagcugaagaagaugcugggccccuccgccgucgagaucgggaauggcugcuucgagaccaagcacaagugcaaccagaccugccucgaccgcaucgccgccgggaccuucgacgcgggcgaguucucgcugcccacguucgacucccugaacaucaccgccgccucgcucaaugacgacggccuggacaaccacaccauccugcuguacuacuccaccgccgccagcucccucgcggugacgcugaugaucgccaucuucguggucuacauggugucgcgggacaacguguccugcagcaucugccuguga

SEQ ID NO: 14889 - RNA, 1755 nt, Artificial Sequence; identical to SEQ ID NO: 14763
  derived and/or modified CDS sequence (AUadapt) from InfluenzaB__AGX17565__HA

SEQ ID NO: 14890 - RNA, 1758 nt, Artificial Sequence
  derived and/or modified CDS sequence (AUadapt) from InfluenzaB__AGX17576__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggauguggcccucgggcgccccaagugcaccggcaacaucccguccgccgaggugucgauccugcacgagguccggcccgugacguccggcugcuuccccaucaugcacgaccgcaccaagauccggcagcugcccaaccuccugcgcggguacgagcacauccggcugucgacccacaacgugaucaacgccgagaaggcgccgggcgggcccuacaagaucggcaccuccgggagcugucccaacgucacgaacggcaacggcuucuucgccaccauggccugggccgugcccaagaacgacaacaacaagaccgcgaccaacucccucacgaucgaggugccguacaucugcaccgagggggaggaccagaucaccaucuggggcuuccacucggacaaugagacccagauggccaagcuguacggggacuccaagccccagaaguucacgucguccgccaacggcgucaccacccacuacgugagccagaucggcggguuccccaaccagaccgaggacggcgggcugccccaguccggccgcaucguggucgacuacauggugcagaaguccgggaagacgggcaccaucaccuaccagcggggcauccuccugccgcagaagguguggugcgccuccgggcgcucgaaggucaucaagggcucgcugccccucaucggggaggccgauugccugcacgagaaguacggcgggcugaacaaguccaagcccuacuacaccggcgagcacgcgaaggccaucggcaacugccccaucugggugaagacgccgcucaagcuggccaacgggaccaaguaccggccgcccgccaagcugcucaaggagcgcggcuucuucggggccaucgcgggcuuccuggagggcgggugggagggcaugaucgccggguggcacggcuacaccagccauggggcccacggcguggccgucgccgcggaccugaaguccacccaggaggccaucaacaagaucacgaagaaccucaacucgcuguccgagcuggaggugaagaaccuccagcggcugucgggcgccauggacgagcugcacaacgagauccucgagcuggacgagaaggucgacgaccugcgcgccgacaccaucuccagccagaucgagcucgccgugcugcuguccaacgaggggaucaucaauucggaggacgagcaccuccuggcgcuggagcggaagcucaagaagaugcugggccccuccgccguggagaucgggaacggcugcuucgagaccaagcacaagugcaaccagaccugccuggaccgcaucgccgccgggaccuucgacgcgggcgaguucucgcuccccacguucgacucccugaauaucaccgccgccagccugaacgacgacggccucgacaaccacaccauccugcuguacuacuccaccgccgccucgucccuggcggucacgcucaugauggccaucuucgugguguacauggucucgcgggacaacguguccugcagcaucugccuguga

SEQ ID NO: 14891 - RNA, 1758 nt, Artificial Sequence; identical to SEQ ID NO: 14254
  derived and/or modified CDS sequence (AUadapt) from InfluenzaB__AGX17598__HA

SEQ ID NO: 14892 - RNA, 1758 nt, Artificial Sequence
  derived and/or modified CDS sequence (AUadapt) from InfluenzaB__AGX17609__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugucccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaucuccugcggggguacgagcacauccgccugucgacccacaacgugaucaacgccgagaacgcgccgggcgggcccuacaagaucggcaccuccgggagcugccccaacgucacgaacggcaauggcuucuucgccaccauggccugggccgugcccaagaacgacaacaacaagaccgcgaccaacucccucacgaucgaggugccguacaucugcaccgagggggaggaccagaucaccgucuggggcuuccacagugacaacgagacccagauggccaagcuguacggggacuccaagccccagaaguucacgagcuccgccaacggcgugaccacccacuacgugucgcagaucggcggguuccccaaccagaccgaggauggcgggcugccccaguccggccggaucgucguggacuacauggugcagaaguccgggaagacgggcaccaucaccuaccagcgcggcauccuccugccgcagaaggucuggugcgccuccgggcggagcaaggugaucaagggcucgcugccccucaucggggaggccgacugccugcacgagaaguacggcgggcugaacaaguccaagcccuacuacaccggcgagcaugcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccucgcacggggcccacggcgucgccguggccgcggaucugaaguccacccaggaggccaucaacaagaucacgaagaaccucaacagccuguccgagcuggaggucaagaaccuccagcgccugucgggcgccauggacgagcugcacaacgagauccucgagcuggacgagaagguggacgaccugcgggccgauaccaucuccagccagaucgagcucgccgugcugcuguccaacgaggggaucaucaacucggaggacgagcaccuccuggcgcuggagcgcaagcucaagaagaugcugggccccuccgccgucgagaucgggaacggcugcuucgagaccaagcacaagugcaaccagaccugucuggaccggaucgccgccgggaccuucgacgcgggcgaguucagccuccccacguucgacucccugaacaucaccgccgccucgcugaacgacgacggccucgauaaccacaccauccugcuguacuacuccaccgccgccagcucccuggcggugacgcucaugaucgccaucuucguggucuacauggugucgcgcgacaacguguccugcagcaucugccuguga

SEQ ID NO: 14893 - RNA, 1758 nt, Artificial Sequence; identical to SEQ ID NO: 14721
  derived and/or modified CDS sequence (AUadapt) from InfluenzaB__AGX17620__HA

SEQ ID NO: 14894 - RNA, 1758 nt, Artificial Sequence; identical to SEQ ID NO: 14254
  derived and/or modified CDS sequence (AUadapt) from InfluenzaB__AGX17631__HA

SEQ ID NO: 14895 - RNA, 1758 nt, Artificial Sequence; identical to SEQ ID NO: 14378
  derived and/or modified CDS sequence (AUadapt) from InfluenzaB__AGX17642__HA

SEQ ID NO: 14896 - RNA, 1758 nt, Artificial Sequence; identical to SEQ ID NO: 14721
  derived and/or modified CDS sequence (AUadapt) from InfluenzaB__AGX17653__HA

SEQ ID NO: 14897 - RNA, 1758 nt, Artificial Sequence; identical to SEQ ID NO: 14254
  derived and/or modified CDS sequence (AUadapt) from InfluenzaB__AGX17664__HA

SEQ ID NO: 14898 - RNA, 1758 nt, Artificial Sequence; identical to SEQ ID NO: 14378
  derived and/or modified CDS sequence (AUadapt) from InfluenzaB__AGX17675__HA

SEQ ID NO: 14899 - RNA, 1758 nt, Artificial Sequence; identical to SEQ ID NO: 14721
  derived and/or modified CDS sequence (AUadapt) from InfluenzaB__AGX17686__HA

SEQ ID NO: 14900 - RNA, 1758 nt, Artificial Sequence
  derived and/or modified CDS sequence (AUadapt) from InfluenzaB__AGX17697__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccacuuugccaaccugaaggggacggagacccggggcaagcucugccccaagugccugaacugcaccgaccuggacguggcccucgggcgccccaagugcaccggcgagaucccguccgcccgggugucgauccugcacgagguccgccccgugacguccggcuguuuccccaucaugcacgaccggaccaagauccgccagcugcccaaccuccugcggggguacgagcacauccgccugagcacccacaacgccaucaacgcggagaaugccccgggcgggcccuacaagaucggcaccuccgggucgugccccaacgugacgaacggcaacggcuucuucgccaccauggccugggcgguccccaagaacgacaauaacaagaccgccaccaacucccucacgaucgaggugccguacaucugcaccgagggggaggaccagaucaccguguggggcuuccacagcgacaacgagacccagauggccaagcuguauggggacuccaagccccagaaguucacgucguccgccaacggcgucaccacccacuacgugagccagaucggcggguuccccaaccagaccgaggacggcgggcugccccaguccggccggaucguggucgauuacauggugcagaaguccgggaagacgggcaccaucaccuaccagcgcggcauccuccugccgcagaagguguggugcgccuccgggcggucgaaggucaucaagggcagccugccccucaucggggaggcggacugccugcacgagaaguacggcgggcugaacaaguccaagcccuacuauaccggcgagcacgccaaggccaucggcaacugccccaucugggugaagacgccgcucaagcuggccaacgggaccaaguaccgcccgcccgccaagcugcucaaggagcggggcuucuucggggcgaucgccggcuuccuggagggcgggugggagggcaugaucgccggguggcacggcuacaccagucacggggcccacggcguggccgucgcggccgaccugaaguccacccaggaggccaucaacaagaucacgaagaaccucaacagccuguccgagcuggaggugaagaaccuccagcgccugucgggcgccauggacgagcugcauaacgagauccucgagcuggacgagaaggucgacgaccugcgggccgacaccaucuccagccagaucgagcucgcggugcugcuguccaacgaggggaucaucaacucggaggacgagcaucuccuggcccuggagcgcaagcucaagaagaugcugggccccuccgccguggagaucgggaacggcugcuucgagaccaagcacaagugcaaccagaccugccuggaccggaucgccgcggggaccuucgacgccggcgaguuuagccuccccacguucgacucccugaacaucaccgccgccucgcugaacgacgacggccucgacaaccauaccauccugcuguacuacuccaccgccgcgagcucccuggccgucacgcucaugaucgccaucuucgugguguacauggucucgcgcgacaacguguccugcagcaucugccuguga

SEQ ID NO: 14901 - RNA, 1758 nt, Artificial Sequence; identical to SEQ ID NO: 14378
  derived and/or modified CDS sequence (AUadapt) from InfluenzaB__AGX17708__HA

SEQ ID NO: 14902 - RNA, 1758 nt, Artificial Sequence; identical to SEQ ID NO: 14721
  derived and/or modified CDS sequence (AUadapt) from InfluenzaB__AGX17719__HA

SEQ ID NO: 14903 - RNA, 1758 nt, Artificial Sequence; identical to SEQ ID NO: 14378
  derived and/or modified CDS sequence (AUadapt) from InfluenzaB__AGX17730__HA

SEQ ID NO: 14904 - RNA, 1758 nt, Artificial Sequence; identical to SEQ ID NO: 14254
  derived and/or modified CDS sequence (AUadapt) from InfluenzaB__AGX17741__HA

SEQ ID NO: 14905 - RNA, 1758 nt, Artificial Sequence; identical to SEQ ID NO: 14721
  derived and/or modified CDS sequence (AUadapt) from InfluenzaB__AGX17752__HA

SEQ ID NO: 14906 - RNA, 1758 nt, Artificial Sequence; identical to SEQ ID NO: 14721
  derived and/or modified CDS sequence (AUadapt) from InfluenzaB__AGX17774__HA

SEQ ID NO: 14907 - RNA, 1758 nt, Artificial Sequence
  derived and/or modified CDS sequence (AUadapt) from InfluenzaB__AGX17785__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacgaagacccggggcaagcucugccccaagugccugaacuguaccgaccuggacguggcccucgggcgccccaagugcaccggcaacaucccguccgccgaggugucgauccugcacgagguccggcccgugacguccggcugcuuccccaucaugcacgaccgcaccaagauccggcagcugcccaaccuccugcgcggguacgagcacgugcggcugagcacccacaaugucaucaacgccgagaaggcgccgggcgggcccuacaagaucggcaccuccgggucgugccccaacgugacgaacggcaacggcuucuucgccaccauggccugggccgugcccaagaacgacaacaacaagaccgcgaccaacucccucacgaucgaggucccguacaucuguaccgagggggaggaccagaucaccaucuggggcuuccacucggacaacgagacccagauggccaagcuguacggggacuccaagccccagaaguucacgagcuccgccaacggcgugaccacccacuacgugucgcagaucggcggguuccccaaucagaccgaggacggcgggcugccccaguccggccgcaucgucguggacuacauggugcagaaguccgggaagacgggcaccaucaccuaccagcggggcauccuccugccgcagaaggucuggugcgccuccgggcgcagcaaggugaucaagggcucgcugccccucaucggggaggccgacugccugcacgagaaguacggcgggcugaacaaguccaagcccuacuacaccggcgagcacgcgaaggccaucggcaauugccccaucugggugaagacgccgcucaagcuggccaacgggaccaaguaccggccgcccgccaagcugcucaaggagcgcggcuucuucggggccaucgcgggcuuccuggagggcgggugggagggcaugaucgccggguggcacggcuacaccucgcacggggcccacggcgucgccguggccgcggaccugaaguccacccaggaggccaucaacaagaucacgaagaaccucaacagucuguccgagcuggaggucaagaaccuccagcggcugucgggcgccauggacgagcugcacaacgagauccucgagcuggacgagaagguggacgaccugcgcgccgacaccaucuccucgcagaucgagcucgccgugcugcuguccaacgaggggaucaucaacagcgaggacgagcaccuccuggcgcuggagcggaagcucaagaagaugcugggccccuccgccgucgagaucgggaauggcugcuucgagaccaagcacaagugcaaccagaccugccuggaccgcaucgccgccgggaccuucgacgcgggcgaguucucgcuccccacguucgacucccugaacaucaccgccgccucgcugaaugacgacggccucgacaaccacaccauccugcuguacuacuccaccgccgccagcucccuggcggugacgcucaugaucgccaucuucguggucuacauggugucgcgggacaacguguccugcagcaucugccuguga

SEQ ID NO: 14908 - RNA, 1758 nt, Artificial Sequence; identical to SEQ ID NO: 14721
  derived and/or modified CDS sequence (AUadapt) from InfluenzaB__AGX17796__HA

SEQ ID NO: 14909 - RNA, 1758 nt, Artificial Sequence; identical to SEQ ID NO: 14305
  derived and/or modified CDS sequence (AUadapt) from InfluenzaB__AGX17807__HA

SEQ ID NO: 14910 - RNA, 1758 nt, Artificial Sequence; identical to SEQ ID NO: 14892
  derived and/or modified CDS sequence (AUadapt) from InfluenzaB__AGX17818__HA

SEQ ID NO: 14911 - RNA, 1758 nt, Artificial Sequence
  derived and/or modified CDS sequence (AUadapt) from InfluenzaB__AGX17829__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccacuucgccaaucugaaggggacggagacccggggcaagcucugccccaagugccugaacugcaccgaccuggacguggcccucgggcgccccaagugcaccggcaagaucccguccgcccgggugucgauccugcacgagguccgccccgugacguccggcugcuuccccaucaugcaugaccggaccaagauccgccagcugcccaaccuccugcggggguacgagcacauccgccugagcacccacaacgugaucaacgccgagaacgcgccgggcgggcccuacaagaucggcaccuccgggucgugucccaacgucacgaacggcaacggcuucuucgccaccauggccugggccgugcccaagaacgacaacaacaagaccgcgaccaacucccucacgaucgaggugccguacaucuguaccgagggggaggaccagaucaccgucuggggcuuccacagcgacaacgagacccagauggccaagcuguacggggacuccaagccccagaaguucacgucguccgccaacggcgugaccacccauuacgugagccagaucggcggguuccccaaccagaccgaggacggcgggcugccccaguccggccggaucgucguggacuacauggugcagaaguccgggaagacgggcaccaucaccuaccagcgcggcauccuccugccgcagaaggucuggugcgccuccgggcggucgaaggugaucaagggcagccugccccucaucggggaggccgauugccugcacgagaaguacggcgggcugaacaaguccaagcccuacuacaccggcgagcacgcgaaggccaucggcaacugccccaucugggugaagacgccgcucaagcuggccaacgggaccaaguaccgcccgcccgccaagcugcucaaggagcggggcuuuuucggggccaucgcgggcuuccuggagggcgggugggagggcaugaucgccggguggcacggcuacaccucgcacggggcccacggcgucgccguggccgcggaccugaaguccacccaggaggccgucaacaagaucacgaagaaccucaacagucuguccgagcuggaggugaagaaccuccagcgccugucgggcgccauggacgagcugcacaacgagauccucgagcuggacgagaagguggacgaccugcgggccgacaccaucuccagccagaucgagcucgccguccugcuguccaacgaggggaucaucaauucggaggacgagcaccuccuggcgcuggagcgcaagcucaagaagaugcugggccccuccgccguggagaucgggaacggcugcuucgagaccaagcacaagugcaaccagaccugccuggaccggaucgccgccgggaccuuugacgcgggcgaguucagccuccccacguucgacucccugaacaucaccgccgccucgcugaacgacgacggccucgacaaucacaccauccugcuguacuacuccaccgccgccagcucccuggcggugacgcucaugaucgccaucuucgucguguacauggugucgcgcgacaacgucuccugcagcaucugccuguga

SEQ ID NO: 14912 - RNA, 1758 nt, Artificial Sequence; identical to SEQ ID NO: 14378
  derived and/or modified CDS sequence (AUadapt) from InfluenzaB__AGX17840__HA

SEQ ID NO: 14913 - RNA, 1758 nt, Artificial Sequence; identical to SEQ ID NO: 14721
  derived and/or modified CDS sequence (AUadapt) from InfluenzaB__AGX17851__HA

SEQ ID NO: 14914 - RNA, 1758 nt, Artificial Sequence
  derived and/or modified CDS sequence (AUadapt) from InfluenzaB__AGX17862__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggauguggcccucgggcgccccaagugcaccggcaacaucccguccgccgaggugucgauccugcacgagguccggcccgugacguccggcugcuuccccaucaugcacgaccgcaccaagauccggcagcugcccaaccuccugcgcggguacgagcacauccggcugucgacccacaacgugaucaacgccgagaaggcgccgggcgggcccuacaagaucggcaccuccgggagcugucccaacgucacgaacggcaacggcuucuucgccaccauggccugggccgugcccaagaacgacaacaacaagaccgcgaccaacucccucacgaucgaggugccguacaucugcaccgagggggaggaccagaucaccaucuggggcuuccacucggacaaugagacccagauggccaagcuguacggggacuccaagccccagaaguucacgucguccgccaacggcgucaccacccacuacgugucgcagaucggcggguuccccaaccagaccgaggacggcgggcugccccaguccggccgcaucguggucgacuacauggugcagaaguccgggaagacgggcaccaucaccuaccagcggggcauccuccugccgcagaagguguggugcgccuccgggcgcagcaaggucaucaagggcacccugccccucaucggggaggccgacugucugcacgagaaguacggcgggcugaacaagucgaagcccuacuacacgggcgagcacgcgaaggccaucggcaacugccccaucugggugaagaccccgcucaagcuggccaacgggaccaaguaccggccgcccgccaagcugcucaaggagcgcggcuucuucggggccaucgcgggcuuccuggagggcgggugggagggcaugaucgccggguggcacggcuacaccucccacggggcccauggcguggccgucgccgcggaccucaagucgacgcaggaggccaucaacaagaucaccaagaaccugaacucccugagcgagcuggaggugaagaaccuccagcggcuguccggcgccauggacgagcugcacaacgagauccucgagcuggacgagaaggucgacgaccugcgcgccgacaccaucucgucccagaucgagcucgccgugcugcugucgaacgaggggaucaucaauuccgaggacgagcaccuccuggcgcuggagcggaagcucaagaagaugcugggccccucggccguggagaucgggaacggcugcuucgagaccaagcacaagugcaaccagaccugccuggaccgcaucgccgccgggacguucgacgcgggcgaguucucccuccccaccuucgacagccugaauaucaccgccgccucccugaacgacgacggccucgacaaccacaccauccugcuguacuacucgacggccgccuccucgcuggcggucacccucaugaucgccaucuucgugguguacauggucucccgggacaacgugagcugcuccaucugccuguga

SEQ ID NO: 14915 - RNA, 1758 nt, Artificial Sequence
  derived and/or modified CDS sequence (AUadapt) from InfluenzaB__AGX17873__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccacuucgccaaucugaaggggacggagacccggggcaagcucugccccaagugccuggacugcaccgaccuggacguggcccucgggcgccccaagugcaccggcaacaucccguccgcccgggugucgauccugcacgagguccgccccgugacguccggcugcuuucccaucaugcacgaccggaccaagauccgccagcugcccaaccuccugcggggguacgagcacauccgccugagcacccacaacgugaucaacgccgagaacgcgccgggcgggcccuacaagaucggcaccuccgggaguugccccaacgucacgaacggcaacggcuucuucgccaccauggccugggccgugcccaagaacgacaacaacaagaccgcgaccaacucccucacgaucgaggugccguauaucugcaccgagggggaggaccagaucaccgucuggggcuuccacagcgacaacgagacccagauggccaagcuguacggggacuccaagccccagaaguucacgucguccgccaauggcgugaccacccacuacgugagccagaucggcggguuccccaaccagaccgaggacggcgggcugccccaguccggccggaucgucguggacuacauggugcagaaguccgggaagacgggcaccaucaccuaccagcgcggcauccuccugccgcagaaggucuggugcgccuccgggcggucgaaggugaucaagggcagccugccccucaucggggaggccgauugccugcacgagaaguacggcgggcugaacaaguccaagcccuacuacaccggcgagcacgcgaaggccaucggcaacugccccaucugggugaagacgccgcucaagcuggccaacgggaccaaguaccgcccgcccgccaagcugcucaaggagcggggcuuuuucggggccaucgcgggcuuccuggagggcgggugggagggcaugaucgccggguggcacggcuacaccucgcacggggcccacggcgucgccguggccgcggaccugaaguccacccaggaggccaucaacaagaucacgaagaaccucaacagucuguccgagcuggaggucaagaaccuccagcgccugucgggcgccauggacgagcugcacaacgagauccucgagcuggacgagaagguggacgaccugcgggccgacaccaucuccagccagaucgagcucgccgugcugcuguccaacgaggggaucaucaauucggaggacgagcaccuccuggcgcuggagcgcaagcucaagaagaugcugggccccuccgccgucgagaucgggaacggcugcuucgagaccaagcacaagugcaaccagaccugccuggaccggaucgccgccgggaccuuugacgcgggcgaguucagccuccccacguucgacucccugaacaucaccgccgccucgcugaacgacgacggccucgacaaucacaccauccugcuguacuacuccaccgccgccagcucccuggcggugacgcucaugaucgccaucuucguggucuacauggugucgcgcgacaacguguccugcagcaucugccuguga

SEQ ID NO: 14916 - RNA, 1758 nt, Artificial Sequence; identical to SEQ ID NO: 14378
  derived and/or modified CDS sequence (AUadapt) from InfluenzaB__AGX17884__HA

SEQ ID NO: 14917 - RNA, 1758 nt, Artificial Sequence
  derived and/or modified CDS sequence (AUadapt) from InfluenzaB__AGX17895__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugccccaagugucugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcauauccgccugucgacccacaacgugaucaacgccgagaacgcgccgggcgggcccuacaagaucggcaccuccgggucgugccccaacgucacgaacggcaacggcuucuucgccaccauggccugggccgugcccaagaacgauaacaacaagaccgcgaccaacucccucacgaucgaggugccguacaucugcaccgagggggaggaccagaucaccgucuggggcuuccacagcgacaacgagaaccagauggccaagcuguacggggauuccaagccccagaaguucaccucguccgccaacggcgugacgacccacuacgugagccagaucggcggguuccccaaccagaccgaggacggcgggcugccccaguccggccggaucgucguggacuacauggugcagaaguccgggaagaccggcacgaucaccuaccagcgcggcauccuccugccgcagaaggucuggugcgccuccgggcggucgaaggugaucaagggcagucugccccucaucggggaggccgacugccugcacgagaaguacggcgggcugaacaaguccaagcccuacuacaccggcgagcacgcgaaggccaucggcaacugccccaucugggugaagaccccgcucaagcuggccaacgggacgaaguaccgcccgcccgccaagcugcucaaggagcggggcuucuucggggccaucgcgggcuuucuggagggcgggugggagggcaugaucgccggguggcacggcuacaccagccacggggcccacggcgucgccguggccgcggaccugaaguccacccaggaggccaucaacaagaucaccaagaaccucaacucgcuguccgagcuggaggucaagaaccuccagcgccugagcggcgccauggacgagcugcauaacgagauccucgagcuggacgagaagguggacgaccugcgggccgacacgaucuccucgcagaucgagcucgccgugcugcuguccaacgaggggaucaucaacucggaggacgagcaccuccuggcgcuggagcgcaagcucaagaagaugcugggccccuccgccgucgagaucgggaacggcugcuucgagaccaagcauaagugcaaccagaccugccuggaccggaucgccgccgggaccuucgacgcgggcgaguucagccuccccaccuucgacucccugaacaucacggccgccucgcugaacgacgauggccucgacaaccacaccauccugcuguacuacuccaccgccgccagcucccuggcggugacccucaugaucgccaucuucguggucuacauggugucgcgcgacaacguguccugcagcaucugccuguga

SEQ ID NO: 14918 - RNA, 1758 nt, Artificial Sequence; identical to SEQ ID NO: 14378
  derived and/or modified CDS sequence (AUadapt) from InfluenzaB__AGX17906__HA

SEQ ID NO: 14919 - RNA, 1758 nt, Artificial Sequence; identical to SEQ ID NO: 14378
  derived and/or modified CDS sequence (AUadapt) from InfluenzaB__AGX17917__HA

SEQ ID NO: 14920 - RNA, 1758 nt, Artificial Sequence
  derived and/or modified CDS sequence (AUadapt) from InfluenzaB__AGX17928__HA
augaagaccaucaucgugcugcucauggucgugaccaguaacgccgaccgcaucugcacgggcaucaccuccucgaacucgccccacguggucaagaccgccacccagggggaggugaacgugacgggcgucaucccgcugaccaccacccccaccaagucgcacuucgcgaaccugaaggggacgaagacccggggcaagcucugccccaagugccugaacugcaccgaccuggacguggcccucgggcgccccaagugcacgggcaauaucccguccgccgaggugagcauccugcacgagguccggcccgugaccuccggcugcuuccccaucaugcacgaccgcaccaagauccggcagcugcccaaccuccugcgcggguacgagcacauccggcugucgacccacaacgugaucaacgccgagaaggccccgggcgggcccuacaagaucggcacguccgggucgugccccaacgucaccaacggcaacggcuucuuugcgaccauggccugggccgugcccaagaacgacaacaacaagaccgccacgaacucccucaccaucgaggugccguacaucugcaccgagggggaggaccagaucaccaucuggggcuuccacucggacaacgagacgcagauggcgaagcuguacggggacuccaagccccagaaguucaccagcuccgccaacggcgucaccacccacuaugugucgcagaucggcggguuccccaaccagacggaggacggcgggcugccccaguccggccgcaucguggucgacuacauggugcagaaguccgggaagaccggcaccaucaccuaccagcggggcauccuccugccgcagaagguguggugcgccuccgggcgcucgaaggucaucaagggcacgcugccccucaucggggaggccgacugccugcacgagaaguacggcgggcugaacaagucgaagcccuacuacaccggcgagcacgccaaggcgaucggcaacugccccaucugggugaagaccccgcucaagcuggccaaugggaccaaguaccggccgcccgccaagcugcucaaggagcgcggcuucuucggggccaucgccggcuuccuggagggcgggugggagggcaugaucgcgggguggcacggcuacacgucccacggggcccacggcguggccgucgccgccgaccucaagagcacccaggaggcgaucaacaagaucaccaagaaccugaacucccugucggagcuggaggugaagaaccuccagcggcuguccggcgccauggacgagcugcacaacgagauccucgagcuggacgagaaggucgaugaccugcgcgccgacaccaucucgucccagaucgagcucgccgugcugcugucgaacgaggggaucaucaacuccgaggacgagcaccuccuggcccuggagcggaagcucaagaagaugcugggccccagcgcgguggagaucgggaacggcugcuucgagaccaagcacaagugcaaccagacgugccuggaccgcaucgccgccgggaccuucgacgccggcgaguucucccuccccaccuuugacucgcugaacaucaccgcggccucccugaacgacgacggccucgacaaccacacgauccugcuguacuacucgaccgccgccuccucgcuggccgucacccucaugaucgcgaucuucgugguguacauggucucccgggacaacgugagcugcuccaucugccuguga

SEQ ID NO: 14921 - RNA, 1758 nt, Artificial Sequence; identical to SEQ ID NO: 14254
  derived and/or modified CDS sequence (AUadapt) from InfluenzaB__AGX17939__HA

SEQ ID NO: 14922 - RNA, 1758 nt, Artificial Sequence; identical to SEQ ID NO: 14254
  derived and/or modified CDS sequence (AUadapt) from InfluenzaB__AGX17950__HA

SEQ ID NO: 14923 - RNA, 1758 nt, Artificial Sequence; identical to SEQ ID NO: 14254
  derived and/or modified CDS sequence (AUadapt) from InfluenzaB__AGX17961__HA

SEQ ID NO: 14924 - RNA, 1758 nt, Artificial Sequence; identical to SEQ ID NO: 14721
  derived and/or modified CDS sequence (AUadapt) from InfluenzaB__AGX17972__HA

SEQ ID NO: 14925 - RNA, 1758 nt, Artificial Sequence; identical to SEQ ID NO: 14254
  derived and/or modified CDS sequence (AUadapt) from InfluenzaB__AGX17983__HA

SEQ ID NO: 14926 - RNA, 1758 nt, Artificial Sequence; identical to SEQ ID NO: 14378
  derived and/or modified CDS sequence (AUadapt) from InfluenzaB__AGX17994__HA

SEQ ID NO: 14927 - RNA, 1758 nt, Artificial Sequence
  derived and/or modified CDS sequence (AUadapt) from InfluenzaB__AGX18005__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugccccaagugucugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcauauccgccugucgacccacaacgugaucaacgccgagaacgcgccgggcgggcccuacaagaucggcaccuccgggucgugccccaacgucacgaacggcaacggcuucuucgccaccauggccugggccgugcccaagaaugacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguuuacgucguccgccaacggcgugaccacccacuacgugagccagaucggcggguuccccaaccagaccgaggacggcgggcugccccaguccggccggaucgucguggacuacauggugcagaaguccgggaagacgggcaccaucaccuaccagcgcggcauccuccugccgcagaaggucuggugcgccuccgggcggucgaaggugaucaagggcucgcugccccucaucggggaggccgauugccugcacgagaaguacggcgggcugaacaaguccaagcccuacuacaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuucuggagggcgggugggagggcaugaucgccggguggcacggcuacaccagccacggggcccacggcgucgccguggccgcggacaucaaguccacccaggaggccaucaacaagaucacgaagaaccugaacucgcucuccgagcuggaggucaagaaccugcagcgccucagcggcgccauggacgagcugcacaaugagauccuggagcucgacgagaagguggacgaccugcgggccgacaccaucuccucgcagaucgagcuggccgugcuccuguccaacgaggggaucaucaacucggaggacgagcaccuccuggcgcuggagcgcaagcugaagaagaugcucggccccuccgccgucgagaucgggaacggcugcuucgagaccaagcauaagugcaaccagaccugccuggaccggaucgccgccgggaccuucgacgcgggcgaguucagccugcccacguucgacucccucaacaucaccgccgccucgcugaacgacgauggccuggacaaccacaccauccuccuguacuacuccaccgccgccagcucccuggcggugacgcugaugaucgccaucuucguggucuacauggugucgcgcgacaacguguccugcagcaucugccucuga

SEQ ID NO: 14928 - RNA, 1758 nt, Artificial Sequence
  derived and/or modified CDS sequence (AUadapt) from InfluenzaB__AGX18016__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugccccaagugucugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcauauccgccugucgacccacaacgugaucaacgccgagaacgcgccgggcgggcccuacaagaucggcaccuccgggagcugccccaacgucacgaacggcaacggcuucuucgccaccauggccugggccgugcccaagaaugacaacaacaagaccgcgaccaacucccucacgaucgaggugccguacaucugcaucgagggggaggaccagaucaccgucuggggcuuccacucggacaacgagacccagauggccaagcuguacggggacuccaagccccagaaguuuaccagcuccgccaacggcgugacgacccacuacgugucgcagaucggcggguuccccaaccagaccgaggacggcgggcugccccaguccggccggaucgucguggacuacauggugcagaaguccgggaagaccggcacgaucaccuaccagcgcggcauccuccugccgcagaaggucuggugcgccuccgggcggagcaaggugaucaagggcucgcugccccucaucggggaggccgauugccugcacgagaaguacggcgggcugaacaaguccaagcccuacuacaccggcgagcacgcgaaggccaucggcaacugccccaucugggugaagaccccgcucaagcuggccaacgggacgaaguaccgcccgcccgccaagcugcucaaggagcggggcuucuucggggccaucgcgggcuuucuggagggcgggugggagggcaugaucgccggguggcacggcuacaccucgcacggggcccacggcgucgccguggccgcggaccugaaguccacccaggaggccaucaacaagaucaccaagaaccucaacagccuguccgagcuggaggucaagaaccuccagcgccugucgggcgccauggacgagcugcacaaugagauccucgagcuggacgagaagguggacgaccugcgggccgacacgaucuccagccagaucgagcucgccgugcugcuguccaacgaggggaucaucaacucggaggacgagcaccuccuggcgcuggagcgcaagcucaagaagaugcugggccccuccgccgucgagaucgggaacggcugcuucgagaccaagcauaagugcaaccagaccugccuggaccggaucgccgccgggaccuucgacgcgggcgaguucagccuccccaccuucgacucccugaacaucacggccgccucgcugaacgacgauggccucgacaaccacaccauccugcuguacuacuccaccgccgccagcucccuggcggugacccucaugaucgccaucuucguggucuacauggugucgcgcgacaacguguccugcagcaucugccuguga

SEQ ID NO: 14929 - RNA, 1758 nt, Artificial Sequence; identical to SEQ ID NO: 14892
  derived and/or modified CDS sequence (AUadapt) from InfluenzaB__AGX18027__HA

SEQ ID NO: 14930 - RNA, 1758 nt, Artificial Sequence; identical to SEQ ID NO: 14378
  derived and/or modified CDS sequence (AUadapt) from InfluenzaB__AGX18038__HA

SEQ ID NO: 14931 - RNA, 1758 nt, Artificial Sequence; identical to SEQ ID NO: 14378
  derived and/or modified CDS sequence (AUadapt) from InfluenzaB__AGX18049__HA

SEQ ID NO: 14932 - RNA, 1758 nt, Artificial Sequence; identical to SEQ ID NO: 14378
  derived and/or modified CDS sequence (AUadapt) from InfluenzaB__AGX18060__HA

SEQ ID NO: 14933 - RNA, 1758 nt, Artificial Sequence; identical to SEQ ID NO: 14254
  derived and/or modified CDS sequence (AUadapt) from InfluenzaB__AGX18071__HA

SEQ ID NO: 14934 - RNA, 1758 nt, Artificial Sequence; identical to SEQ ID NO: 14914
  derived and/or modified CDS sequence (AUadapt) from InfluenzaB__AGX18082__HA

SEQ ID NO: 14935 - RNA, 1758 nt, Artificial Sequence; identical to SEQ ID NO: 14914
  derived and/or modified CDS sequence (AUadapt) from InfluenzaB__AGX18093__HA

SEQ ID NO: 14936 - RNA, 1758 nt, Artificial Sequence; identical to SEQ ID NO: 14721
  derived and/or modified CDS sequence (AUadapt) from InfluenzaB__AGX18104__HA

SEQ ID NO: 14937 - RNA, 1758 nt, Artificial Sequence; identical to SEQ ID NO: 14378
  derived and/or modified CDS sequence (AUadapt) from InfluenzaB__AGX18115__HA

SEQ ID NO: 14938 - RNA, 1758 nt, Artificial Sequence; identical to SEQ ID NO: 14378
  derived and/or modified CDS sequence (AUadapt) from InfluenzaB__AGX18126__HA

SEQ ID NO: 14939 - RNA, 1758 nt, Artificial Sequence; identical to SEQ ID NO: 14254
  derived and/or modified CDS sequence (AUadapt) from InfluenzaB__AGX18137__HA

SEQ ID NO: 14940 - RNA, 1758 nt, Artificial Sequence; identical to SEQ ID NO: 14914
  derived and/or modified CDS sequence (AUadapt) from InfluenzaB__AGX18148__HA

SEQ ID NO: 14941 - RNA, 1758 nt, Artificial Sequence; identical to SEQ ID NO: 14254
  derived and/or modified CDS sequence (AUadapt) from InfluenzaB__AGX18159__HA

SEQ ID NO: 14942 - RNA, 1758 nt, Artificial Sequence; identical to SEQ ID NO: 14254
  derived and/or modified CDS sequence (AUadapt) from InfluenzaB__AGX18170__HA

SEQ ID NO: 14943 - RNA, 1758 nt, Artificial Sequence; identical to SEQ ID NO: 14914
  derived and/or modified CDS sequence (AUadapt) from InfluenzaB__AGX18181__HA

SEQ ID NO: 14944 - RNA, 1758 nt, Artificial Sequence
  derived and/or modified CDS sequence (AUadapt) from InfluenzaB__AGX18192__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaauaucccguccgccgaggugucgauccugcacgagguccggcccgugacguccggcugcuuccccaucaugcacgaccgcaccaagauccggcagcugcccaaccuccugcgcggguacgagcacauccggcugucgacccacaacgugaucaacgccgagaaggcgccgggcgggcccuacaagaucggcaccuccgggucgugccccaacgucacgaacggcaacggcuucuuugccaccauggccugggccgugcccaagaacgacaacaacaagaccgcgaccaacucccucacgaucgaggugccguacaucugcaccgagggggaggaccagaucaccaucuggggcuuccacagcgacaacgagacccagauggccaagcuguacggggacuccaagccccagaaguucacgucguccaccaacggcgucaccacccacuacgugagucagaucggcggguuccccaaccagacggaggacggcgggcugccccaguccggccgcaucguggucgacuacauggugcagaagccggggaagaccggcaccaucaccuaccagcggggcauccuccugccccagaagguguggugcgccagcgggcgcuccaaggucaucaagggcucgcugccccucaucggggaggccgacugccugcacgagaaguacggcgggcugaacaagucgaagcccuacuacacgggcgagcacgccaaggcgaucggcaacuguccgaucugggugaagacgccccucaagcuggccaacgggaccaaguaccggccgcccgccaagcugcucaaggagcgcggcuucuucggggccaucgccggcuuccuggagggcgggugggagggcaugaucgcgggguggcacggcuacaccucccacggggcccacggcguggccgucgccgccgaccugaaguccacccaggaggcgaucaacaagaucaccaagaaccucaacucccugucggagcuggaggugaagaaccuccagcggcuguccagcgccauggacgagcugcacaacgagauccucgagcuggacgagaaggucgaugaccugcgcgccgacaccaucuccucgcagaucgagcucgccgugcugcuguccaacgagggcaucaucaacucggaggacgagcaccuccuggcccuggagcggaagcucaagaagaugcuggggcccuccgcgguggagaucggcaacgggugcuucgagaccaagcacaagugcaaccagaccugccuggaccgcaucgccgccggcacguucgacgccggggaguucucgcuccccaccuuugacucccugaacaucaccgcggccagccugaacgacgacggccucgacaaccacaccauccugcuguacuacuccacggccgccucgucccuggccgucacccucaugaucgcgaucuucgugguguacauggucucgcgggacaacguguccugcagcaucugccuguga

SEQ ID NO: 14945 - RNA, 1758 nt, Artificial Sequence; identical to SEQ ID NO: 14892
  derived and/or modified CDS sequence (AUadapt) from InfluenzaB__AGX18203__HA

SEQ ID NO: 14946 - RNA, 1758 nt, Artificial Sequence
  derived and/or modified CDS sequence (AUadapt) from InfluenzaB__AGX18214__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggauguggcccucgggcgccccaagugcaccggcaacaucccguccgccgaggugucgauccugcacgagguccggcccgugacguccggcugcuuccccaucaugcacgaccgcaccaagauccggcagcugcccaaccuccugcgcggguacgagcacauccggcugucgacccacaacgugaucaacgccgagaaggcgccgggcgggcccuacaagaccggcacguccgggagcugucccaacgucaccaacggcaacggcuucuucgccaccauggccugggccgugcccaagaacgacaacaacaagaccgcgacgaacucccucaccaucgaggugccguacaucugcaccgagggggaggaccagaucaccaucuggggcuuccacucggacaaugagacgcagauggccaagcuguacggggacuccaagccccagaaguucaccucguccgccaacggcgucaccacccacuacgugagccagaucggcggguuccccaaccagacggaggacggcgggcugccccaguccggccgcaucguggucgacuacauggugcagaaguccgggaagaccggcaccaucaccuaccagcggggcauccuccugccgcagaagguguggugcgccuccgggcgcucgaaggucaucaagggcucgcugccccucaucggggaggccgauugccugcacgagaaguacggcgggcugaacaaguccaagcccuacuacacgggcgagcacgcgaaggccaucggcaacugccccaucugggugaagaccccgcucaagcuggccaacgggaccaaguaccggccgcccgccaagcugcucaaggagcgcggcuucuucggggccaucgcgggcuuccuggagggcgggugggagggcaugaucgccggguggcacggcuacaccagccauggggcccacggcguggccgucgccgcggaccugaaguccacgcaggaggccaucaacaagaucaccaagaaccucaacucgcuguccgagcuggaggugaagaaccuccagcggcugucgggcgccauggacgagcugcacaacgagauccucgagcuggacgagaaggucgacgaccugcgcgccgacaccaucuccagccagaucgagcucgccgugcugcuguccaacgaggggaucaucaauucggaggacgagcaccuccuggcgcuggagcggaagcucaagaagaugcugggccccuccgccguggagaucgggaacggcugcuucgagaccaagcacaagugcaaccagaccugccuggaccgcaucgccgccgggacguucgacgcgggcgaguucucgcuccccaccuucgacucccugaauaucaccgccgccagccugaacgacgacggccucgacaaccacaucauccugcuguacuacuccaccgccgccucgucccuggcggucacgcucaugaucgccaucuucgugguguacauggucucgcgggacaacguguccugcagcaucugccuguga

SEQ ID NO: 14947 - RNA, 1758 nt, Artificial Sequence
  derived and/or modified CDS sequence (AUadapt) from InfluenzaB__AGX18225__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacgaagacccggggcaagcucugccccaagugucugaacugcaccgaccuggacguggcccucgggcgccccaagugcaccggcaacaucccguccgccgaggugagcauccugcacgagguccggcccgugacguccggcugcuuccccaucaugcacgaccgcaccaagauccggcagcugcccaaccuccugcgcggguacgagcauauccggcugucgacccacaacgugaucaacgccgagaaggcgccgggcgggcccuacaagaucggcaccuccgggucgugccccaacgucacgaacggcaacggcuucuucgccaccauggccugggccgugcccaagaacgauaacaacaagaccgcgaccaacucccucacgaucgaggugccguacaucugcaccgagggggaggaccagaucaccaucuggggcuuccacagcgacaacgagacccagauggccaagcuguacggggacuccaagccccagaaguucacgaguuccgccaacggcgucaccacccacuacgugagccagaucggcggguuccccaaccagaccgaggacggcgggcugccccaguccggccgcaucguggucgacuacauggugcagaaguccgggaagacgggcaccaucaccuaccagcggggcauccuccugccgcagaagguguggugcgccuccgggcgcucgaaggucaucaagggcucgcugccccucaucggggaggccgauugccugcacgagaaguacggcgggcugaacaaguccaagcccuacuacaccggcgagcacgcgaaggccaucggcaacugccccaucugggugaagacgccgcucaagcuggccaacgggaccaaguaccggccgcccgccaagcugcucaaggagcgcggcuucuucggggccaucgcgggcuuccuggagggcgggugggagggcaugaucgccggguggcauggcuacaccagccacggggcccacggcguggccgucgccgcggaccugaaguccacccaggaggccaucaaccggaucacgaagaaccucaacucgcuguccgagcuggaggugaagaaccuccagcgccugagcggcgccauggacgagcugcacaaugagauccucgagcuggacgagaaggucgacgaccugcgggccgacaccaucuccucgcagaucgagcucgccgugcugcuguccaacgaggggaucaucaacucggaggacgagcaccuccuggcgcuggagcgcaagcucaagaagaugcugggccccuccgccguggagaucgggaacggcugcuucgagaccaagcacaaguguaaccagaccugccuggaccggaucgccgccgggaccuucgacgcgggcgaguucagccuccccacguucgacucccugaacaucaccgccgccucgcugaacgacgauggccucgacaaccacaccauccugcuguacuacuccaccgccgccagcucccuggcggucacgcucaugaucgccaucuucgugguguacauggucucgcgcgacaacguguccugcagcaucugccuguga

SEQ ID NO: 14948 - RNA, 1758 nt, Artificial Sequence
  derived and/or modified CDS sequence (AUadapt) from InfluenzaB__AGX18236__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaauaucccguccgccgaggugucgauccugcacgagguccggcccgugacguccggcugcuuccccaucaugcacgaccgcaccaagauccggcagcugcccaaccuccugcgcggguacgagcacauccggcugucgacccacaacgugaucaacgccgagaaggcgccgggcgggcccuacaagaucggcaccuccgggucgugccccaacgucacgaacggcaacggcuucuuugccaccauggccugggccgugcccaagaacgacaacaacaagaccgcgaccaacucccucacgaucgaggugccguacaucugcaccgagggggaggaccagaucaccaucuggggcuuccacagcgacaacgagacccagauggccaagcuguacggggacuccaagccccagaaguucacgucguccgccaacggcgucaccacccacuacgugagucagaucggcggguuccccaaccagaccgaggacggcgggcugccccaguccggccgcaucguggucgacuacaugaugcagaaguccgggaagacgggcaccaucaccuaccagcggggcauccuccugccgcagaagguguggugcgccuccgggcgcagcaaggugaucaagggcucgcugccccucaucggggaggccgacugccugcacgagaaguacggcgggcugaacaaguccaagcccuacuacaccggcgagcacgcgaaggccaucggcaacugccccaucugggucaagacgccgcucaagcuggccaaugggaccaaguaccggccgcccgccaagcugcucaaggagcgcggcuucuucggggccaucgcgggcuuccuggagggcgggugggagggcaugaucgccggguggcacggcuacaccucgcacggggcccacggcguggccguggccgcggaccugaaguccacccaggaggccaucaacaagaucacgaagaaccucaacucgcuguccgagcuggaggucaagaaccuccagcggcugagcggcgccauggacgagcugcacaacgagauccucgagcuggacgagaagguggaugaccugcgcgccgacaccaucuccucgcagaucgagcucgccguccugcuguccaacgaggggaucaucaacucggaggacgagcaccuccuggcgcuggagcggaagcucaagaagaugcugggccccuccgccguggagaucgggaacggcugcuucgagaccaagcacaagugcaaccagaccugccuggaccgcaucgccgccgggaccuucgacgcgggcgaguucucgcuccccacguuugacucccugaacaucaccgccgccagccugaacgacgacggccucgacaaccacaccauccugcuguacuacuccaccgccgccucgucccuggcggugacgcucaugaucgccaucuucgucguguacauggugucgcgggacaacgucuccugcagcaucugccuguga

SEQ ID NO: 14949 - RNA, 1758 nt, Artificial Sequence; identical to SEQ ID NO: 14305
  derived and/or modified CDS sequence (AUadapt) from InfluenzaB__AGX18247__HA

SEQ ID NO: 14950 - RNA, 1758 nt, Artificial Sequence
  derived and/or modified CDS sequence (AUadapt) from InfluenzaB__AGX18258__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaucuggacguggcccucgggcgccccaagugcaccggcaacaucccguccgccgaggugucgauccugcacgagguccggcccgugacguccggcugcuuccccaucaugcacgaccgcaccaagauccggcagcugcccaaccuccugcgcggguacgagcacauccggcugucgacccacaacgugaucaacgccgagaaggcgccgggcgggcccuacaagaucggcaccuccgggaguugccccaacgucacgaacggcaacggcuucuucgccaccauggccugggccgugcccaagaacgacaagaacaagaccgcgaccaacucccucacgaucgaggugccguacaucugcaccgagggggaggaccagaucaccaucuggggcuuccacucggacaaugagacccagauggccaagcuguacggggacuccaagccccagaaguucacgucguccgccaacggcgucaccacccacuacgugucgcagaucggcggguuccccaaccagaccgaggacggcgggcugccccaguccggccgcaucguggucgacuacauggugcagaaguccgggaagacgggcaccaucaccuaccagcggggcauccuccugccgcagaagguguggugcgccuccgggcgcagcaaggucaucaagggcacccugccccucaucggggaggccgacugucugcacgagaaguacggcgggcugaacaagucgaagcccuacuacacgggcgagcacgcgaaggccaucggcaacugccccaucugggugaagaccccgcucaagcuggccaacgggaccaaguaccggccgcccgccaagcugcucaaggagcgcggcuucuucggggccaucgcgggcuuccuggagggcgggugggagggcaugaucgccggguggcacggcuacaccucccacggggcccauggcguggccgucgccgcggaccucaagucgacgcaggaggccaucaacaagaucaccaagaaccugaacucccugagcgagcuggaggugaagaaccuccagcggcuguccggcgccauggacgagcugcacaacgagauccucgagcuggacgagaaggucgacgaccugcgcgccgacaccaucucgucccagaucgagcucgccgugcugcugucgaacgaggggaucaucaauuccgaggacgagcaccuccuggcgcuggagcggaagcucaagaagaugcugggccccucggccguggagaucgggaacggcugcuucgagaccaagcacaagugcaaccagaccugccuggaccgcaucgccgccgggacguucgacgcgggcgaguucucccuccccaccuucgacagccugaauaucaccgccgccucccugaacgacgacggccucgacaaccacaccauccugcuguacuacucgacggccgccuccucgcuggcggucacccucaugaucgccaucuucgugguguacauggucucccgggacaacgugagcugcuccaucugccuguga

SEQ ID NO: 14951 - RNA, 1758 nt, Artificial Sequence; identical to SEQ ID NO: 14254
  derived and/or modified CDS sequence (AUadapt) from InfluenzaB__AGX18280__HA

SEQ ID NO: 14952 - RNA, 1758 nt, Artificial Sequence
  derived and/or modified CDS sequence (AUadapt) from InfluenzaB__AGX18291__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaauaucccguccgccgaggugucgauccugcacgagguccggcccgugacguccggcugcuuccccaucaugcacgaccgcaccaagauccggcagcugcccaaccuccugcgcggguacgagcacauccggcugucgacccacaacgugaucaacgccgagaaggcgccgggcgggcccuacaagaucggcaccuccgggagcugccccaacgucacgaacggcaacggcuucuuugccaccauggccugggccgugcccaagaacgacaacaacaagaccgcgaccaacucccucacgaucgaggugccguacaucugcaccgagggggaggaccagaucaccaucuggggcuuccacucggacaacgagacccagauggccaagcuguacggggacuccaagccccagaaguucacgucguccgccaacggcgucaccacccacuacgugagucagaucggcggguuccccaaccagaccgaggacggcgggcugccccaguccggccgcaucguggucgacuacauggugcagaaguccgggaagacgggcaccaucaccuaccagcggggcauccuccugccgcagaagguguggugcgucuccgggcgcucgaaggugaucaagggcucgcugccccucaucggggaggccgacugccugcacgagaaguacggcgggcugaacaaguccaagcccuacuacaccggcgagcacgccaaggcgaucggcaacugccccaucugggugaagacgccgcucaagcuggccaaugggaccaaguaccggccgcccgccaagcugcucaaggagcgcggcuucuucggggccaucgccggcuuccuggagggcgggugggagggcaugaucgcgggguggcacggcuacaccagccacggggcccacggcgucgccguggccgccgaccugaaguccacccaggaggcgaucaacaagaucacgaagaaccucaacucgcuguccgagcuggaggucaagaaccuccagcggcugucgggcgccauggacgagcugcacaacgagauccucgagcuggacgagaagguggaugaccugcgcgccgacaccaucuccagccagaucgagcucgccgugcugcuguccaacgaggggaucaucaacucggaggacgagcaccuccuggcccuggagcggaagcucaagaagaugcugggccccuccgcggucgagaucgggaacggcugcuucgagaccaagcacaagugcaaccagaccugccuggaccgcaucgccgccgggaccuucgacgccggcgaguucucgcuccccacguuugacucccugaacaucaccgcggccagccugaacgacgacggccucgacaaccacaccauccugcuguacuacuccaccgccgccucgucccuggccgugacgcucaugaucgcgaucuucguggucuacauggugucgcgggacaacguguccugcagcaucugccuguga

SEQ ID NO: 14953 - RNA, 1758 nt, Artificial Sequence
  derived and/or modified CDS sequence (AUadapt) from InfluenzaB__AGX18302__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagucgcacuucgccaaccugaaggggacgaagacccggggcaagcucugccccaagugccugaacugcaccgaccuggacguggcccucgggcgccccaagugcaccggcaauaucccguccgccgaggugagcauccugcacgagguccggcccgugacguccggcugcuuccccaucaugcacgaccgcaccaagauccggcagcugcccaaccuccugcgcggguacaagcacauccggcugucgacccacaacgugaucaacgccgagaaggcgccgggcgggcccuacaagaucggcaccuccgggucgugccccaacgucacgaacggcaacggcuucuuugccaccauggccugggccgugcccaagaacgacaacaacaagaccgcgaccaacucccucacgaucgaggugccguacaucugcaccgagggggaggaccagaucaccaucuggggcuuccacucggacaacgagacccagauggccaagcuguacggggacuccaagccccagaaguucacgagcuccgccaacggcgucaccacccacuaugugucgcagaucggcggguuccccaaccagaccgaggacggcgggcugccccaguccggccgcaucguggucgacuacauggugcagaaguccgggaagacgggcaccaucaccuaccagcggggcauccuccugccgcagaagguguggugcgccuccgggcgcucgaaggucaucaagggcacccugccccucaucggggaggccgacugccugcacgagaaguacggcgggcugaacaagucgaagcccuacuacacgggcgagcacgcgaaggccaucggcaacugccccaucugggugaagaccccgcucaagcuggccaaugggaccaaguaccggccgcccgccaagcugcucaaggagcgcggcuucuucggggccaucgcgggcuuccuggagggcgggugggagggcaugaucgccggguggcacggcuacaccucccacggggcccacggcguggccgucgccgcggaccucaagagcacgcaggaggccaucaacaagaucaccaagaaccugaacucccugucggagcuggaggugaagaaccuccagcggcuguccggcgccauggacgagcugcacaacgagauccucgagcuggacgagaaggucgaugaccugcgcgccgacaccaucucgucccagaucgagcucgccgugcugcugucgaacgaggggaucaucaacuccgaggacgagcaccuccuggcgcuggagcggaagcucaagaagaugcugggccccagcgccguggagaucgggaacggcugcuucgagaccaagcacaagugcaaccagaccugccuggaccgcaucgccgccgggacguucgacgcgggcgaguucucccuccccaccuuugacucgcugaacaucaccgccgccucccugaacgacgacggccucgacaaccacaccauccugcuguacuacucgacggccgccuccucgcuggcggucacccucaugaucgccaucuucgugguguacauggucucccgggacaacgugagcugcuccaucugccuguga

SEQ ID NO: 14954 - RNA, 1758 nt, Artificial Sequence; identical to SEQ ID NO: 14254
  derived and/or modified CDS sequence (AUadapt) from InfluenzaB__AGX18313__HA

SEQ ID NO: 14955 - RNA, 1758 nt, Artificial Sequence
  derived and/or modified CDS sequence (AUadapt) from InfluenzaB__AGX18324__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacgaagacccggggcaagcucugccccaagugccugaacuguaccgaccuggacguggcccucgggcgccccaagugcaccggcaacaucccguccgccgaggugucgauccugcacgagguccggcccgugacguccggcugcuuccccaucaugcacgaccgcaccaagauccggcagcugcccaaccuccugcgcggguacgagcacauccggcugagcacccacaaugugaucaacgccgagaaggcgccgggcgggcccuacaagaucggcaccuccgggucgugccccaacgucacgaacggcaacggcuucuucgccaccauggccugggccgugcccaagaacgacaacaacaagaccgcgaccaacucccucacgaucgaggugccguacaucuguaccgagggggaggaccagaucaccaucuggggcuuccacucggacaacgaggcccagauggccaagcuguacggggacuccaagccccagaaguucaccagcuccgccaacggcgucacgacccacuacgugucgcagaucggcggguuccccaaucagaccgaggacggcgggcugccccaguccggccgcaucguggucgacuacauggugcagaaguccgggaagaccggcacgaucaccuaccagcggggcauccuccugccgcagaagguguggugcgccuccgggcgcagcaaggucaucaagggcucgcugccccucaucggggaggcggacugccugcacgagaaguacggcgggcugaacaaguccaagcccuacuacaccggcgagcacgccaaggccaucggcaauugccccaucugggugaagaccccgcucaagcuggccaacgggacgaaguaccggccgcccgccaagcugcucaaggagcgcggcuucuucggggcgaucgccggcuuccuggagggcgggugggagggcaugaucgccggguggcacggcuacaccucgcacggggcccacggcguggccgucgcggccgaccugaaguccacccaggaggccaucaacaagaucaccaagaaccucaacagucuguccgagcuggaggugaagaaccuccagcggcugucgggcgccauggacgagcugcacaacgagauccucgagcuggacgagaaggucgacgaccugcgcgccgacacgaucuccucgcagaucgagcucgcggugcugcuguccaacgaggggaucaucaacagcgaggacgagcaccuccuggcccuggagcggaagcucaagaagaugcugggccccuccgccguggagaucgggaauggcugcuucgagaccaagcacaagugcaaccagaccugccuggaccgcaucgccgcggggaccuucgacgccggcgaguucucgcuccccaccuucgacucccugaacaucacggccgccucgcugaaugacgacggccucgacaaccacaccauccugcuguacuacuccaccgccgcgagcucccuggccgucacccucaugaucgccaucuucgugguguacauggucucgcgggacaacguguccugcagcaucugccuguga

SEQ ID NO: 14956 - RNA, 1758 nt, Artificial Sequence; identical to SEQ ID NO: 14914
  derived and/or modified CDS sequence (AUadapt) from InfluenzaB__AGX18335__HA

SEQ ID NO: 14957 - RNA, 1758 nt, Artificial Sequence
  derived and/or modified CDS sequence (AUadapt) from InfluenzaB__AGX18346__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggauguggcccucgggcgccccaagugcaccggcaacaucccguccgccgaggugucgauccugcacgagguccggcccgugacguccggcugcuuccccaucaugcacgaccgcaccaagauccggcagcugcccaaccuccugcgcggguacgagcacauccggcugucgacccacaacgugaucaacgccgagaaggcgccgggcgggcccuacaagaucggcaccuccgggagcugucccaacgucacgaacggcaacggcuucuucgccaccauggccugggccgugcccaagaacgacaacaacaagaccgcgaccaacucccucacgaucgaggugccguacaucugcaccgagggggaggaccagaucaccaucuggggcuuccacucggacaaugagacccagauggccaagcuguacggggacuccaagccccagaaguucacgucguccgccaacggcgucaccacccacuacgugagccagaucggcggguuccccaaccagaccgaggacggcgggcugccccaguccggccgcaucguggucgacuacauggugcagaaguccgggaagacgggcaccaucaccuaccagcggggcauccuccugccgcagaagguguggugcgccuccgggcgcucgaaggucaucaagggcucgcugccccucaucggggaggccgauugccugcacgagaaguacggcgggcugaacaaguccaagcccuacuacaccggcgagcacgcgaaggccaucggcaacugccccaucugggugaagacgccgcucaagcuggccaacgggaccaaguaccggccgcccgccaagcugcucaaggagcgcggcuucuucggggccaucgcgggcuuccuggagggcgggugggagggcaugaucgccggguggcacggcuacaccagccauggggcccacggcguggccgucgccgcggaccugaaguccacccaggaggccaucaacaagaucacgaagaaccucaacucgcuguccgagcuggaggugaagaaccuccagcggcugucgggcgccauggacgagcugcacaacgagauccucgagcuggacgagaaggucgacgaccugcgcgccgacaccaucuccagccagaucgagcucgccgugcugcuguccaacgaggggaucaucaauucggaggacgagcaccuccuggcgcuggagcggaagcucaagaagaugcugggccccuccgccguggagaucgggaacggcugcuucgagaccaagcacaagugcaaccagaccugccuggaccgcaucgccgccgggaccuucgacgcgggcgaguucucgcuccccacguucgacucccugaauaucaccgccgccagccugaacgaggacggccucgacaaccacaccauccugcuguacuacuccaccgccgccucgucccuggcggucacgcucaugaucgccaucuucgugguguacauggucucgcgggacaacguguccugcagcaucugccuguga

SEQ ID NO: 14958 - RNA, 1758 nt, Artificial Sequence
  derived and/or modified CDS sequence (AUadapt) from InfluenzaB__AGX18357__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccgcccccaccaagucgcacuucgccaaccugaaggggaccaagacgcggggcaagcucugccccaagugccugaacuguaccgaccuggacguggcccucgggcgccccaagugcaccggcaacaucccguccgccgaggugucgauccugcacgagguccggcccgugaccuccggcugcuuccccaucaugcacgaccgcacgaagauccggcagcugcccaaccuccugcgcggguacgagcacauccggcugagcacccacaaugugaucaacgcggagaaggccccgggcgggcccuacaagaucggcaccuccgggucgugccccaacgucaccaacggcaacggcuucuucgccacgauggccugggcggugcccaagaacgacaacaacaagaccgccaccaacucccucaccaucgaggugccguacaucuguacggagggggaggaccagaucaccaucuggggcuuccacucggacaaggagacccagauggccaagcuguacggggacuccaagccccagaaguucaccagcuccgccaacggcgucacgacccacuacgugucgcagaucggcggguuccccaaccagaccgaggauggcgggcugccccaguccggccgcaucguggucgacuacauggugcagaagccggggaagaccggcacgaucaccuaccagcggggcauccuccugccccagaagguguggugcgccagcgggcgcuccaaggucaucaagggcucgcugccccucaucggggaggcggacugccugcacgagaaguacggcgggcugaacaagucgaagcccuacuacaccggcgagcacgccaaggccaucggcaauugcccgaucugggugaagacgccccucaagcuggccaacgggaccaaguaccggccgcccgccaagcugcucaaggagcgcggcuucuucggggcgaucgccggcuuccuggagggcgggugggagggcaugaucgccggguggcacggcuacaccucccacggggcccacggcguggccgucgcggccgaccugaaguccacccaggaggccaucaacaagaucaccaagaaccucaacucccugagcgagcuggaggugaagaaucuccagcggcuguccucggccauggacgagcugcacaacgagauccucgagcuggacgagaaggucgacgaccugcgcgccgacacgaucuccucgcagaucgagcucgcggugcugcuguccaacgagggcaucaucaacagcgaggacgagcaccuccuggcccuggagcggaagcucaagaagaugcuggggcccuccgccguggagaucggcaacggguguuucgagaccaagcacaagugcaaccagaccugccuggaccgcaucgccgcgggcaccuucgacgccggggaguucucgcuccccaccuucgacucccugaacaucacggccgccucgcugaacgaugacggccucgacaaccacaccauccugcuguacuacuccaccgccgcgagcucccuggccgucacccucaugaucgccaucuucgugguguacauggucucgcgggacaacguguccugcagcaucugccuguga

SEQ ID NO: 14959 - RNA, 1758 nt, Artificial Sequence
  derived and/or modified CDS sequence (AUadapt) from InfluenzaB__AGX18368__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccgcccccaccaagagccacuucgccaaccugaaggggaccaagacgcggggcaagcucugccccaagugccugaacuguaccgaccuggacguggcccucgggcgccccaagugcaccggcaacaccccguccgccgaggugucgauccugcacgagguccggcccgugacguccggcugcuuccccaucaugcacgaccgcaccaagauccggcagcugcccaaccuccugcgcggguacgagcacauccggcugucgaaccauaacgugaucaacgcggagaaggccccgggcgggcccuacaagaucggcaccuccgggagcugccccaacgucaccaacggcaacggcuucuucgccacgauggccugggcggugcccaagaacgacaacaacaagaccgccaccaacucccucaccaucgaggugccguauaucugcacggagggggaggaccagaucaccaucuggggcuuccacucggacaacgagacccagauggccaagcuguacggggacuccaagccccagaaguucaccucguccgccaacggcgucacgacccacuacgugagccagaucggcggguuucccaaccagaccgaggacggcgggcugccccaguccggccgcaucguggucgacuacauggugcagaagccggggaagaccggcacgaucaccuaccagcggggcauccuccugccccagaagguguggugcgccucggggcgcuccaaggucaucaagggcucgcugccccucaucggggaggcggacugccugcacgagaaguacggcgggcugaacaagagcaagcccuacuacaccggcgagcaugccaaggccaucggcaacugcccgaucugggugaagacgccccucaagcuggccaacgggaccaaguaccggccgcccgccaagcugcucaaggagcgcggcuucuucggggcgaucgccggcuuccuggagggcgggugggagggcaugaucgccggguggcacggcuacaccucccacggggcccacggcguggccgucgcggccgaccugaaguccacccaggaggccaucaacaagaucaccaagaaccucaacucccugagugagcuggaggugaagaaccuccagcggcuguccucggccauggacgagcugcacaacgagauccucgagcuggacgagaaggucgacgaccugcgcgccgacacgaucuccagccagaucgagcucgcggugcugcuguccaacgagggcaucaucaacucggaggacgagcaccuccuggcccuggagcggaagcucaagaagaugcuggggcccuccgccguggagaucggcaaugggugcuucgagaccaagcacaagugcaaccagaccugccuggaccgcaucgccgcgggcaccuucgacgccggggaguucucgcuccccaccuucgacucccugaacaucacggccgccagccugaaugacgacggccucgacaaccacaccauccugcuguacuacuccaccgccgcgucgucccuggccgucacccucaugaucgccaucuucgugguguacauggucucgcgggacaacguguccugcagcaucugccuguga

SEQ ID NO: 14960 - RNA, 1758 nt, Artificial Sequence; identical to SEQ ID NO: 14378
  derived and/or modified CDS sequence (AUadapt) from InfluenzaB__AGX18379__HA

SEQ ID NO: 14961 - RNA, 1758 nt, Artificial Sequence; identical to SEQ ID NO: 14914
  derived and/or modified CDS sequence (AUadapt) from InfluenzaB__AGX18390__HA

SEQ ID NO: 14962 - RNA, 1758 nt, Artificial Sequence
  derived and/or modified CDS sequence (AUadapt) from InfluenzaB__AGX18401__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccgcccccaccaagucgcacuucgccaaccugaaggggaccaagacgcggggcaagcucugccccaagugccugaacugcaccgaccuggauguggcccucgggcgccccaagugcaccggcaacaucccguccgccgaggugucgauccugcacgagguccggcccgugaccuccggcugcuuccccaucaugcacgaccgcacgaagauccggcagcugcccaaccuccugcgcggguacgagcacauccggcugagcacccacaacgugaucaacgcggagaaggccccgggcgggcccuacaagaucggcaccuccgggucgugucccaacgucaccaacggcaacggcuucuucgccacgauggccugggcggugcccaagaacgacaacaacaagaccgccaccaacucccucaccaucgaggugccguacaucugcacggagggggaggaccagaucaccaucuggggcuuccacucggacaaugagauccagauggccaagcuguacggggacuccaagccccagaaguucaccagcuccgccaacggcgucaccacgcacuacgugucgcagaucggcggguuccccaaccagaccgaggacggcgggcugccccaguccggccgcaucguggucgacuacauggugcagaagccggggaagaccggcaccaucacguaccagcggggcauccuccugccccagaagguguggugcgccagcgggcgcuccaaggucaucaagggcucgcugccccucaucggggaggcggauugccugcacgagaaguacggcgggcugaacaagucgaagcccuacuacaccggcgagcacgccaaggccaucggcaacugcccgaucugggugaagacgccccucaagcuggccaacgggaccaaguaccggccgcccgccaagcugcucaaggagcgcggcuucuucggggcgaucgccggcuuccuggagggcgggugggagggcaugaucgccggguggcacggcuacaccucccauggggcccacggcguggccgucgcggccgaccugaaguccacccaggaggccaucaacaagaucaccaagaaccucaacucccugagcgagcuggaggugaagaaccuccagcggcuguccucggccauggacgagcugcacaacgagauccucgagcuggacgagaaggucgacgaccugcgcgccgacaccaucuccucgcagaucgagcucgcggugcugcuguccaacgagggcaucaucaauagcgaggacgagcaccuccuggcccuggagcggaagcucaagaagaugcuggggcccuccgccguggagaucggcaacgggugcuucgagacgaagcacaagugcaaccagaccugccuggaccgcaucgccgcgggcaccuucgacgccggggaguucucgcuccccaccuucgacucccugaauaucaccgccgccucgcugaacgacgacggccucgacaaccacacgauccugcuguacuacuccaccgccgcgagcucccuggccgucacccucaugaucgccaucuucgugguguacauggucucgcgggacaacguguccugcagcaucugccuguga

SEQ ID NO: 14963 - RNA, 1758 nt, Artificial Sequence
  derived and/or modified CDS sequence (AUadapt) from InfluenzaB__AGX18412__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggauguggcccucgggcgccccaagugcaccggcaacaucccguccgccgaggugucgauccugcacgagguccggcccgugacguccggcugcuuccccaucaugcacgaccgcaccaagauccggcagcugcccaaccuccugcgcggguacgagcacauccggcugucgaaccacaacgugaucaacgccgagaaggcgccgggcgggcccuacaagaucggcaccuccgggaguugccccaacgucaccaacggcaacggcuucuucgccacgauggccugggccgugcccaagaacgacaacaacaagaccgcgaccaacucccucaccaucgaggugccguacaucugcacggagggggaggaccagaucaccaucuggggcuuccacucggauaacgaggcccagauggccaagcuguacggggacuccaagccccagaaguucaccucguccgccaacggcgucaccacgcacuacgugagccagaucggcggguuccccaaccagaccgaggacggcgggcugccccaguccggccgcaucguggucgacuacauggugcagaaguccgggaagaccggcaccaucacguaccagcggggcauccuccugccgcagaagguguggugcgccuccgggcgcucgaaggucaucaagggcucgcugccccucaucggggaggcggauugccugcacgagaaguacggcgggcugaacaaguccaagcccuacuacaccggcgagcacgccaaggccaucggcaacugccccaucugggugaagaccccgcucaagcuggccaacgggaccaaguaccggccgcccgccaagcugcucaaggagcgcggcuucuucggggcgaucgccggcuuccuggagggcgggugggagggcaugaucgccggguggcacggcuacacgagccauggggcccacggcguggccgucgcggccgaccugaaguccacccaggaggccaucaacaagaucaccaagaaccucaacucgcuguccgagcuggaggugaagaaccuccagcggcugucgggcgccauggacgagcugcacaacgagauccucgagcuggacgagaaggucgacgaccugcgcgccgacaccaucuccagccagaucgagcucgcggugcugcuguccaacgaggggaucaucaauucggaggacgagcaccuccuggcccuggagcggaagcucaagaagaugcugggccccuccgccguggagaucgggaacggcugcuucgagacgaagcacaagugcaaccagaccugccuggaccgcaucgccgcggggaccuucgacgccggcgaguucucgcuccccaccuucgacucccugaauaucaccgccgccagccugaacgacgacggccucgacaaccacacgauccugcuguacuacuccaccgccgcgucgucccuggccgucacccucaugaucgccaucuucgugguguacauggucucgcgggacaacguguccugcagcaucugccuguga

SEQ ID NO: 14964 - RNA, 1758 nt, Artificial Sequence; identical to SEQ ID NO: 14721
  derived and/or modified CDS sequence (AUadapt) from InfluenzaB__AGX18423__HA

SEQ ID NO: 14965 - RNA, 1755 nt, Artificial Sequence
  derived and/or modified CDS sequence (AUadapt) from InfluenzaB__AGX18424__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaucaagucccacuucgccaaccugaaggggacccggacgcgcggcaagcucugccccgacugccugaauugcaccgaccuggacguggcccucgggcggcccaugugcgugggcaccaccccguccgccaaggccagcauccugcacgagguccgccccgugacguccggcuguuuccccaucaugcacgaccggaccaagauccgccagcugcccaaccuccugcggggguacgagaacauccgccugagcacccagaaugugaucgacgcggagaaggcccucggcgggccguaccggcugggcaccuccgggagcugccccaacgccacguccaagagcggcuucuuugccaccauggcgugggccguccccaaggacaacaacaagaacgccaccaacccccugaccguggaggugccguacaucuguacggagggcgaggaccagaucaccgucuggggguuccacuccgacgacaagacccagaugaagaaccucuacggcgauagcaacccccagaaguucaccuccagcgccaacggggugacgacccacuacgugucccagaucggcggcuuucccgaccagaccgaggacgggggccugccccagagcgggcgcaucgucguggacuacauggugcagaagccgggcaagaccgggacgaucgucuaccagcggggcgugcugcucccccagaagguguggugugccuccggccgcagcaaggucaucaaggggucgcugccccugaucggcgaggcggacugccuccacgagaaguacgggggccugaacaaguccaagcccuauuacaccggggagcacgccaaggccaucggcaacugcccgaucugggugaagacgccccugaagcucgccaacggcaccaaguaccggccgcccgccaagcugcugaaggagcgcggguuuuucggcgcgaucgccggguuccucgagggcgggugggagggcaugaucgccggcuggcacggguacaccagccacggcgcccacggggucgccguggcggccgaucugaaguccacccaggaggccaucaacaagaucaccaagaaccugaacagccucuccgagcuggaggugaagaaccugcagcggcucagcggcgccauggacgagcugcauaacgagauccuggagcucgacgagaaggucgacgaccugcgcgccgacaccaucuccagccagaucgagcuggcggugcuccuguccaaugagggcaucaucaacagcgaggacgagcaccuccuggcccuggagcggaagcugaagaagaugcucgggcccuccgccguggacaucggcaacgggugcuuugagacgaagcacaagugcaaccagaccugccuggaccgcaucgccgcgggcaccuucaacgccggggaguuuagccugcccaccuucgacucccucaacaucaccgccgccagccugaacgaugacggccuggacaaccacacgauccugcucuacuacuccaccgccgcgagcucccuggccgucacccugaugcucgccaucuuuaucguguacauggugagccgggacaacgucuccugcagcaucugccuguga

SEQ ID NO: 14966 - RNA, 1758 nt, Artificial Sequence
  derived and/or modified CDS sequence (AUadapt) from InfluenzaB__AGX18435__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaauaucccguccgccgaggugucgauccugcacgagguccggcccgugacguccggcugcuuccccaucaugcacgaccgcaccaagauccggcagcugcccaaccuccugcgcggguacgagcacauccggcugucgacccacaacgugaucaacgccgagaaggcgccgggcgggcccuacaagaucggcaccuccgggagcugccccaacgucacgaacggcaacggcuucuuugccaccauggccugggccgugcccaagaacgacaacaacaagaccgcgaccaacucccucacgaucgaggugccguacaucugcaccgagggggaggaccagaucaccaucuggggcuuccacucggacaacgagauccagauggccaagcuguacggggacuccaagccccagaaguucaccucguccgccaacggcgucacgacccacuacgugagucagaucggcggguuccccaaccagaccgaggacggcgggcugccccaguccggccgcaucguggucgacuacauggugcagaaguccgggaagaccggcacgaucaccuaccagcggggcauccuccugccgcagaagguguggugcgccuccgggcgcucgaaggucaucaagggcucgcugccccucaucggggaggccgacugccugcacgagaaguacggcgggcugaacaaguccaagcccuacuacaccggcgagcacgcgaaggccaucggcaacugccccaucugggugaagaccccgcucaagcuggccaaugggacgaaguaccggccgcccgccaagcugcucaaggagcgcggcuucuucggggccaucgcgggcuuccuggagggcgggugggagggcaugaucgccggguggcacggcuacaccagccacggggcccacggcguggccgucgccgcggaccugaaguccacccaggaggccaucaacaagaucaccaagaaccucaacucgcuguccgagcuggaggugaagaaccuccagcggcugucgggcgccauggacgagcugcacaacgagauccucgagcuggacgagaaggucgaugaccugcgcgccgacacgaucuccagccagaucgagcucgccgugcugcuguccaacgaggggaucaucaacucggaggacgagcaccuccuggcgcuggagcggaagcucaagaagaugcugggccccuccgccguggagaucgggaacggcugcuucgagaccaagcacaagugcaaccagaccugccuggaccgcaucgccgccgggaccuucgacgcgggcgaguucucgcuccccaccuuugacucccugaacaucacggccgccagccugaacgacgacggccucgacaaccacaccauccugcuguacuacuccaccgccgccucgucccuggcggucacccucaugaucgccaucuucgugguguacauggucucgcgggacaacguguccugcagcaucugccuguga

SEQ ID NO: 14967 - RNA, 1758 nt, Artificial Sequence; identical to SEQ ID NO: 14378
  derived and/or modified CDS sequence (AUadapt) from InfluenzaB__AGX18446__HA

SEQ ID NO: 14968 - RNA, 1758 nt, Artificial Sequence; identical to SEQ ID NO: 14914
  derived and/or modified CDS sequence (AUadapt) from InfluenzaB__AGX18457__HA

SEQ ID NO: 14969 - RNA, 1758 nt, Artificial Sequence; identical to SEQ ID NO: 14721
  derived and/or modified CDS sequence (AUadapt) from InfluenzaB__AGX18468__HA

SEQ ID NO: 14970 - RNA, 1758 nt, Artificial Sequence; identical to SEQ ID NO: 14914
  derived and/or modified CDS sequence (AUadapt) from InfluenzaB__AGX18479__HA

SEQ ID NO: 14971 - RNA, 1758 nt, Artificial Sequence; identical to SEQ ID NO: 14254
  derived and/or modified CDS sequence (AUadapt) from InfluenzaB__AGX18490__HA

SEQ ID NO: 14972 - RNA, 1758 nt, Artificial Sequence
  derived and/or modified CDS sequence (AUadapt) from InfluenzaB__AGX18512__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccacuuugccaaccugaaggggacggagacccggggccgccucugccccaagugccugaacugcaccgaccuggacguggcccucgggcggcccaagugcaccggcaacaucccguccgcccgcgugucgauccugcaugagguccggcccgugacguccggcugcuuccccaucaugcacgaccgcaccaagauccggcagcugcccaaccuccugcgcggguacgagcacauccggcugagcacccacaacgugaucaaugccgagaacgcgccgggcgggcccuacaagaucggcaccuccgggucgugccccaacgucacgaacggcaacggcuucuucgccaccauggccugggccgugcccaagaacgauaacaacaagaccgcgaccaacucccucacgaucgaggugccguacaucugcaccgagggggaggaccagaucaccgucuggggcuuccacagcgacaacgagacccagauggccaagcuguauggggacuccaagccccagaaguucacgucguccgccaacggcgugaccacccacuacgugagccagaucggcggguuccccaaccagaccgaggacggcgggcugccccaguccggccgcaucgucguggauuacauggugcagaaguccgggaagacgggcaccaucaccuaccagcggggcauccuccugccgcagaaggucuggugcgccuccgggcgcagcaaggugaucaagggcucgcugccccucaucggggaggccgacugccugcacgagaaguacggcgggcugaacaaguccaagcccuauuacaccggcgagcacgcgaaggccaucggcaacugccccaucugggugaagacgccgcucaagcuggccaacgggaccaaguaccggccgcccgccaagcugcucaaggagcgcggcuucuucggggccaucgcgggcuuccuggagggcgggugggagggcaugaucgccggguggcacggcuauaccagccacggggcccacggcgucgccguggccgcggaccugaaguccacccaggaggccaucaacaagaucacgaagaaccucaacucgcuguccgagcuggaggucaagaaccuccagcggcugagcggcgccauggacgagcugcauaacgagauccucgagcuggacgagaagguggacgaccugcgcgccgacaccaucuccucgcagaucgagcucgccgugcugcuguccaacgaggggaucaucaacagcgaggacgagcaucuccuggcgcuggagcggaagcucaagaagaugcugggccccuccgccgucgagaucgggaacggcugcuucgagaccaagcacaagugcaaccagaccugccuggaccgcaucgccgccgggaccuucgacgcgggcgaguuuucgcuccccacguucgacucccugaacaucaccgccgccagccugaacgacgacggccucgacaaccauaccauccugcuguacuacuccaccgccgccucgucccuggcggugacgcucaugaucgccaucuucguggucuacauggugagccgggacaacguguccugcagcaucugccuguga

SEQ ID NO: 14973 - RNA, 1758 nt, Artificial Sequence; identical to SEQ ID NO: 14254
  derived and/or modified CDS sequence (AUadapt) from InfluenzaB__AGX18523__HA

SEQ ID NO: 14974 - RNA, 1758 nt, Artificial Sequence; identical to SEQ ID NO: 14254
  derived and/or modified CDS sequence (AUadapt) from InfluenzaB__AGX18534__HA

SEQ ID NO: 14975 - RNA, 1758 nt, Artificial Sequence; identical to SEQ ID NO: 14315
  derived and/or modified CDS sequence (AUadapt) from InfluenzaB__AGX18545__HA

SEQ ID NO: 14976 - RNA, 1758 nt, Artificial Sequence; identical to SEQ ID NO: 14254
  derived and/or modified CDS sequence (AUadapt) from InfluenzaB__AGX18556__HA

SEQ ID NO: 14977 - RNA, 1758 nt, Artificial Sequence; identical to SEQ ID NO: 14254
  derived and/or modified CDS sequence (AUadapt) from InfluenzaB__AGX18567__HA

SEQ ID NO: 14978 - RNA, 1758 nt, Artificial Sequence
  derived and/or modified CDS sequence (AUadapt) from InfluenzaB__AGX18578__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugucccaagugccugaacugcaccgaccuggacguggcccucgggcgccccaagugcaccggcaacaucccguccgcccgggugagcauccugcacgagguccgccccgugacguccggcugcuuccccaucaugcacgaucggaccaagauccgccagcugcccaaccuccugcggggguacgagcacauccgccugucgacccacaacgugaucaacgccgagaacgcgccgggcgggcccuacaagaucggcaccuccgggagcugccccaacgucacgaauggcaacggcuucuucgccaccauggccugggccgugcccaagaacgacaagaacaagaccgcgaccaacucccucacgaucgaggugccguacaucugcaccgagggggaggaccagaucaccgucuggggcuuccacagugacaacgagacccagauggccaagcuguacggggacuccaagccccagaaguucacgagcuccgccaacggcgugaccacccacuacgugucgcagaucggcggguuccccaaccagaccgaggauggcgggcugccccaguccggccggaucgucguggacuacauggugcagaaguccgggaagacgggcaccaucaccuaccagcgcggcauccuccugccgcagaaggucuggugcgccuccgggcggagcaaggugaucaagggcucgcugccccucaucggggaggccgacugccugcacgagaaguacggcgggcugaacaaguccaagcccuacuauaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccucgcacggggcccauggcgucgccguggccgcggaccugaaguccacccaggaggccaucaacaagaucacgaagaaccucaacagccuguccgagcuggaggucaagaaccuccagcgccugucgggcgccauggacgagcugcacaaggagauccucgagcuggacgagaagguggacgaccugcgggccgauaccaucuccagccagaucgagcucgccgugcugcuguccaacgaggggaucaucaacucggaggacgagcaccuccuggcgcuggagcgcaagcucaagaagaugcugggccccuccgccgucgagaucgggaacggcugcuucgagaccaagcacaagugcaaccagaccugucuggaccggaucgccgccgggaccuucgacgcgggcgaguucagccuccccacguucgacucccugaacaucaccgccgccucgcugaacgacgacggccucgauaaccacaccauccugcuguacuacuccaccgccgccagcucccuggcggugacgcucaugaucgccaucuucguggucuacauggugucgcgcgacaacguguccugcagcaucugccuguga

SEQ ID NO: 14979 - RNA, 1758 nt, Artificial Sequence
  derived and/or modified CDS sequence (AUadapt) from InfluenzaB__AGX18589__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugucccaagugccugaacugcaccgaccuggacguggcccucgggcgccccaagugcaccggcaacaucccguccgcccgggugagcauccugcacgagguccgccccgugacguccggcugcuuccccaucaugcacgaucggaccaagauccgccagcugcccaaccuccugcggggguacgagcacauccgccugucgacccacaacgugaucaacgccgagaacgcgccgggcgggcccuacaagaucggcaccuccgggagcugccccaacgucacgaauggcaacggcuucuucgccaccauggccugggccgugcccaagaacgacaacaacaagaccgcgaccaacucccucacgaucgaggugccguacaucugcaccgagggggaggaccagaucaccgucuggggcuuccacagugacaccgagacgcagauggccaagcuguacggggacuccaagccccagaaguucaccagcuccgccaacggcgugaccacccacuacgugucgcagaucggcgacuuccccaaccagacggaggaugggggccugccccaguccgggcggaucgucguggacuacauggugcagaaguccggcaagaccgggaccaucaccuaccagcgcggcauccuccugccgcagaaggucuggugcgccuccggccggagcaaggugaucaaggggucgcugccccucaucggcgaggccgacugccugcacgagaaguacgggggccugaacaaguccaagcccuacuauacgggggagcacgcgaaggccaucggcaacugccccaucugggugaagaccccgcucaagcuggccaacggcaccaaguaccgcccgcccgccaagcugcucaaggagcggggguucuucggcgccaucgcgggguuccuggagggcgggugggagggcaugaucgccggcuggcacggguacaccucgcacggcgcccauggggucgccguggccgcggaccugaaguccacgcaggaggccaucaacaagaucaccaagaaccucaacagccuguccgagcuggaggucaagaaccuccagcgccugucgggcgccauggacgagcugcacaacgagauccucgagcuggacgagaagguggacgaccugcgggccgauaccaucuccagccagaucgagcucgccgugcugcuguccaacgagggcaucaucaacucggaggacgagcaccuccuggcgcuggagcgcaagcucaagaagaugcuggggcccuccgccgucgagaucggcaacgggugcuucgagaccaagcacaagugcaaccagaccugucuggaccggaucgccgccggcacguucgacgcgggggaguucagccuccccaccuucgacucccugaacaucaccgccgccucgcugaacgacgacggccucgauaaccacaccauccugcuguacuacuccacggccgccagcucccuggcggugacccucaugaucgccaucuucguggucuacauggugucgcgcgacaacguguccugcagcaucugccuguga

SEQ ID NO: 14980 - RNA, 1758 nt, Artificial Sequence; identical to SEQ ID NO: 14254
  derived and/or modified CDS sequence (AUadapt) from InfluenzaB__AGX18600__HA

SEQ ID NO: 14981 - RNA, 1758 nt, Artificial Sequence; identical to SEQ ID NO: 14254
  derived and/or modified CDS sequence (AUadapt) from InfluenzaB__AGX18611__HA

SEQ ID NO: 14982 - RNA, 1758 nt, Artificial Sequence; identical to SEQ ID NO: 14254
  derived and/or modified CDS sequence (AUadapt) from InfluenzaB__AGX18622__HA

SEQ ID NO: 14983 - RNA, 1758 nt, Artificial Sequence; identical to SEQ ID NO: 14254
  derived and/or modified CDS sequence (AUadapt) from InfluenzaB__AGX18633__HA

SEQ ID NO: 14984 - RNA, 1758 nt, Artificial Sequence; identical to SEQ ID NO: 14254
  derived and/or modified CDS sequence (AUadapt) from InfluenzaB__AGX18644__HA

SEQ ID NO: 14985 - RNA, 1758 nt, Artificial Sequence; identical to SEQ ID NO: 14254
  derived and/or modified CDS sequence (AUadapt) from InfluenzaB__AGX18655__HA

SEQ ID NO: 14986 - RNA, 1758 nt, Artificial Sequence; identical to SEQ ID NO: 14254
  derived and/or modified CDS sequence (AUadapt) from InfluenzaB__AGX18666__HA

SEQ ID NO: 14987 - RNA, 1758 nt, Artificial Sequence; identical to SEQ ID NO: 14254
  derived and/or modified CDS sequence (AUadapt) from InfluenzaB__AGX18677__HA

SEQ ID NO: 14988 - RNA, 1758 nt, Artificial Sequence; identical to SEQ ID NO: 14254
  derived and/or modified CDS sequence (AUadapt) from InfluenzaB__AGX18688__HA

SEQ ID NO: 14989 - RNA, 1758 nt, Artificial Sequence; identical to SEQ ID NO: 14254
  derived and/or modified CDS sequence (AUadapt) from InfluenzaB__AGX18699__HA

SEQ ID NO: 14990 - RNA, 1758 nt, Artificial Sequence; identical to SEQ ID NO: 14254
  derived and/or modified CDS sequence (AUadapt) from InfluenzaB__AGX18710__HA

SEQ ID NO: 14991 - RNA, 1758 nt, Artificial Sequence; identical to SEQ ID NO: 14254
  derived and/or modified CDS sequence (AUadapt) from InfluenzaB__AGX18721__HA

SEQ ID NO: 14992 - RNA, 1758 nt, Artificial Sequence; identical to SEQ ID NO: 14254
  derived and/or modified CDS sequence (AUadapt) from InfluenzaB__AGX18732__HA

SEQ ID NO: 14993 - RNA, 1758 nt, Artificial Sequence
  derived and/or modified CDS sequence (AUadapt) from InfluenzaB__AGX18743__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugccccaagugucugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcauauccgccugucgaaccacaacgugaucaacgccgagaacgcgccgggcgggcccuacaagaucggcaccuccgggucgugccccaacgucaccaacggcaacggcuucuucgccacgauggccugggccgugcccaagaaugacaacaacaagaccgcgaccaacucccucaccaucgaggugccguacaucugcacggagggggaggaccagaucaccgucuggggcuuccacagcgacaacgagacccagauggccaagcuguacggggauuccaagccccagaaguucaccucguccgccaacggcgugacgacccacuacgugagccagaucggcggguuccccaaccagaccgaggacggcgggcugccccaguccggccggaucgucguggacuacauggugcagaaguccgggaagaccggcacgaucaccuaccagcgcggcauccuccugccgcagaaggucuggugcgccuccgggcggucgaaggugaucaagggcagucugccccucaucggggaggccgacugccugcacgagaaguacggcgggcugaacaaguccaagcccuacuacaccggcgagcacgcgaaggccaucggcaacugccccaucugggugaagaccccgcucaagcuggccaacgggacgaaguaccgcccgcccgccaagcugcucaaggagcggggcuucuucggggccaucgcgggcuuucuggagggcgggugggagggcaugaucgccggguggcacggcuacaccagccacggggcccacggcgucgccguggccgcggaccugaaguccacccaggaggccaucaacaagaucaccaagaaccucaacucgcuguccgagcuggaggucaagaaccuccagcgccugagcggcgccauggacgagcugcauaacgagauccucgagcuggacgagaagguggacgaccugcgggccgacacgaucuccucgcagaucgagcucgccgugcugcuguccaacgaggggaucaucaacucggaggacgagcaccuccuggcgcuggagcgcaagcucaagaagaugcugggccccuccgccgucgagaucgggaacggcugcuucgagaccaagcauaagugcaaccagaccugccuggaccggaucgccgccgggaccuucgacgcgggcgaguucagccuccccaccuucgacucccugaacaucacggccgccucgcugaacgacgauggccucgacaaccacaccauccugcuguacuacuccaccgccgccagcucccuggcggugacccucaugaucgccaucuucguggucuacauggugucgcgcgacaacguguccugcagcaucugccuguga

SEQ ID NO: 14994 - RNA, 1758 nt, Artificial Sequence; identical to SEQ ID NO: 14254
  derived and/or modified CDS sequence (AUadapt) from InfluenzaB__AGX18754__HA

SEQ ID NO: 14995 - RNA, 1758 nt, Artificial Sequence; identical to SEQ ID NO: 14254
  derived and/or modified CDS sequence (AUadapt) from InfluenzaB__AGX18765__HA

SEQ ID NO: 14996 - RNA, 1758 nt, Artificial Sequence; identical to SEQ ID NO: 14305
  derived and/or modified CDS sequence (AUadapt) from InfluenzaB__AGX18776__HA

SEQ ID NO: 14997 - RNA, 1758 nt, Artificial Sequence; identical to SEQ ID NO: 14254
  derived and/or modified CDS sequence (AUadapt) from InfluenzaB__AGX18787__HA

SEQ ID NO: 14998 - RNA, 1758 nt, Artificial Sequence; identical to SEQ ID NO: 14254
  derived and/or modified CDS sequence (AUadapt) from InfluenzaB__AGX18798__HA

SEQ ID NO: 14999 - RNA, 1758 nt, Artificial Sequence
  derived and/or modified CDS sequence (AUadapt) from InfluenzaB__AGX18809__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugucccaagugccugaacugcaccgaccuggacguggcccucgggcgccccaagugcaccggcaacaucccguccgcccgggugagcauccugcacgagguccgccccgugacguccggcugcuuccccaucaugcacgaucggaccaagauccgccagcugcccaaccuccugcggggguacgagcacauccgccugucgacccacaacgugaucaacgccgagaacgcgccgggcgggcccuacaagaucggcaccuccgggagcugccccaacgucacgaauggcaacggcuucuucgccaccauggccugggccgugcccaagaacgacaacaacaagaccgcgaccaacucccucacgaucgaggugccguacaucugcaccgagggggaggaccagaucaccgucuggggcuuccacagugacuccgagacccagauggccaagcuguacggggacagcaagccccagaaguucacguccucggccaacggcgugaccacccacuacgugucccagaucggcggguuccccaaccagaccgaggacggcgggcugccccagaguggccggaucgucguggacuacaugaugcagaaguccgggaagacgggcaccaucaccuaccagcgcggcauccuccugccgcagaagguguggugcgccucggggcggagcaaggucaucaagggcucccugccccucaucggggaggccgacugccugcacgagaaguacggcgggcugaacaagucgaagcccuauuacaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccauggcguggccgucgccgcggaccugaaguccacccaggaggccaucaacaagaucacgaagaaccucaacucccugagcgagcuggaggugaagaaccuccagcgccuguccggcgccauggacgagcugcacaacgagauccucgagcuggacgagaaggucgacgaccugcgggccgacaccaucaguucccagaucgagcucgccgugcugcugagcaacgaggggaucaucaacuccgaggacgagcaccuccuggcgcuggagcgcaagcucaagaagaugcugggccccucggccguggagaucgggaacggcugcuucgagaccaagcacaagugcaaccagaccugucuggaccggaucgccgccgggaccuucgacgcgggcgaguucucccuccccacguucgacagccugaacaucaccgccgccucccugaacgacgacggccucgacaaucacaccauccugcuguacuacucgaccgccgccuccagccuggcggucacgcucaugaucgccaucuucgugguguacauggucucccgcgacaacgugucgugcagcaucugccuguga

SEQ ID NO: 15000 - RNA, 1758 nt, Artificial Sequence; identical to SEQ ID NO: 14917
  derived and/or modified CDS sequence (AUadapt) from InfluenzaB__AGX18820__HA

SEQ ID NO: 15001 - RNA, 1758 nt, Artificial Sequence; identical to SEQ ID NO: 14254
  derived and/or modified CDS sequence (AUadapt) from InfluenzaB__AGX18831__HA

SEQ ID NO: 15002 - RNA, 1758 nt, Artificial Sequence; identical to SEQ ID NO: 14254
  derived and/or modified CDS sequence (AUadapt) from InfluenzaB__AGX18842__HA

SEQ ID NO: 15003 - RNA, 1758 nt, Artificial Sequence; identical to SEQ ID NO: 14322
  derived and/or modified CDS sequence (AUadapt) from InfluenzaB__AGX18853__HA

SEQ ID NO: 15004 - RNA, 1758 nt, Artificial Sequence
  derived and/or modified CDS sequence (AUadapt) from InfluenzaB__AGX18864__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucguacuucgccaaccugaaggggacggagacccggggcaagcucugccccaagugucugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcauauccgccugucgaaccacaacgugaucaacgccgagaacgcgccgggcgggcccuacaagaucggcaccuccgggagcugccccaacgucaccaacggcaacggcuucuucgccacgauggccugggccgugcccaagaaugacaacaacaagaccgcgaccaacucccucaccaucgaggugccguacaucugcacggagggggaggaccagaucaccgucuggggcuuccacucggacaacgaggcccagauggccaagcuguacggggauuccaagccccagaaguucaccagcuccgccaacggcgugaccacgcacuacgugucgcagaucggcggguuccccaaccagaccgaggacggcgggcugccccaguccggccggaucgucguggacuacauggugcagaaguccgggaagaccggcaccaucacguaccagcgcggcauccuccugccgcagaaggucuggugcgccuccgggcggagcaaggugaucaagggcagucugccccucaucggggaggcggacugccugcacgagaaguacggcgggcugaacaaguccaagcccuacuacaccggcgagcacgccaaggccaucggcaacugccccaucugggugaagaccccgcucaagcuggccaacgggaccaaguaccgcccgcccgccaagcugcucaaggagcggggcuucuucggggcgaucgccggcuuucuggagggcgggugggagggcaugaucgccggguggcacggcuacacgucgcacggggcccacggcgucgccguggcggccgaccugaaguccacccaggaggccaucaacaagaucaccaagaaccucaacagccuguccgagcuggaggucaagaaccuccagcgccugucgggcgccauggacgagcugcauaacgagauccucgagcuggacgagaagguggacgaccugcgggccgacaccaucuccagccagaucgagcucgcggugcugcuguccaacgaggggaucaucaacucggaggacgagcaccuccuggcccuggagcgcaagcucaagaagaugcugggccccuccgccgucgagaucgggaacggcugcuucgagacgaagcauaagugcaaccagaccugccuggaccggaucgccgcggggaccuucgacgccggcgaguucagccuccccaccuucgacucccugaacaucaccgccgccucgcugaacgacgauggccucgacaaccacacgauccugcuguacuacuccaccgccgcgagcucccuggccgugacccucaugaucgccaucuucguggucuacauggugucgcgcgacaacguguccugcagcaucugccuguga

SEQ ID NO: 15005 - RNA, 1758 nt, Artificial Sequence
  derived and/or modified CDS sequence (AUadapt) from InfluenzaB__AGX18875__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugccccaagugucugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcauauccgccugucgacccacaacgugaucaacgccgagaacgcgccgggcgggcccuacaagaucggcaccuccgggagcugccccaacgucacgaaccggaacggcuucuucgccaccauggccugggccgugcccaagaaugacaacaacaagaccgcgaccaacucccucacgaucgaggugccguacaucugcaccgagggcgaggaccagaucaccgucuggggguuccacucggacaacgagauccagauggccaagcuguacggcgacuccaagccccagaaguuuaccagcuccgccaacggggugacgacccacuacgugucgcagaucggcggcuuccccaaccagaccgaggacgggggccugccccaguccgggcgcaucgucguggacuacauggugcagaaguccggcaagaccgggacgaucaccuaccagcggggcauccuccugccgcagaaggucuggugcgccuccggccgcagcaaggugaucaaggggucgcugccccucaucggcgaggccgauugccugcacgagaaguacgggggccugaacaaguccaagcccuacuacaccggggagcacgcgaaggccaucggcaacugccccaucugggugaagaccccgcucaagcuggccaacggcacgaaguaccggccgcccgccaagcugcucaaggagcgcggguucuucggcgccaucgcgggguuucuggagggcgggugggagggcaugaucgccggcuggcacggguacaccucgcacggcgcccacggggucgccguggccgcggaccugaaguccacccaggaggccaucaacaagaucaccaagaaccucaacagccuguccgagcuggaggucaagaaccuccagcggcugucgggcgccaucgacgagcugcacaaugagauccucgagcuggacgagaagguggacgaccugcgcgccgacacgaucuccagccagaucgagcucgccgugcugcuguccaacgagggcaucaucaacucggaggacgagcaccuccuggcgcuggagcggaagcucaagaagaugcuggggcccuccgccgucgagaucggcaacgggugcuucgagaccaagcauaagugcaaccagaccugccuggaccgcaucgccgccggcaccuucgacgcgggggaguucagccuccccaccuucgacucccugaacaucacggccgccucgcugaacgacgauggccucgacaaccacaccauccugcuguacuacuccaccgccgccagcucccuggcggugacccucaugaucgccaucuucguggucuacauggugucgcgggacaacguguccugcagcaucugccuguga

SEQ ID NO: 15006 - RNA, 1758 nt, Artificial Sequence
  derived and/or modified CDS sequence (AUadapt) from InfluenzaB__AGX18886__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugccccaagugccugaacuguaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcacauccgccugucgacccacaaugugaucaacgccgagaacgcgccgggcgggcccuacaagaucggcaccuccgggucgugccccaacgucacgaacggcaacggcuucuucgccaccauggccugggccgugcccaagaacgacaacaacaagaccgcgaccaacucccucacgaucgaggugccguauaucugcaccgagggggaggaccagaucaccgucuggggcuuccacagcgacaacgagauccagauggccaagcuguacggggacuccaagccccagaaguucaccucguccgccaacggcgugacgacccacuacgugagccagaucggcggguuucccaaccagaccgaggacggcgggcugccccaguccggccggaucgucguggacuacauggugcagaaguccgggaagaccggcacgaucaccuaccagcgcggcauccuccugccgcagaaggucuggugcgccuccgggcggucgaaggugaucaagggcucgcugccccucaucggggaggccgacugccugcacgagaaguacggcgggcugaacaaguccaagcccuacuacaccggcgagcacgcgaaggccaucggcaauugccccaucugggugaagaccccgcucaagcuggccaacgggacgaaguaccgcccgcccgccaagcugcucaaggagcggggcuucuucggggccaucgcgggcuuccuggagggcgggugggagggcaugaucgccggguggcacggcuacaccagccacggggcccacggcgucgccguggccgcggaccugaaguccacccaggaggccaucaacaagaucaccaagaaccucaacagucuguccgagcuggaggucaagaaccuccagcgccugagcggcgccauggacgagcugcacaacgagauccucgagcuggacgagaagguggacgaccugcgggccgacacgaucuccucgcagaucgagcucgccgugcugcuguccaacgaggggaucaucaacucggaggacgagcaccuccuggcgcuggagcgcaagcucaagaagaugcugggccccuccgccgucgagaucgggaauggcugcuucgagaccaagcacaagugcaaccagaccugccuggaccggaucgccgccgggaccuucgacgcgggcgaguucagccuccccaccuucgacucccugaacaucacggccgccucgcugaaugacaacggccucgacaaccacaccauccugcuguacuacuccaccgccgccagcucccuggcggugacccucaucaucgccaucuucguggucuacauggugucgcgcgacaacguguccugcagcaucugccuguga

SEQ ID NO: 15007 - RNA, 1758 nt, Artificial Sequence; identical to SEQ ID NO: 14727
  derived and/or modified CDS sequence (AUadapt) from InfluenzaB__AGX18897__HA

SEQ ID NO: 15008 - RNA, 1758 nt, Artificial Sequence; identical to SEQ ID NO: 14254
  derived and/or modified CDS sequence (AUadapt) from InfluenzaB__AGX18908__HA

SEQ ID NO: 15009 - RNA, 1758 nt, Artificial Sequence; identical to SEQ ID NO: 14254
  derived and/or modified CDS sequence (AUadapt) from InfluenzaB__AGX18919__HA

SEQ ID NO: 15010 - RNA, 1758 nt, Artificial Sequence
  derived and/or modified CDS sequence (AUadapt) from InfluenzaB__AGX18930__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugccccaagugucugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcauauccgccugucgacccacaacgugaucaacgccgagaacgcgccgggcgggcccuacaagaucggcaccuccgggucgugccccaacgucacgaacggcaacggcuucuucgccaccauggccugggccgugcccaagaaugacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguuuacgucguccgccaacggcgugaccacccacuacgugagccagaucggcggguuccccaaccagaccgaggacggcgggcugccccaguccggccggaucgucguggacuacauggugcagaaguccgggaagacgggcaccaucaccuaccagcgcggcauccuccugccgcagaaggucuggugcgccuccgggcggucgaaggugaucaagggcucgcugccccucaucggggaggccgauugccugcacgagaaguacggcgggcugaacaaguccaagcccuacuacaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuucuggagggcgggugggagggcaugaucgccggguggcacggcuacaccagccacggggcccacggcgucgccguggccgcggaccugaaguccacccaggaggccaucaacaagaucacgaagaaccucaacucgcuguccgagcuggaggucaagaaccuccagcgccugagcggcgccauggacgagcugcacaaugagauccucgagcuggacgagaagguggacgaccugcgggccgacaccaucuccucgcagaucgagcucgccgugcugcuguccaacgaggggaucaucaacucggaggacgagcaccuccuggcgcuggagcgcaagcucaagaagaugcugggccccuccgccgucgagaucgggaacggcugcuucgagaccaagcauaagugcaaccagaccugcaucgaccggaucgccgccgggaccuucgacgcgggcgaguucagccugcccacguucgacucccucaacaucaccgccgccucgcugaacgacgauggccuggacaaccacaccauccuccuguacuacuccaccgccgccagcucccuggcggugacgcugaugaucgccaucuucguggucuacauggugucgcgcgacaacguguccugcagcaucugccucuga

SEQ ID NO: 15011 - RNA, 1758 nt, Artificial Sequence; identical to SEQ ID NO: 14254
  derived and/or modified CDS sequence (AUadapt) from InfluenzaB__AGX18941__HA

SEQ ID NO: 15012 - RNA, 1758 nt, Artificial Sequence; identical to SEQ ID NO: 14254
  derived and/or modified CDS sequence (AUadapt) from InfluenzaB__AGX18952__HA

SEQ ID NO: 15013 - RNA, 1758 nt, Artificial Sequence; identical to SEQ ID NO: 14254
  derived and/or modified CDS sequence (AUadapt) from InfluenzaB__AGX18963__HA

SEQ ID NO: 15014 - RNA, 1758 nt, Artificial Sequence
  derived and/or modified CDS sequence (AUadapt) from InfluenzaB__AGX18974__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugccccaagugccugaacuguaccgaccuggacguggcccucgggcgccccaagugcaccggcaacaucccguccgcccgggugucgauccugcacgagguccgccccgugacguccggcugcuuccccaucaugcacgaccggaccaagauccgccagcugcccaaccuccugcggggguacgagcacauccgccugagcacccacaaugugaucaacgccgagaacgcgccgggcgggcccuacaagaucggcaccuccgggucgugccccaacgucacgaacggcaacggcuucuucgccaccauggccugggccgugcccaagaacgacaacaacaagaccgcgaccaacucccucacgaucgaggugccguauaucugcaccgagggggaggaccagaucaccgucuggggcuuccacucggacaacgagacccagauggccaagcuguacggggacuccaagccccagaaguucacgagcuccgccaacggcgugaccacccacuacgugucgcagaucggcggguuucccaaccagaccgaggacggcgggcugccccaguccggccggaucgucguggacuacauggugcagaaguccgggaagacgggcaccaucaccuaccagcgcggcauccuccugccgcagaaggucuggugcgccuccgggcggagcaaggugaucaagggcucgcugccccucaucggggaggccgacugccugcacgagaaguacggcgggcugaacaaguccaagcccuacuacaccggcgagcacgcgaaggccaucggcaauugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccucgcacggggcccacggcgucgccguggccgcggaccugaaguccacccaggaggccaucaacaagaucacgaagaaccucaacagucuguccgagcuggaggucaagaaccuccagcgccugucgggcgccauggacgagcugcacaacgagauccucgagcuggacgagaagguggacgaccugcgggccgacaccaucuccucgcagaucgagcucgccgugcugcuguccaacgaggggaucaucaacagcgaggacgagcaccuccuggcgcuggagaagaagcucaagaagaugcugggccccuccgccgucgagaucgggaauggcugcuucgagaccaagcacaagugcaaccagaccugccuggaccgcaucgccgccgggaccuucgacgcgggcgaguucucgcuccccacguucgacucccugaacaucaccgccgccucgcugaaugacgacggccucgacaaccacaccauccugcuguacuacuccaccgccgccagcucccuggcggugacgcucaugaucgccaucuucguggucuacauggugucgcgggacaacguguccugcagcaucugccuguga

SEQ ID NO: 15015 - RNA, 1758 nt, Artificial Sequence; identical to SEQ ID NO: 14254
  derived and/or modified CDS sequence (AUadapt) from InfluenzaB__AGX18985__HA

SEQ ID NO: 15016 - RNA, 1758 nt, Artificial Sequence
  derived and/or modified CDS sequence (AUadapt) from InfluenzaB__AGX18996__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccacuuugccaaccugaaggggacggagacccggggcaagcucugccccaagugccugaacugcaccgaccuggacguggcccucgggcgccccaagugcaccggcaacacgccguccgcccgggugucgauccugcaugagguccgccccgugaccuccggcugcuuccccaucaugcacgaccggaccaagauccgccagcugcccaaccuccugcggggguacgagcacauccgccugagcacccacaacgugaucaaugccgagaacgcgccgggcgggcccuacaagaucggcacguccgggucgugccccaacgucaccaacggcaacggcuucuucgccaccauggccugggccgugcccaagaacgauaacaacaagaccgcgacgaacucccucaccaucgaggugccguacaucugcaccgagggggaggaccagaucaccgucuggggcuuccacagcgacaacgggacgcagauggccaagcuguauggcgacuccaagccccagaaguucaccucguccgccaacggcgugaccacccacuacgugagccagaucgggggcuuccccaaccagacggaggacgggggccugccccaguccgggcggaucgucguggauuacauggugcagaaguccggcaagaccggcaccaucaccuaccagcgcgggauccuccugccgcagaaggucuggugcgccuccggccggucgaaggugaucaaggggagccugccccucaucggcgaggccgacugccugcacgagaaguacgggggccugaacaaguccaagcccuauuacacgggcgagcacgcgaaggccaucgggaacugccccaucugggugaagaccccgcucaagcuggccaacggcaccaaguaccgcccgcccgccaagcugcucaaggagcggggguucuucggcgccaucgcgggguuccuggagggcggcugggaggggaugaucgccggcuggcacggguauaccucgcacggcgcccacggcgucgccguggccgcggaccugaaguccacgcaggaggccaucaacaagaucaccaagaaccucaacagccuguccgagcuggaggucaagaaccuccagcgccugucgggggccauggacgagcugcauaacgagauccucgagcuggacgagaagguggacgaccugcgggccgacaccaucuccagccagaucgagcucgccgugcugcuguccaacgagggcaucaucaacucggaggacgagcaucuccuggcgcuggagcgcaagcucaagaagaugcuggggcccuccgccgucgagaucggcaacgggugcuucgagaccaagcacaagugcaaccagaccugccuggaccggaucgccgccggcacguucgacgcgggcgaguuuagccuccccaccuucgacucccugaacaucaccgccgccucgcugaacgacgacgggcucgacaaccauaccauccugcuguacuacuccacggccgccagcucccuggcggugacccucaugaucgccaucuucguggucuacauggugucgcgcgacaacguguccugcagcaucugccuguga

SEQ ID NO: 15017 - RNA, 1758 nt, Artificial Sequence; identical to SEQ ID NO: 14254
  derived and/or modified CDS sequence (AUadapt) from InfluenzaB__AGX19007__HA

SEQ ID NO: 15018 - RNA, 1758 nt, Artificial Sequence
  derived and/or modified CDS sequence (AUadapt) from InfluenzaB__AGX19018__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccacuucgccaaccugaaggggacggagacccggggcaagcucugucccaagugccugaacugcaccgaccuggacguggcccucgggcgccccaagugcaccggcaacaucccguccgcccgggugucgauccugcacgagguccgccccgugacguccggcugcuuccccaucaugcacgaucggaccaagauccgccagcugcccaacuuccuccggggguacgagcacauccgccugagcacccacaacgugaucaacgccgagaacgcgccgggcgggcccuacaagaucggcaccuccgggucgugccccaacgucacgaauggcaacggcuucuucgccaccauggccugggccgugcccaagaacgacaacaacaagaccgcgaccaacucccugacgaucgaggugccguacaucugcaccgagggggaggaccagaucaccgucuggggcuuccauagcgacuccgagacccagauggccaagcucuacggggacucgaagccccagaaguucacguccagcgccaacggcgugaccacccacuacgugucccagaucggcggguuccccaaccagaccgaggauggcgggcugccccagucgggccggaucgucguggacuacauggugcagaaguccgggaagacgggcaccaucaccuaccagcgcggcauccugcucccgcagaaggucuggugcgccagcgggcggucgaaggugaucaagggcucccugccccugaucggggaggccgacugccuccacgagaaguacggcgggcugaacaagagcaagcccuauuacaccggcgagcacgcgaaggccaucggcaacugccccaucugggugaagacgccgcugaagcucgccaacgggaccaaguaccgcccgcccgccaagcugcugaaggagcggggcuucuucggggccaucgcgggcuuccucgagggcgggugggagggcaugaucgccggguggcacggcuacaccucccacggggcccauggcgucgccguggccgcggaccugaaguccacccaggaggccaucaacaagaucacgaagaaccugaacucccucucggagcuggaggucaagaaccugcagcgccucuccggcgccauggacgagcugcacaacgagauccuggagcucgacgagaagguggacgaccugcgggccgauaccaucagcucccagaucgagcuggccgugcuccugucgaacgaggggaucaucaacuccgaggacgagcaccuccuggcgcuggagcgcaagcugaagaagaugcucggccccagcgccgucgagaucgggaacggcugcuucgagaccaagcacaagugcaaccagaccugucuggaccggaucgccgccgggaccuucgacgcgggcgaguucucccugcccacguucgacucgcucaacaucaccgccgccucccugaacgacgacggccuggacaaucacaccauccuccuguacuacagcaccgccgccuccucgcuggcggugacgcugaugaucgccaucuucguggucuacauggugucccgcgacaacgugagcugcagcaucugccucuga

SEQ ID NO: 15019 - RNA, 1758 nt, Artificial Sequence; identical to SEQ ID NO: 14917
  derived and/or modified CDS sequence (AUadapt) from InfluenzaB__AGX19029__HA

SEQ ID NO: 15020 - RNA, 1758 nt, Artificial Sequence; identical to SEQ ID NO: 14254
  derived and/or modified CDS sequence (AUadapt) from InfluenzaB__AGX19040__HA

SEQ ID NO: 15021 - RNA, 1758 nt, Artificial Sequence
  derived and/or modified CDS sequence (AUadapt) from InfluenzaB__AGX19051__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugucccaagugccugaacugcaccgaccuggacguggcccucgggcgccccaagugcaccggcaacaucccguccgcccgggugagcauccugcacgagguccgccccgugacguccggcugcuuccccaucaugcacgaucggaccaagauccgccagcugcccaaccuccugcggggguacgagcacauccgccugucgacccacaacgugaucaacaccgagaacgccccgggcgggcccuacaagaucggcacguccgggagcugccccaacgucaccaauggcaacggcuucuucgcgaccauggccugggccgugcccaagaacgacaacaacaagaccgccacgaacucccucaccaucgaggugccguacaucugcaccgagggggaggaccagaucaccgucuggggcuuccacagugacuccgagacgcagauggcgaagcuguacggggacagcaagccccagaaguucaccuccucggccaacggcgugaccacccacuacgugucccagaucggcggguuccccaaccagacggaggacggcgggcugccccagaguggccggaucgucguggacuacauggugcagaaguccgggaagaccggcaccaucaccuaccagcgcggcauccuccugccgcagaaggucuggugcgccucggggcggagcaaggugaucaagggcucccugccccucaucggggaggccgacugccugcacgagaaguacggcgggcugaacaagucgaagcccuauuacacgggcgagcacgccaaggcgaucggcaacugccccaucugggugaagaccccgcucaagcuggccaacgggaccaaguaccgcccgcccgccaagcugcucaaggagcggggcuucuucggggccaucgccggcuuccuggagggcgggugggagggcaugaucgcgggguggcacggcuacaccucccacggggcccauggcgucgccguggccgccgaccugaaguccacgcaggaggcgaucaacaagaucaccaagaaccucaacucccugagcgagcuggaggucaagaaccuccagcgccuguccggcgccauggacgagcugcacaacgagauccucgagcuggacgagaagguggacgaccugcgggccgacaccaucaguucccagaucgagcucgccgugcugcugagcaacgaggggaucaucaacuccgaggacgagcaccuccuggcccuggagcgcaagcucaagaagaugcugggccccucggcggucgagaucgggaacggcugcuucgagaccaagcacaagugcaaccagaccugucuggaccggaucgccgccgggacguucgacgccggcgaguucucccuccccaccuucgacagccugaacaucaccgcggccucccugaacgacgacggccucgacaaucacaccauccugcuguacuacucgacggccgccuccagccuggccgugacccucaugaucgcgaucuucguggucuacauggugucccgcgacaacgugucgugcagcaucugccuguga

SEQ ID NO: 15022 - RNA, 1758 nt, Artificial Sequence
  derived and/or modified CDS sequence (AUadapt) from InfluenzaB__AGX19062__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugccccaagugucugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcauauccgccugucgacccacaacgugaucaacgccgagaacgcgccgggcgggcccuacaagaucggcaccuccgggagcugccccaacgucacgaacggcaacggcuucuucgccaccauggccugggccgugcccaagaacgauaacaacaagaccgcgaccaacucccucacgaucgaggugccguacaucugcaccgagggggaggaccagaucaccgucuggggcuuccacucggacaacgagacccagauggccaagcuguacggggacuccaagccccagaaguuuacgagcuccgccaacggcgugaccacccacuacgugucgcagaucggcggguuccccaaccagaccgaggacggcgggcugccccaguccggccggaucgucguggacuacauggugcagaaguccgggaagacgggcaccaucaccuaccagcgcggcauccuccugccgcagaaggucuggugcgccuccgggcggagcaaggugaucaagggcucgcugccccucaucggggaggccgauugccugcacgagaaguacggcgggcugaacaaguccaagcccuacuacaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcauggcuacaccucgcacggggcccacggcgucgccguggccgcggaccugaaguccacccaggaggccaucaacaagaucacgaagaacuucaacagccucuccgagcuggaggucaagaaccugcagcgccucucgggcgccauggacgagcugcauaacgagauccuggagcucgacgagaagguggacgaccugcgggccgacaccaucuccagccagaucgagcuggccgugcuccuguccaacgaggggaucaucaacucggaggacgagcaccuccuggcgcuggagcgcaagcugaagaagaugcucggccccuccgccgucgagaucgggaacggcugcuucgagaccaagcauaagugcaaccagaccugccuggaccggaucgccgccgggaccuucgacgcgggcgaguucagccugcccacguucgacucccucaacaucaccgccgccucgcugaacgacgauggccuggacaaccacaccauccuccuguacuacuccaccgccgccagcucccuggcggugacgcugaugaucgccaucuucguggucuacauggugucgcgcgacaacguguccugcagcaucugccucuga

SEQ ID NO: 15023 - RNA, 1758 nt, Artificial Sequence; identical to SEQ ID NO: 14254
  derived and/or modified CDS sequence (AUadapt) from InfluenzaB__AGX19073__HA

SEQ ID NO: 15024 - RNA, 1758 nt, Artificial Sequence
  derived and/or modified CDS sequence (AUadapt) from InfluenzaB__AGX19084__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagagccacuucgccaaccugaaggggacggagacccggggcaagcucugccccaagugccugaacugcaccgaccuggauguggcccucgggcgccccaagugcaccggcaacaucccguccgcccgggugucgauccugcacgagguccgccccgugacguccggcugcuuccccaucaugcacgaccggaccaagauccgccagcugcccaaccuccugcggggguacgagcacaucaagcugucgacccacaacgugaucaacgccgagaacgcgccgggcgggcccuacaagaucggcaccuccgggaguugccccaacgucacgaacggcaacggcuucuucgccaccauggccugggccgugcccaagaacgacaacaacaagaccgcgaccaacucccucacgaucgaggugccguacaucugcaccgagggggaggaccagaucaccgucuggggcuuccacucggacaaugagaaccagauggccaagcuguacggggacuccaagccccagaaguucaccucguccgccaacggcgugacgacccacuacgugagccagaucggcggguuccccaaccagaccgaggacggcgggcugccccaguccggccgcaucgucguggacuacauggugcagaaguccgggaagaccggcacgaucaccuaccagcggggcauccuccugccgcagaaggucuggugcgccuccgggcgcucgaaggugaucaagggcagucugccccucaucggggaggccgacugccugcacgagaaguacggcgggcugaacaaguccaagcccuacuacaccggcgagcacgcgaaggccaucggcaacugccccaucugggugaagaccccgcucaagcuggccaacgggacgaaguaccggccgcccgccaagcugcucaaggagcgcggcuucuucggggccaucgcgggcuuccuggagggcgggugggagggcaugaucgccggguggcacggcuacaccagucacggggcccacggcgucgccguggccgcggaccugaaguccacccaggaggccaucaacaagaucaccaagaaccucaacucgcuguccgagcuggaggucaagaaccuccagcggcugucgggcgccauggacgagcugcacaacgagauccucgagcuggacgagaagguggacgaccugcgcgccgacacgaucuccagccagaucgagcucgccgugcugcuguccaacgaggggaucaucaauucggaggacgagcaccuccuggcgcuggagcggaagcucaagaagaugcugggccccuccgccgucgagaucgggaacggcugcuucgagaccaagcacaagugcaaccagaccugccuggaccgcaucgccgccgggaccuucgacgcgggcgaguucucgcuccccaccuucgacucccugaauaucacggccgccagccugaacgacgacggccucgacaaccacaccauccugcuguacuacuccaccgccgccucgucccuggcggugacccucaugaucgccaucuucguggucuacauggugucgcgggacaacguguccugcagcaucugccuguga

SEQ ID NO: 15025 - RNA, 1758 nt, Artificial Sequence; identical to SEQ ID NO: 14254
  derived and/or modified CDS sequence (AUadapt) from InfluenzaB__AGX19095__HA

SEQ ID NO: 15026 - RNA, 1758 nt, Artificial Sequence; identical to SEQ ID NO: 14917
  derived and/or modified CDS sequence (AUadapt) from InfluenzaB__AGX19106__HA

SEQ ID NO: 15027 - RNA, 1758 nt, Artificial Sequence; identical to SEQ ID NO: 14254
  derived and/or modified CDS sequence (AUadapt) from InfluenzaB__AGX19117__HA

SEQ ID NO: 15028 - RNA, 1758 nt, Artificial Sequence
  derived and/or modified CDS sequence (AUadapt) from InfluenzaB__AGX19128__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccacuuugccaaccugaaggggacggagacccggggcaagcucugccccaagugccugaacugcaccgaccuggacguggcccucgggcgccccaagugcaccggcaacacgccguccgcccgggugucgauccugcaugagguccgccccgugaccuccggcugcuuccccaucaugcacgaccggaccaagauccgccagcugcccaaccuccugcggggguacgagcacauccgccugagcacccacaacgugaucaaugccgagaacgcgccgggcgggcccuacaagaucggcacguccgggucgugccccaacgucaccaacggcaacggcuucuucgccaccauggccugggccgugcccaagaacgauaacaacaagaccgcgacgaacucccucaccaucgaggugccguacaucugcaccgagggggaggaccagaucaccgucuggggcuuccacagcgacuccgagacgcagauggccaagcuguacggggauucgaagccccagaaguucaccuccagcgccaacggcgugaccacccacuacgugucccagaucggcggguuccccaaccagacggaggacggcgggcugccccagucgggccggaucgucguggauuacauggugcagaaguccgggaagaccggcaccaucaccuaccagcgcggcauccuccugccgcagaaggucuggugcgccagcgggcggucgaaggugaucaagggcucccugccccucaucggggaggccgacugccugcacgagaaguacggcgggcugaacaagaguaagcccuacuacacgggcgagcacgcgaaggccaucggcaacugccccaucugggugaagaccccgcucaagcuggccaacgggaccaaguaccgcccgcccgccaagcugcucaaggagcggggcuucuucggggccaucgcgggcuuccuggagggcgggugggagggcaugaucgccggguggcauggcuacaccucccacggggcccacggcgucgccguggccgcggaccugaaguccacgcaggaggccaucaacaagaucaccaagaaccucaacucccugucggagcuggaggucaagaaccuccagcgccuguccggcgccauggacgagcugcacaaugagauccucgagcuggacgagaagguggacgaccugcgggccgacaccaucagcucccagaucgagcucgccgugcugcugucgaacgaggggaucaucaacuccgaggacgagcaccuccuggcgcuggagcgcaagcucaagaagaugcugggccccagugccgucgagaucgggaacggcugcuucgagaccaagcacaagugcaaccagaccugccuggaccggaucgccgccgggacguucgacgcgggcgaguuuucccuccccaccuucgacucgcugaacaucaccgccgccucccugaacgacgacggccucgacaaccacaccauccugcuguauuacagcacggccgccuccucgcuggcggugacccucaugaucgccaucuucguggucuacauggugucccgcgacaacgugagcugcagcaucugccuguga

SEQ ID NO: 15029 - RNA, 1758 nt, Artificial Sequence; identical to SEQ ID NO: 14254
  derived and/or modified CDS sequence (AUadapt) from InfluenzaB__AGX19139__HA

SEQ ID NO: 15030 - RNA, 1758 nt, Artificial Sequence; identical to SEQ ID NO: 14727
  derived and/or modified CDS sequence (AUadapt) from InfluenzaB__AGX19150__HA

SEQ ID NO: 15031 - RNA, 1758 nt, Artificial Sequence; identical to SEQ ID NO: 14254
  derived and/or modified CDS sequence (AUadapt) from InfluenzaB__AGX19161__HA

SEQ ID NO: 15032 - RNA, 1758 nt, Artificial Sequence; identical to SEQ ID NO: 14727
  derived and/or modified CDS sequence (AUadapt) from InfluenzaB__AGX19172__HA

SEQ ID NO: 15033 - RNA, 1758 nt, Artificial Sequence
  derived and/or modified CDS sequence (AUadapt) from InfluenzaB__AGX19183__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccacuucgccaaucugaaggggacggagacccggggcaagcucugccccaagugccugaacugcaccgaccuggacguggcccucgggcgccccaagugcaccggcaacaucccguccgcccgggugucgauccugcacgagguccgccccgugacguccggcugcuuucccaucaugcacgaccggaccaagauccgccagcugcccaaccuccugcggggguacgagcacauccgccugagcacccacaacgugaucaacgccgagaacgcgccgggcgggcccuacaagaucggcaccuccgggaguugccccaacgucacgaacggcaacggcuucuucgccaccauggccugggccgugcccaagaacgacaacaacaagaccgcgaccaacucccucacgaucgaggugccguauaucugcaccgagggggaggaccagaucaccgucuggggcuuccacagcgacaccgagacgcagauggccaagcuguacggggacuccaagccccagaaguucaccucguccgccaacggcgugaccacccauuacgugagccagaucggcggguuccccaaccagacggaggacggcgggcugccccaguccggccggaucgucguggacuacauggugcagaaguccgggaagaccggcaccaucaccuaccagcgcggcauccuccugccgcagaaggucuggugcgccuccgggcggucgaaggugaucaagggcagccugccccucaucggggaggccgauugccugcacgagaaguacggcgggcugaacaaguccaagcccuacuacacgggcgagcacgcgaaggccaucggcaacugccccaucugggugaagaccccgcucaagcuggccaacgggaccaaguaccgcccgcccgccaagcugcucaaggagcggggcuuuuucggggccaucgcgggcuuccuggagggcgggugggagggcaugaucgccggguggcacggcuacaccucgcacggggcccacggcgucgccguggccgcggaccugaaguccacgcaggaggccaucaacaagaucaccaagaaccucaacagucuguccgagcuggaggucaagaaccuccagcgccugucgggcgccauggacgagcugcacaacgagauccucgagcuggacgagaagguggacgaccugcgggccgacaccaucuccagccagaucgagcucgccgugcugcuguccaacgaggggaucaucaauucggaggacgagcaccuccuggcgcuggagcgcaagcucaagaagaugcugggccccuccgccgucgagaucgggaacggcugcuucgagaccaagcacaagugcaaccagaccugccuggaccggaucgccgccgggacguuugacgcgggcgaguucagccuccccaccuucgacucccugaacaucaccgccgccucgcugaacgacgacggccucgacaaucacaccauccugcuguacuacuccacggccgccagcucccuggcggugacccucaugaucgccaucuucguggucuacauggugucgcgcgacaacguguccugcagcaucugccuguga

SEQ ID NO: 15034 - RNA, 1758 nt, Artificial Sequence; identical to SEQ ID NO: 14254
  derived and/or modified CDS sequence (AUadapt) from InfluenzaB__AGX19194__HA

SEQ ID NO: 15035 - RNA, 1758 nt, Artificial Sequence
  derived and/or modified CDS sequence (AUadapt) from InfluenzaB__AGX19205__HA
augaaggccaucaucgugcugcucauggucgugaccaguaacgccgaccgcgugugcaccggcaucacguccagcaacucgccccacgucgugaagaccgcgacccagggggaggugaacgucaccggcgugaucccgcugacgaccacccccaccaagagccacuucgccaaucugaaggggacggagacccggggcaagcucugccccaagugccugaacugcaccgaccuggacguggcccucgggcgccccaagugcaccggcaacaucccguccgcccgggucucgauccugcacgaggugcgccccgugacguccggcugcuuucccaucaugcacgaccggaccaagauccgccagcugcccaaccuccugcggggguacgagcacauccgccugagcacccacaacgucaucaacgccgagaacgcgccgggcgggcccuacaagaucggcaccuccgggaguugccccaacgugacgaacggcaacggcuucuucgccaccauggccugggccgugcccaagaacgacaacaacaagaccgcgaccaacucccucacgaucgaggucccguauaucugcaccgagggggaggaccagaucaccguguggggcuuccacagcgacaacgagacccagauggccaagcuguacggggacuccaagccccagaaguucacgucguccgccaauggcgugaccacccacuacgucagccagaucggcggguuccccaaccagaccgaggacggcgggcugccccaguccggccggaucgugguggacuacaugguccagaaguccgggaagacgggcaccaucaccuaccagcgcggcauccuccugccgcagaagguguggugcgccuccgggcggucgaaggugaucaagggcagccugccccucaucggggaggccgauugccugcacgagaaguacggcgggcugaacaaguccaagcccuacuacaccggcgagcacgcgaaggccaucggcaacugccccaucugggucaagacgccgcucaagcuggccaacgggaccaaguaccgcccgcccgccaagcugcucaaggagcggggcuuuuucggggccaucgcgggcuuccuggagggcgggugggagggcaugaucgccggguggcacggcuacaccucgcacggggcccacggcguggccgucgccgcggaccugaaguccacccaggaggccaucaacaagaucacgaagaaccucaacagucuguccgagcuggaggugaagaaccuccagcgccugucgggcgccauggacgagcugcacaacgagauccucgagcuggacgagaagguggacgaccugcgggccgacaccaucuccagccagaucgagcucgccguccugcuguccaacgaggggaucaucaauucggaggacgagcaccuccuggcgcuggagcgcaagcucaagaagaugcugggccccuccgccguggagaucgggaacggcugcuucgagaccaagcacaagugcaaccagaccugccuggaccggaucgccgccgggaccuuugacgcgggcgaguucagccuccccacguucgacucccugaacaucaccgccgccucgcugaacgacgacggccucgacaaucacaccauccugcuguacuacuccaccgccgccagcucccuggcggugacgcucaugaucgccaucuucgucguguacauggugucgcgcgacaacgucuccugcagcaucugccuguga

SEQ ID NO: 15036 - RNA, 1758 nt, Artificial Sequence
  derived and/or modified CDS sequence (AUadapt) from InfluenzaB__AGX19216__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccacuucgccaaucugaaggggacggagacccggggcaagcucugccccaagugccugaacugcaccgaccuggacguggcccucgggcgccccaagugcaccggcaacaucccguccgcccgggugucgauccugcacgagguccgccccgugacguccggcugcuuucccaucaugcacgaccggaccaagauccgccagcugcccaaccuccugcggggguacgagcacauccgccugagcacccacaacgugaucaacgccgagaacgcgccgggcgggcccuacaagaucggcaccuccgggaguugccccaacgucacgaacggcaacggcuucuucgccaccauggccugggccgugcccaagaacgacaacaacaagaccgcgaccaacucccucacgaucgaggugccguauaucugcaccgagggggaggaccagaucaccgucuggggcuuccacagcgacaacgagacccagauggccaagcuguacggggacuccaagccccagaaguucacgucguccgccaauggcgugaccacccacuacgugagccagaucggcggguuccccaaccagaccgaggacggcgggcugccccaguccggccggaucgucguggacuacauggugcagaaguccgggaagccgggcacgaucaccuaccagcgcggcauccuccugccccagaaggucuggugcgccuccgggcggucgaaggugaucaagggcagccugccccucaucggggaggccgauugccugcacgagaaguacggcgggcugaacaaguccaagcccuacuacaccggcgagcacgcgaaggccaucggcaacugcccgaucugggugaagacgccccucaagcuggccaacgggaccaaguaccgcccgcccgccaagcugcucaaggagcggggcuuuuucggggccaucgcgggcuuccuggagggcgggugggagggcaugaucgccggguggcacggcuacaccucgcacggggcccacggcgucgccguggccgcggaccugaaguccacccaggaggccaucaacaagaucaccaagaaccucaacagucuguccgagcuggaggucaagaaccuccagcgccugucgggcgccauggacgagcugcacaacgagauccucgagcuggacgagaagguggacgaccugcgggccgacacgaucuccagccagaucgagcucgccgugcugcuguccaacgaggggaucaucaauucggaggacgagcaccuccuggcgcuggagcgcaagcucaagaagaugcugggccccuccgccgucgagaucgggaacggcugcuucgagaccaagcacaagugcaaccagaccugccuggaccggaucgccgccgggaccuuugacgcgggcgaguucagccuccccaccuucgacucccugaacaucacggccgccucgcugaacgacgacggccucgacaaucacaccauccugcuguacuacuccaccgccgccagcucccuggcggugacccucaugaucgccaucuucguggucuacauggugucgcgcgacaacguguccugcagcaucugccuguga

SEQ ID NO: 15037 - RNA, 1758 nt, Artificial Sequence
  derived and/or modified CDS sequence (AUadapt) from InfluenzaB__AGX19227__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccacuuugccaaccugaaggggacggagacccggggcaagcucugcccccagugccugaacugcaccgaccuggacguggcccucgggcgccccaagugcaccggcaacaucccguccgcccgggugucgauccugcaugagguccgccccgugacguccggcugcuuccccaucaugcacgaccggaccaagauccgccagcugcccaaccuccugcggggguacgagcacauccgccugagcacccacaacgugaucaaugccgagaacgcgccgggcgggcccuacaagaucggcaccuccgggucgugccccaacgucacgaacggcaacggcuucuucgccaccauggccugggccgugcccaaguccgacaauaacaagaccgcgaccaacagccucacgaucgaggugccguacaucugcaccgagggggaggaccagaucaccgucuggggcuuccacuccgacaacgagacccagauggccaagcuguacggggauagcaagccccagaaguucacguccucggccaacggcgugaccacccacuacgugucccagaucggcggguuccccaaccagaccgaggacggcgggcugccccagagcggccggaucgucguggauuacauggugcagaaguccgggaagacgggcaccaucaccuaccagcgcggcauccuccugccgcagaaggucuggugcgccucggggcggagcaaggugaucaagggcucccugccccucaucggggaggccgacugccugcacgagaaguacggcgggcugaacaagaguaagcccuacuacaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcauggcuacaccucccacggggcccacggcgucgccguggccgcggaccugaaguccacccaggaggccaucaacaagaucacgaagaaccucaacucccugagcgagcuggaggucaagaaccuccagcgccuguccggcgccauggacgagcugcacaaugagauccucgagcuggacgagaagguggacgaccugcgggccgacaccaucagcucccagaucgagcucgccgugcugcugucgaacgaggggaucaucaacuccgaggacgagcaccuccuggcgcuggagcgcaagcucaagaagaugcugggccccagugccgucgagaucgggaacggcugcuucgagaccaagcacaagugcaaccagaccugccuggaccggaucgccgccgggaccuucgacgcgggcgaguuuucccuccccacguucgacucgcugaacaucaccgccgccucccugaacgacgacggccucgacaaccacaccauccugcuguauuacagcaccgccgccuccucgcuggcggugacgcucaugaucgccaucuucguggucuacauggugucccgcgacaacgugagcugcagcaucugccuguga

SEQ ID NO: 15038 - RNA, 1758 nt, Artificial Sequence
  derived and/or modified CDS sequence (AUadapt) from InfluenzaB__AGX19238__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugucccaagugccugaacugcaccgaccuggacguggcccucgggcgccccaagugcaccggcaacaucccguccgcccgggugagcauccugcacgagguccgccccgugacguccggcugcuuccccaucaugcacgaucggaccaagauccgccagcugcccaaccuccugcggggguacgagcacauccgccugucgacccacaacgugaucaacgccgagaacgcgccgggcgggcccuacaagaucggcaccuccgggagcugccccaacgucacgaauggcaacggcuucuucgccaccauggccugggccgugcccaagaacgacaagaacaagaccgcgaccaacucccucacgaucgaggugccguacaucugcaccgagggggaggaccagaucaccgucuggggcuuccacagugacaacgagacccagauggccaagcuguacggggacuccaagccccagaaguucacgagcuccgccaacggcgugaccacccacuacgugucgcagaucggcggguuccccaaccagaccgaggauggcgggcugccccaguccggccggaucgucguggacuacauggugcagaaguccgggaagacgggcaccaucaccuaccagcgcggcauccuccugccgcagaaggucuggugcgccuccgggcggagcaaggugaucaagggcucgcugccccucaucggggaggccgacugccugcacgagaaguacggcgggcugaacaaguccaagcccuacuacaccggcgagcaugcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccucgcacggggcccacggcgucgccguggccgcggaucugaaguccacccaggaggccaucaacaagaucacgaagaaccucaacagccuguccgagcuggaggucaagaaccuccagcgccugucgggcgccauggacgagcugcacaacgagauccucgagcuggacgagaagguggacgaccugcgggccgauaccaucuccagccagaucgagcucgccgugcugcuguccaacgaggggaucaucaacucggaggacgagcaccuccuggcgcuggagcgcaagcucaagaagaugcugggccccuccgccgucgagaucgggaacggcugcuucgagaccaagcacaagugcaaccagaccugucuggaccggaucgccgccgggaccuucgacgcgggcgaguucagccuccccacguucgacucccugaacaucaccgccgccucgcugaacgacgacggccucgauaaccacaccauccugcuguacuacuccaccgccgccagcucccuggcggugacgcucaugaucgccaucuucguggucuacauggugucgcgcgacaacguguccugcagcaucugccuguga

SEQ ID NO: 15039 - RNA, 1758 nt, Artificial Sequence; identical to SEQ ID NO: 15038
  derived and/or modified CDS sequence (AUadapt) from InfluenzaB__AGX19249__HA

SEQ ID NO: 15040 - RNA, 1758 nt, Artificial Sequence; identical to SEQ ID NO: 14254
  derived and/or modified CDS sequence (AUadapt) from InfluenzaB__AGX19260__HA

SEQ ID NO: 15041 - RNA, 1758 nt, Artificial Sequence; identical to SEQ ID NO: 14254
  derived and/or modified CDS sequence (AUadapt) from InfluenzaB__AGX19271__HA

SEQ ID NO: 15042 - RNA, 1758 nt, Artificial Sequence
  derived and/or modified CDS sequence (AUadapt) from InfluenzaB__AGX19282__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugccccaagugucugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcauauccgccugucgacccacaacgugaucaacgccgagaacgcgccgggcgggcccuacaagaucggcaccuccgggucgugccccaacgucacgaacggcaacggcuucuucgccaccauggccugggccgugcccaagaaugacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguuuacgucguccgccaacggcgugaccacccacuacgugagccagaucggcggguuccccaaccagaccgaggacggcgggcugccccaguccggccggaucgucguggacuacauggugcagaaguccgggaagacgggcaccaucaccuaccagcgcggcauccuccugccgcagaaggucuggugcaccuccgggcggucgaaggugaucaagggcucgcugccccucaucggggaggccgauugccugcacgagaaguacggcgggcugaacaaguccaagcccuacuacacgggcgagcacgccaaggcgaucggcaacugccccaucugggugaagaccccgcucaagcuggccaacgggaccaaguaccgcccgcccgccaagcugcucaaggagcggggcuucuucggggccaucgccggcuuucuggagggcgggugggagggcaugaucgcgggguggcacggcuacaccagccacggggcccacggcgucgccguggccgccgaccugaaguccacgcaggaggcgaucaacaagaucaccaagaaccucaacucgcuguccgagcuggaggucaagaaccuccagcgccugagcggcgccauggacgagcugcacaaugagauccucgagcuggacgagaagguggacgaccugcgggccgacaccaucuccucgcagaucgagcucgccgugcugcuguccaacgaggggaucaucaacucggaggacgagcaccuccuggcccuggagcgcaagcucaagaagaugcugggccccuccgcggucgagaucgggaacggcugcuucgagaccaagcauaagugcaaccagaccugccuggaccggaucgccgccgggacguucgacgccggcgaguucagccuccccaccuucgacucccugaacaucaccgcggccucgcugaacgacgauggccucgacaaccacaccauccugcuguacuacuccacggccgccagcucccuggccgugacccucaugaucgcgaucuucguggucuacauggugucgcgcgacaacguguccugcagcaucugccuguga

SEQ ID NO: 15043 - RNA, 1758 nt, Artificial Sequence
  derived and/or modified CDS sequence (AUadapt) from InfluenzaB__AGX19304__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugccccaagugucugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcauauccgccugucgacccacaacgugaucaacgccgagaacgcgccgggcgggcccuacaagaucggcaccuccgggagcugccccaacgucacgaacggcaacggcuucuucgccaccauggccugggccgugcccaagaaugacaacaacaagaccgcgaucaacucccucaccaucgaggugccguacaucugcacggagggggaggaccagaucaccgucuggggcuuccacucggacaacgagacccagauggccaagcuguacggggacuccaagccccagaaguuuaccagcuccgccaacggcgugacgacccacuacgugucgcagaucggcggguuccccaaccagaccgaggacggcgggcugccccaguccggccggaucgucguggacuacauggugcagaaguccgggaagaccggcacgaucaccuaccagcgcggcauccuccugccgcagaaggucuggugcgccuccgggcggagcaaggugaucaagggcucgcugccccucaucggggaggccgauugccugcacgagaaguacggcgggcugaacaaguccaagcccuacuacaccggcgagcacgcgaaggccaucggcaacugccccaucugggugaagaccccgcucaagcuggccaacgggacgaaguaccgcccgcccgccaagcugcucaaggagcggggcuucuucggggccaucgcgggcuuucuggagggcgggugggagggcaugaucgccggguggcacggcuacaccucgcacggggcccacggcgucgccguggccgcggaccugaaguccacccaggaggccaucaacaagaucaccaagaaccucaacagccuguccgagcuggaggucaagaaccuccagcgccugucgggcgccauggacgagcugcacaaugagauccucgagcuggacgagaagguggacgaccugcgggccgacacgaucuccagccagaucgagcucgccgugcugcuguccaacgaggggaucaucaacucggaggacgagcaccuccuggcgcuggagcgcaagcucaagaagaugcugggccccuccgccgucgagaucgggaacggcugcuucgagaccaagcauaagugcaaccagaccugccuggaccggaucgccgccgggaccuucgacgcgggcgaguucagccuccccaccuucgacucccugaacaucacggccgccucgcugaacgacgauggccucgacaaccacaccauccugcuguacuacuccaccgccgccagcucccuggcggugacccucaugaucgccaucuucguggucuacauggugucgcgcgacaacguguccugcagcaucugccuguga

SEQ ID NO: 15044 - RNA, 1758 nt, Artificial Sequence; identical to SEQ ID NO: 15043
  derived and/or modified CDS sequence (AUadapt) from InfluenzaB__AGX19315__HA

SEQ ID NO: 15045 - RNA, 1758 nt, Artificial Sequence; identical to SEQ ID NO: 15042
  derived and/or modified CDS sequence (AUadapt) from InfluenzaB__AGX19326__HA

SEQ ID NO: 15046 - RNA, 1758 nt, Artificial Sequence; identical to SEQ ID NO: 15042
  derived and/or modified CDS sequence (AUadapt) from InfluenzaB__AGX19337__HA

SEQ ID NO: 15047 - RNA, 1758 nt, Artificial Sequence
  derived and/or modified CDS sequence (AUadapt) from InfluenzaB__AGX19348__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugucccaagugccugaacugcaccgaccuggacguggcccucgggcgccccaagugcaccggcaacaucccguccgcccgggugagcauccugcacgagguccgccccgugacguccggcugcuuccccaucaugcacgaucggaccaagauccgccagcugcccaaccuccugcggggguacgagcacauccgccugucgacccacaacgugaucaacgccgagaacgcgccgggcgggcccuacaagaucggcaccuccgggagcugccccaacgucacgaauggcaacggcuucuucgccaccauggccugggccgugcccaagaacgacaacaacaagaccgcgaccaacucccucacgaucgaggugccguacaucugcaccgagggggaggaccagaucaccgucuggggcuuccacagugacaacgaggcccagauggccaagcuguacggggacuccaagccccagaaguucaccagcuccgccaacggcgugacgacccacuacgugucgcagaucggcggguuccccaaccagaccgaggauggcgggcugccccaguccggccggaucgucguggacuacauggugcagaaguccgggaagaccggcacgaucaccuaccagcgcggcauccuccugccgcagaaggucuggugcaccuccgggcggagcaaggugaucaagggcucgcugccccucaucggggaggccgacugccugcacgagaaguacggcgggcugaacaaguccaagcccuacuauaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccucgcacggggcccauggcgucgccguggccgcggaccugaaguccacccaggaggccaucaacaagaucacgaagaaccucaacagccuguccgagcuggaggucaagaaccuccagcgccugucgggcgccauggacgagcugcacaacgagauccucgagcuggacgagaagguggacgaccugcgggccgauaccaucuccagccagaucgagcucgccgugcugcuguccaacgaggggaucaucaacucggaggacgagcaccuccuggcgcuggagcgcaagcucaagaagaugcugggccccuccgccgucgagaucgggaacggcugcuucgagaccaagcacaagugcaaccagaccugucuggaccggaucgccgccgggaccuucgacgcgggcgaguucagccuccccacguucgacucccugaacaucaccgccgccucgcugaacgacgacggccucgauaaccacaccauccugcuguacuacuccaccgccgccagcucccuggcggugacgcucaugaucgccaucuucguggucuacauggugucgcgcgacaacguguccugcagcaucugccuguga

SEQ ID NO: 15048 - RNA, 1758 nt, Artificial Sequence; identical to SEQ ID NO: 15042
  derived and/or modified CDS sequence (AUadapt) from InfluenzaB__AGX19359__HA

SEQ ID NO: 15049 - RNA, 1755 nt, Artificial Sequence; identical to SEQ ID NO: 14471
  derived and/or modified CDS sequence (AUadapt) from InfluenzaB__AGX19370__HA

SEQ ID NO: 15050 - RNA, 1758 nt, Artificial Sequence; identical to SEQ ID NO: 14305
  derived and/or modified CDS sequence (AUadapt) from InfluenzaB__AGX19381__HA

SEQ ID NO: 15051 - RNA, 1758 nt, Artificial Sequence; identical to SEQ ID NO: 15042
  derived and/or modified CDS sequence (AUadapt) from InfluenzaB__AGX19392__HA

SEQ ID NO: 15052 - RNA, 1758 nt, Artificial Sequence; identical to SEQ ID NO: 15042
  derived and/or modified CDS sequence (AUadapt) from InfluenzaB__AGX19403__HA

SEQ ID NO: 15053 - RNA, 1758 nt, Artificial Sequence; identical to SEQ ID NO: 14085
  derived and/or modified CDS sequence (AUadapt) from InfluenzaB__AGX19414__HA

SEQ ID NO: 15054 - RNA, 1755 nt, Artificial Sequence
  derived and/or modified CDS sequence (AUadapt) from InfluenzaB__AGX19425__HA
augaagaccaucaucgugcugcucauggucgugaccaguaacgccgaccgcaucugcacgggcaucaccuccagcaacaguccccacguggucaagaccgccacccagggggaggugaacgugacgggcgucaucccgcugaccaccacccccacgaaguccuacuucgcgaaccugaaggggacccggacccgcggcaagcucugccccgauugccugaacugcaccgaccuggacguggcccucgggcggcccaugugcgugggcacgaccccguccgccaaggccaguauccugcacgagguccgccccgugaccuccggcugcuuccccaucaugcacgaccggaccaagauccgccagcugcccaaccuccugcggggguaugagaacauccgccugagcacgcagaacgugaucgacgccgagaaggcgccgggcgggcccuaccggcucggcaccuccgggagcugucccaacgccaccuccaagagcggcuucuucgccaccauggccugggcgguccccaaggacaacaauaagaacgccacgaacccgcugaccguggaggugcccuacaucugcaccgagggcgaggaccagaucaccgucuggggguuccauuccgacaacaagacgcagaugcgcaaccuguacggcgacaguaacccccagaaguucaccuccagcgccaacggggugaccacccacuacgugucccagaucggcaguuuccccgaccagacggaggacggcgggcucccgcaguccggccggaucgucguggacuacaugaugcagaagcccgggaagaccggcaccaucguguaccagcgcgggguccugcugccccagcggguguggugugccagcggccgcagcaaggugaucaagggcgcccucccccugaucggggaggcggacugccugcacgagaaguacggcgggcucaauaaguccaagccguacuacaccggcgagcacgccaaggccaucgggaacugccccaucugggucaagacgccccugaagcuggccaacggcaccaaguaucggcccccggccaagcuccugaaggagcgcggcuucuucggggcgaucgccggcuuccuggagggcgggugggaggggaugaucgccggcuggcacggcuacaccagccauggggcccacggcguggccgucgcggccgaccucaaguccacccaggaggccaucaacaagaucacgaagaaccugaacagccuguccgagcucgaggugaagaaucugcagcggcugagcggggccauggacgagcuccacaacgagauccuggagcuggacgagaagguggaugaccuccgcgccgacaccaucuccagccagaucgagcuggcgguccugcucuccaacgagggcaucaucaacagcgaggaugagcaccuccuggcccuggagcggaagcugaagaagaugcugggccccuccgccguggagaucgggaacggcugcuucgagaccaagcacaagugcaaucagaccugccucgaccgcaucgccgcggggaccuucaacgccggcgaguucagccugcccacguuugacucccugaacaucaccgccgccagccucaacgacgacgggcuggauaaccacaccauccugcuguacuacuccaccgccgcgagcucccucgccgugacgcugaugcuggccaucuucaucgucuauauggugagccgggacaacguguccugcagcaucugccucuga

SEQ ID NO: 15055 - RNA, 1758 nt, Artificial Sequence; identical to SEQ ID NO: 14254
  derived and/or modified CDS sequence (AUadapt) from InfluenzaB__AGX19436__HA

SEQ ID NO: 15056 - RNA, 1758 nt, Artificial Sequence; identical to SEQ ID NO: 14917
  derived and/or modified CDS sequence (AUadapt) from InfluenzaB__AGX19447__HA

SEQ ID NO: 15057 - RNA, 1755 nt, Artificial Sequence; identical to SEQ ID NO: 14796
  derived and/or modified CDS sequence (AUadapt) from InfluenzaB__AGX19458__HA

SEQ ID NO: 15058 - RNA, 1755 nt, Artificial Sequence; identical to SEQ ID NO: 14796
  derived and/or modified CDS sequence (AUadapt) from InfluenzaB__AGX19469__HA

SEQ ID NO: 15059 - RNA, 1758 nt, Artificial Sequence; identical to SEQ ID NO: 14085
  derived and/or modified CDS sequence (AUadapt) from InfluenzaB__AGX19480__HA

SEQ ID NO: 15060 - RNA, 1758 nt, Artificial Sequence; identical to SEQ ID NO: 14322
  derived and/or modified CDS sequence (AUadapt) from InfluenzaB__AGX19491__HA

SEQ ID NO: 15061 - RNA, 1758 nt, Artificial Sequence; identical to SEQ ID NO: 14086
  derived and/or modified CDS sequence (AUadapt) from InfluenzaB__AGX19502__HA

SEQ ID NO: 15062 - RNA, 1758 nt, Artificial Sequence
  derived and/or modified CDS sequence (AUadapt) from InfluenzaB__AGX19513__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugccccaagugucugaacugcaccgaccuggacguggcccucgggcgccccaagugcaccggcaagaucccguccgcccgggugucgauccugcacgagguccgccccgugacguccggcugcuuccccaucaugcacgaccggaccaagauccgccagcugcccaaccuccugcggggguacgagcauauccgccugagcacccacaacgugaucaacgccgagaacgcgccgggcgggcccuacaagaucggcaccuccgggucgugccccaacaucacgaacggcaacggcuucuucgccaccauggccugggccguccccaagaaugacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagugccaacggcgucaccacccacuacaucucccagaucggcggguuccccaaccagaccgaggacggcgggcugccgcagucgggccggaucgugguggacuacaugguccagaaguccgggaagacgggcaccaucaccuaccagcgcggcauccuccugccccagaagguguggugcgccagcgggcgguccaaggugaucaagggcucgcugccccucaucggggaggccgauugccugcacgagaaguacggcgggcugaacaagucgaagcccuacuacaccggcgagcacgcgaaggccaucggcaacugcccgaucugggucaagacgccccucaagcuggccaacgggaccaaguaccgcccgcccgccaagcugcucaaggagcggggcuucuuuggggccaucgcgggcuuccuggagggcgggugggagggcaugaucgccggguggcacggcuacaccucccacggggcccacggcguggccguggccgcggaccugaaguccacccaggaggccaucaacaagaucacgaagaaccucaacucccugagcgagcuggaggucaagaaccuccagcgccuguccggcgccauggacgagcugcacaacgagauccucgagcuggaugagaagguggacgaccugcgggccgacaccaucucgucccagaucgagcucgccguccugcugagcaacgaggggaucaucaacuccgaggacgagcaccuccuggcgcuggagcgcaagcucaagaagaugcugggccccucggccguggagaucgggaacggcugcuucgagaccaagcauaagugcaaccagaccugccuggaccggaucgccgccgggaccuucgacgcgggcgaguucucccuccccacguucgacucgcugaacaucaccgccgccucccugaacgacgauggccucgacaaccacaccauccugcuguacuacagcaccgccgccuccucgcuggcggugacgcucaugaucgccaucuucgucguguacauggugucccgcgacaacgucagcugcuccaucugccuguga

SEQ ID NO: 15063 - RNA, 1758 nt, Artificial Sequence; identical to SEQ ID NO: 15062
  derived and/or modified CDS sequence (AUadapt) from InfluenzaB__AGX19524__HA

SEQ ID NO: 15064 - RNA, 1758 nt, Artificial Sequence
  derived and/or modified CDS sequence (AUadapt) from InfluenzaB__AGX19535__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccacuucgccaaucugaaggggacggagacccggggcaagcucugccccaagugccugaacugcaccgaccuggacguggcccucgggcgccccaagugcaccggcaacaucccguccgcccgggugucgauccugcacgagguccgccccgugacguccggcugcuuucccaucaugcacgaccggaccaagauccgccagcugcccaaccuccugcggggguacgagcacauccgccugagcacccacaacgugaucaacgccgagaacgcgccgggcgggcccuacaagaucggcaccuccgggaguugccccaacgucacgaacggcaacggcuucuucgccaccauggccugggccgugcccaagaacgacaacaacaagaccgcgaccaacucccucacgaucgaggugccguauaucugcaccgagggggaggaccagaucaccgucuggggcuuccacagcgacgacgagacccagauggccaagcuguacggggacuccaagccccagaaguucacgucguccgccaauggcgugaccacccacuacgugagccagaucggcggguuccccaaccagaccgaggacggcgggcugccccaguccggccggaucgucguggacuacauggugcagaaguccgggaagacgggcaccaucaccuaccagcgcggcauccuccugccgcagaaggucuggugcgccuccgggcggucgaaggugaucaagggcagccugccccucaucggggaggccgauugccugcacgagaaguacggcgggcugaacaaguccaagcccuacuacaccggcgagcacgcgaaggccaucggcaacugccccaucugggugaagacgccgcucaagcuggccaacgggaccaaguaccgcccgcccgccaagcugcucaaggagcggggcuuuuucggggccaucgcgggcuuccuggagggcgggugggagggcaugaucgccggguggcacggcuacaccucgcacggggcccacggcgucgccguggccgcggaccugaaguccacccaggaggccaucaacaagaucacgaagaaccucaacagucuguccgagcuggaggucaagaaccuccagcgccugucgggcgccauggacgagcugcacaacgagauccucgagcuggacgagaagguggacgaccugcgggccgacaccaucuccagccagaucgagcucgccgugcugcuguccaacgaggggaucaucaauucggaggacgagcaccuccuggcgcuggagcgcaagcucaagaagaugcugggccccuccgccgucgagaucgggaacggcugcuucgagaccaagcacaagugcaaccagaccugccuggaccggaucgccgccgggaccuuugacgcgggcgaguucagccuccccacguucgacucccugaacaucaccgccgccucgcugaacgacgacggccucgacaaucacaccauccugcuguacuacuccaccgccgccagcucccuggcggugacgcucaugaucgccaucuucguggucuacauggugucgcgcgacaacguguccugcagcaucugccuguga

SEQ ID NO: 15065 - RNA, 1758 nt, Artificial Sequence
  derived and/or modified CDS sequence (AUadapt) from InfluenzaB__AGX19546__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugucccaagugccugaacugcaccgaccuggacguggcccucgggcgccccaagugcaccggcaacaucccguccgcccgggugagcauccugcacgagguccgccccgugacguccggcugcuuccccaucaugcacgaucggaccaagauccgccagcugcccaaccuccugcggggguacgagcacauccgccugucgacccacaacgugaucaacgccgagaacgcgccgggcgggcccuacaagaucggcaccuccgggagcugccccaacgucacgaauggcaacggcuucuucgccaccauggccugggccgugcccaagaacgacaacaacaagaccgcgaccaacucccucacgaucgaggugccguacaucugcaccgagggggaggaccagaucaccgucuggggcuuccauucggacaaggagacccagauggccaagcuguacggggacuccaagccccagaaguucacgagcuccgccaacggcgugaccacccacuacgugucgcagaucggcggguuccccaaccagaccgaggauggcgggcugccccaguccggccggaucgucguggacuacauggugcagaaguccgggaagacgggcaccaucaccuaccagcgcggcauccuccugccgcagaaggucuggugcgccuccgggcggagcaaggugaucaagggcucgcugccccucaucggggaggccgacugccugcacgagaaguacggcgggcugaacaaguccaagcccuacuacaccggcgagcaugcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccucgcacggggcccacggcgucgccguggccgcggaucugaaguccacccaggaggccaucaacaagaucacgaagaaccucaacagccuguccgagcuggaggucaagaaccuccagcgccugucgggcgccauggacgagcugcacaacgagauccucgagcuggacgagaagguggacgaccugcgggccgauaccaucuccagccagaucgagcucgccgugcugcuguccaacgaggggaucaucaacucggaggacgagcaccuccuggcgcuggagcgcaagcucaagaagaugcugggccccuccgccgucgagaucgggaacggcugcuucgagaccaagcacaagugcaaccagaccugucuggaccggaucgccgccgggaccuucgacgcgggcgaguucagccuccccacguucgacucccugaacaucaccgccgccucgcugaacgacgacggccucgauaaccacaccauccugcuguacuacuccaccgccgccagcucccuggcggugacgcucaugaucgccaucuucguggucuacauggugucgcgcgacaacguguccugcagcaucugccuguga

SEQ ID NO: 15066 - RNA, 1758 nt, Artificial Sequence
  derived and/or modified CDS sequence (AUadapt) from InfluenzaB__AGX19557__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccacuucgccaaucugaaggggacggagacccggggcaagcucugccccaagugccugaacugcaccgaccuggacguggcccucgggcgccccaagugcaccggcaacaucccguccgcccgggugucgauccugcacgagguccgccccgugacguccggcugcuuucccaucaugcacgaccggaccaagauccgccagcugcccaaccuccugcggggguacgagcacauccgccugagcacccacaacgugaucaacgccgagaacgcgccgggcgggcccuacaagaucggcaccuccgggaguugccccaacgucacgaacggcaacggcuucuucgccaccauggccugggccgugcccaagaacgacaacaacaagaccgcgaccaacucccucacgaucgaggugccguauaucugcaccgggggcgaggaccagaucaccgucuggggguuccacagcgacaacgagacccagauggccaagcuguacggcgacuccaagccccagaaguucacgucguccgccaauggcgugaccacccacuacgugagccagaucgggggcuuccccaaccagaccgaggacgggggccugccccaguccgggcggaucgucguggacuacauggugcagaaguccggcaagacgggcaccaucaccuaccagcgcgggauccuccugccgcagaaggucuggugcgccuccggccggucgaaggugaucaaggggagccugccccucaucggcgaggccgauugccugcacgagaaguacgggggccugaacaaguccaagcccuacuacaccggcgagcacgcgaaggccaucgggaacugccccaucugggugaagacgccgcucaagcuggccaacggcaccaaguaccgcccgcccgccaagcugcucaaggagcggggguuuuucggcgccaucgcgggguuccuggagggcggcugggaggggaugaucgccggcuggcacggguacaccucgcacggcgcccacggcgucgccguggccgcggaccugaaguccacccaggaggccaucaacaagaucacgaagaaccucaacagucuguccgagcuggaggucaagaaccuccagcgccugucgggggccauggacgagcugcacaacgagauccucgagcuggacgagaagguggacgaccugcgggccgacaccaucuccagccagaucgagcucgccgugcugcuguccaacgagggcaucaucaauucggaggacgagcaccuccuggcgcuggagcgcaagcucaagaagaugcuggggcccuccgccgucgagaucggcaacgggugcuucgagaccaagcacaagugcaaccagaccugccuggaccggaucgccgccggcaccuuugacgcgggcgaguucagccuccccacguucgacucccugaacaucaccgccgccucgcugaacgacgacgggcucgacaaucacaccauccugcuguacuacuccaccgccgccagcucccuggcggugacgcucaugaucgccaucuucguggucuacauggugucgcgcgacaacguguccugcagcaucugccuguga

SEQ ID NO: 15067 - RNA, 1758 nt, Artificial Sequence; identical to SEQ ID NO: 14085
  derived and/or modified CDS sequence (AUadapt) from InfluenzaB__AGX19568__HA

SEQ ID NO: 15068 - RNA, 1758 nt, Artificial Sequence; identical to SEQ ID NO: 15062
  derived and/or modified CDS sequence (AUadapt) from InfluenzaB__AGX19579__HA

SEQ ID NO: 15069 - RNA, 1758 nt, Artificial Sequence; identical to SEQ ID NO: 14085
  derived and/or modified CDS sequence (AUadapt) from InfluenzaB__AGX19590__HA

SEQ ID NO: 15070 - RNA, 1758 nt, Artificial Sequence; identical to SEQ ID NO: 14085
  derived and/or modified CDS sequence (AUadapt) from InfluenzaB__AGX19601__HA

SEQ ID NO: 15071 - RNA, 1758 nt, Artificial Sequence; identical to SEQ ID NO: 14085
  derived and/or modified CDS sequence (AUadapt) from InfluenzaB__AGX19612__HA

SEQ ID NO: 15072 - RNA, 1758 nt, Artificial Sequence
  derived and/or modified CDS sequence (AUadapt) from InfluenzaB__AGX19623__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccacuucgccaaucugaaggggacggagacccggggcaagcucugccccaagugccugaacugcaccgaccuggacguggcccucgggcgccccaagugcaccggcaacaucccguccgcccgggugucgauccugcacgagguccgccccgugacguccggcugcuuucccaucaugcacgaccggaccaagauccgccagcugcccaaccuccugcggggguacgagcacauccgccugagcacccacaacgugaucaacgccgagaacgcgccgggcgggcccuacaagaucggcaccuccgggaguugccccaacgucacgaacggcaacggcuucuucgccaccauggccugggccgugcccaagaacgacaacaacaagaccgcgaccaacucccucacgaucgaggugccguauaucugcaccgagggggaggaccagaucaccgucuggggcuuccacagcgacaacgagacccagauggccaagcuguacggggacuccaagccccagaaguucacgucguccgccaauggcgugaccacccacuacgugagccagaucggcggguuccccaaccagaccgaggacggcgggcugccccaguccggccggaucgucguggacuacauggugcagaaguccgggaagacgggcaccaucaccuaccagcgcggcauccuccugccgcagaaggucuggugcgccuccgggcggucgaaggugaucaagggcagccugccccucaucggggaggccgauugccugcacgagaaguacggcgggcugaacaaguccaagcccuacuacaccggcgagcacgcgaaggccaucggcaacugccccaucugggugaagacgccgcucaagcuggccaacgggaccaaguaccgcccgcccgccaagcugcucaaggagcggggcuuuuucggggccaucgcgggcuuccuggagggcgggugggagggcaugaucgccggguggcacggcuacaccucgcacggggcccacggcgucgccguggccgcggaccugaaguccacccaggaggccaucaacaagaucacgaagaaccucaacagucuguccgagcuggaggucaagaaccuccagcgccugucgggcgccauggacgagcugcacaacgagauccucgagcuggacgagaagguggacgaccugcgggccgacaccaucuccagccagaucgagcucgccgugcugcuguccaacgaggggaucaucaauucggaggacgagcaccuccuggcgcuggagcgcaagcucaagaagaugcugggccccuccgccgucgagaucgggaacggcugcuucgagaccaagcacaagugcaaccagaccugccuggaccggaucgccgccgggaccuuugacgcgggcgaguucagccuccccacguucgacucccugaacaucaccgccgccucgcugaacgacgacggccucgacaaucacaccauccugcuguacuacuccaccgccgccagcucccuggcgguggcccucaugaucgccaucuucguggucuacauggugucgcgcgacaacguguccugcagcaucugccuguga

SEQ ID NO: 15073 - RNA, 1758 nt, Artificial Sequence; identical to SEQ ID NO: 14085
  derived and/or modified CDS sequence (AUadapt) from InfluenzaB__AGX19634__HA

SEQ ID NO: 15074 - RNA, 1758 nt, Artificial Sequence; identical to SEQ ID NO: 14254
  derived and/or modified CDS sequence (AUadapt) from InfluenzaB__AGX19645__HA

SEQ ID NO: 15075 - RNA, 1758 nt, Artificial Sequence; identical to SEQ ID NO: 14305
  derived and/or modified CDS sequence (AUadapt) from InfluenzaB__AGX19656__HA

SEQ ID NO: 15076 - RNA, 1758 nt, Artificial Sequence
  derived and/or modified CDS sequence (AUadapt) from InfluenzaB__AGX19667__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuuugccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuucccaucaugcacgaccggaccaagauccgccagcugcccaaccuccugcggggguacgagcacauccgccugucgacccacaacgugaucaacgccgagaacgcgccgggcgggcccuacaagaucggcaccuccgggaguugccccaacaucacgaacggcaacggcuucuucgccaccauggccugggccguccccaagaacgacaagaacaagaccgcgaccaacccgcucacgaucgaggugcccuacaucuguaccgagggggaggaccagaucaccguguggggcuuccacuccgacaacgagacccagauggccaagcuguacggggacucgaagccccagaaguucacguccagcgccaacggcgucaccacccauuacgugucccagaucggcggguuccccaaccagaccgaggacggcgggcugccgcagucgggccggaucguggucgacuacauggugcagaaguccgggaagacgggcaccaucaccuaccagcgcggcauccuccugccccagaagguguggugcgccagcgggcgguccaaggucaucaagggcucgcugccccucaucggggaggccgauugccugcacgagaaguacggcgggcugaacaagagcaagcccuacuacaccggcgagcacgcgaaggccaucggcaacugcccgaucugggugaagacgccccucaagcuggccaacgggaccaaguaucgcccgcccgccaagcugcucaaggagcggggcuucuucggggccaucgcgggcuuccuggagggcgggugggagggcaugaucgccggguggcacggcuacaccucccacggggcccacggcguggccgucgccgcggaccugaaguccacccaggaggccaucaacaagaucacgaagaaccucaacucccugagugagcuggaggugaaggaccuccagcgccuguccggcgccauggacgagcugcacaacgagauccucgagcuggacgagaaggucgacgaccugcgggccgacaccaucagcucccagaucgagcucgccgugcugcugucgaacgaggggaucaucaauuccgaggacgagcaccuccuggcgcuggagcgcaagcucaagaagaugcugggccccagcgccguggagaucgggaacggcugcuucgagaccaagcacaagugcaaccagaccugccuggaccggaucgccgccgggaccuuugacgcgggcgaguucucccuccccacguucgacucgcugaacaucaccgccgccucccugaacgacgacggccucgacaaccauaccauccugcuguacuacagcaccgccgccuccucgcuggcggucacgcucaugaucgccaucuucgugguguacauggucucccgcgacaacgugagcugcuccaucugccuguga

SEQ ID NO: 15077 - RNA, 1758 nt, Artificial Sequence; identical to SEQ ID NO: 14085
  derived and/or modified CDS sequence (AUadapt) from InfluenzaB__AGX19678__HA

SEQ ID NO: 15078 - RNA, 1758 nt, Artificial Sequence; identical to SEQ ID NO: 14254
  derived and/or modified CDS sequence (AUadapt) from InfluenzaB__AGX19700__HA

SEQ ID NO: 15079 - RNA, 1758 nt, Artificial Sequence
  derived and/or modified CDS sequence (AUadapt) from InfluenzaB__AGX19711__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugccccaagugucugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcauauccgccugucgacccacaacgugaucaacgccgagaacgcgccgggcgggcccuacaagaucggcaccuccgggucgugccccaacgucacgaacggcaacggcuucuucgccaccauggccugggccgugcccaagaaugacaagaacaagaccgcgaccaacucccucacgaucgaggugccguacaucugcaaggagggggaggaccagaucaccgucuggggcuuccacagcgacaacgagacccagauggccaagcuguacggggacuccaagccccagaaguucaccaguuccgccaacggcgugacgacccacuacgugagccagaucggcggguuccccaaccagaccgaggacggcgggcugccccaguccggccggaucgucguggacuacauggugcagaaguccgggaagaccggcacgaucaccuaccagcgcggcauccuccugccgcagaaggucuggugcgccuccgggcggucgaaggugaucaagggcucgcugccccucaucggggaggccgauugccugcacgagaaguacggcgggcugaacaaguccaagcccuacuacaccggcgagcacgcgaaggccaucggcaacugccccaucugggugaagaccccgcucaagcuggccaacgggacgaaguaccgcccgcccgccaagcugcucaaggagcggggcuucuucggggccaucgcgggcuuccuggagggcgggugggagggcaugaucgccggguggcauggcuacaccagccacggggcccacggcgucgccguggccgcggaccugaaguccacccaggaggccaucaacaagaucaccaagaaccucaacucgcuguccgagcuggaggucaagaaccuccagcgccugagcggcgccauggacgagcugcacaaugagauccucgagcuggacgagaagguggacgaccugcgggccgacacgaucuccucgcagaucgagcucgccgugcugcuguccaacgaggggaucaucaacucggaggacgagcaccuccuggcgcuggagcgcaagcucaagaagaugcugggccccuccgccgucgagaucgggaacggcugcuucgagaccaagcacaaguguaaccagaccugccuggaccggaucgccgccgggaccuucgacgcgggcgaguucagccuccccaccuucgacucccugaacaucacggccgccucgcugaacgacgauggccucgacaaccacaccauccugcuguacuacuccaccgccgccagcucccuggcggugacccucaugaucgccaucuucguggucuacauggugucgcgcgacaacguguccugcagcaucugccuguga

SEQ ID NO: 15080 - RNA, 1758 nt, Artificial Sequence; identical to SEQ ID NO: 14085
  derived and/or modified CDS sequence (AUadapt) from InfluenzaB__AGX19722__HA

SEQ ID NO: 15081 - RNA, 1758 nt, Artificial Sequence; identical to SEQ ID NO: 14085
  derived and/or modified CDS sequence (AUadapt) from InfluenzaB__AGX19733__HA

SEQ ID NO: 15082 - RNA, 1758 nt, Artificial Sequence; identical to SEQ ID NO: 14085
  derived and/or modified CDS sequence (AUadapt) from InfluenzaB__AGX19744__HA

SEQ ID NO: 15083 - RNA, 1758 nt, Artificial Sequence; identical to SEQ ID NO: 14254
  derived and/or modified CDS sequence (AUadapt) from InfluenzaB__AGX19755__HA

SEQ ID NO: 15084 - RNA, 1758 nt, Artificial Sequence; identical to SEQ ID NO: 14085
  derived and/or modified CDS sequence (AUadapt) from InfluenzaB__AGX19766__HA

SEQ ID NO: 15085 - RNA, 1758 nt, Artificial Sequence; identical to SEQ ID NO: 15062
  derived and/or modified CDS sequence (AUadapt) from InfluenzaB__AGX19788__HA

SEQ ID NO: 15086 - RNA, 1758 nt, Artificial Sequence; identical to SEQ ID NO: 14085
  derived and/or modified CDS sequence (AUadapt) from InfluenzaB__AGX19799__HA

SEQ ID NO: 15087 - RNA, 1758 nt, Artificial Sequence; identical to SEQ ID NO: 14085
  derived and/or modified CDS sequence (AUadapt) from InfluenzaB__AGX19810__HA

SEQ ID NO: 15088 - RNA, 1758 nt, Artificial Sequence
  derived and/or modified CDS sequence (AUadapt) from InfluenzaB__AGX19821__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugccccaagugucugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcauauccgccugucgacccacaacgugaucaacgccgagaacgcgccgggcgggcccuacaagaucggcaccuccgggagcugccccaacgucacgaacggcaacggcuucuucgccaccauggccugggccgugcccaagaacgauaacaacaagaccgcgaccaacucccucacgaucgaggugccguacaucugcaccgagggggaggaccagaucaccgucuggggcuuccacucggacaacgagacccagauggccaagcuguacggggacuccaagccccagaaguuuacgucguccgccaacggcgugaccacccacuacgugagccagaucggcggguuccccaaccagaccgaggacggcgggcugccccaguccggccggaucgucguggacuacauggugcagaaguccgggaagacgggcaccaucaccuaccagcgcggcauccuccugccgcagaaggucuggugcgccuccgggcggucgaaggugaucaagggcagccugccccucaucggggaggccgauugccugcacgagaaguacggcgggcugaacaaguccaagcccuacuacaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcauggcuacaccucgcacggggcccacggcgucgccguggccgcggaccugaaguccacccaggaggccaucaacaagaucacgaagaaccucaacagccuguccgagcuggaggucaagaaccuccagcgccugucgggcuccauggacgagcugcacaaugagauccucgagcuggacgagaagguggacgaccugcgggccgacaccaucucgucccagaucgagcucgccgugcugcugagcaacgaggggaucaucaacuccgaggacgagcaccuccuggcccuggagcgcaagcucaagaagaugcugggccccucggcggucgagaucgggaacggcugcuucgagaccaagcauaagugcaaccagaccugccuggaccggaucgccgccgggaccuucgacgccggcgaguucucccuccccacguucgacagccugaacaucaccgcggccucccugaacgacgacggccucgauaaccacaccauccugcuguacuacucgaccgccgccuccagccuggccgugacgcucaugaucgcgaucuucguggucuacauggugucccgcgacaacgugucgugcagcaucugccuguga

SEQ ID NO: 15089 - RNA, 1758 nt, Artificial Sequence; identical to SEQ ID NO: 15062
  derived and/or modified CDS sequence (AUadapt) from InfluenzaB__AGX19832__HA

SEQ ID NO: 15090 - RNA, 1758 nt, Artificial Sequence; identical to SEQ ID NO: 14085
  derived and/or modified CDS sequence (AUadapt) from InfluenzaB__AGX19843__HA

SEQ ID NO: 15091 - RNA, 1758 nt, Artificial Sequence; identical to SEQ ID NO: 14085
  derived and/or modified CDS sequence (AUadapt) from InfluenzaB__AGX19854__HA

SEQ ID NO: 15092 - RNA, 1758 nt, Artificial Sequence; identical to SEQ ID NO: 14085
  derived and/or modified CDS sequence (AUadapt) from InfluenzaB__AGX19865__HA

SEQ ID NO: 15093 - RNA, 1758 nt, Artificial Sequence; identical to SEQ ID NO: 15062
  derived and/or modified CDS sequence (AUadapt) from InfluenzaB__AGX19876__HA

SEQ ID NO: 15094 - RNA, 1758 nt, Artificial Sequence; identical to SEQ ID NO: 14085
  derived and/or modified CDS sequence (AUadapt) from InfluenzaB__AGX19887__HA

SEQ ID NO: 15095 - RNA, 1758 nt, Artificial Sequence
  derived and/or modified CDS sequence (AUadapt) from InfluenzaB__AGX19898__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugccccaagugucugaacugcaccgaccuggacguggcccucgggcgccccaagugcaccggcaagaucccguccgcccgggugucgauccugcacgagguccgccccgugacguccggcugcuuccccaucaugcacgaccggaccaagauccgccagcugcccaaccuccugcggggguacgagcauauccgccugagcacccacaacgugaucaacgccgagaacgcgccgggcgggcccuacaagaucggcaccuccgggucgugccccaacaucacgaacgagaacggcuucuucgccaccauggccugggccguccccaagaaugacaagaacaagaccgcgaccaacccgcucacgaucgaggugcccuacaucugcaccgagggcgaggaccagaucaccguguggggguuccacuccgacaacgagacccagauggccaagcuguacggcgacagcaagccccagaaguucacguccagugccaacggggucaccacccacuacgugucccagaucggcggcuuccccaaccagaccgaggacgggggccugccgcagucggggcggaucguggucgacuacauggugcagaaguccggcaagacggggaccaucaccuaccagcgcggcauccuccugccccagaagguguggugcgccagcggccgguccaaggucaucaaggggucgcugccccucaucggcgaggccgauugccugcacgagaaguacgggggccugaacaagucgaagcccuacuacaccggggagcacgcgaaggccaucggcaacugcccgaucugggugaagacgccccucaagcuggccaacggcaccaaguaccgcccgcccgccaagcugcucaaggagcggggguucuuuggcgccaucgcgggguuccuggagggcgggugggagggcaugaucgccggcuggcacggguacaccucccacggcgcccacgggguggccgucgccgcggaccugaaguccacccaggaggccaucaacaagaucacgaagaaccucaacucccugagcgagcuggaggugaagaaccuccagcgccuguccggcgccauggacgagcugcacaacgagauccucgagcuggaugagaaggucgacgaccugcgggccgacaccaucucgucccagaucgagcucgccgugcugcugagcaacgagggcaucaucaacuccgaggacgagcaccuccuggcgcuggagcgcaagcucaagaagaugcuggggcccucggccguggagaucggcaacgggugcuucgagaccaagcauaagugcaaccagaccugccuggaccggaucgccgccggcaccuucgacgcgggggaguucucccuccccacguucgacucgcugaacaucaccgccgccucccugaacgacgauggccucgacaaccacaccauccugcuguacuacagcaccgccgccuccucgcuggcggucacgcucaugaucgccaucuucgugguguacauggucucccgcgacaacgugagcugcuccaucugccuguga

SEQ ID NO: 15096 - RNA, 1758 nt, Artificial Sequence; identical to SEQ ID NO: 14254
  derived and/or modified CDS sequence (AUadapt) from InfluenzaB__AGX19909__HA

SEQ ID NO: 15097 - RNA, 1758 nt, Artificial Sequence; identical to SEQ ID NO: 14085
  derived and/or modified CDS sequence (AUadapt) from InfluenzaB__AGX19920__HA

SEQ ID NO: 15098 - RNA, 1758 nt, Artificial Sequence; identical to SEQ ID NO: 15095
  derived and/or modified CDS sequence (AUadapt) from InfluenzaB__AGX19931__HA

SEQ ID NO: 15099 - RNA, 1758 nt, Artificial Sequence; identical to SEQ ID NO: 15062
  derived and/or modified CDS sequence (AUadapt) from InfluenzaB__AGX19942__HA

SEQ ID NO: 15100 - RNA, 1758 nt, Artificial Sequence; identical to SEQ ID NO: 14085
  derived and/or modified CDS sequence (AUadapt) from InfluenzaB__AGX19953__HA

SEQ ID NO: 15101 - RNA, 1758 nt, Artificial Sequence; identical to SEQ ID NO: 14089
  derived and/or modified CDS sequence (AUadapt) from InfluenzaB__AGX19964__HA

SEQ ID NO: 15102 - RNA, 1758 nt, Artificial Sequence; identical to SEQ ID NO: 14254
  derived and/or modified CDS sequence (AUadapt) from InfluenzaB__AGX19975__HA

SEQ ID NO: 15103 - RNA, 1758 nt, Artificial Sequence
  derived and/or modified CDS sequence (AUadapt) from InfluenzaB__AGX19986__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugccccaagugucugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcauauccgccugucgacccacaacgugaucaacgccgagaacgcgccgggcgggcccuacaagaucggcaccuccgggagcugccccaacaucacgaacggcaacggcuucuucgccaccauggccugggccguccccaagaaugacaagaacaagaccgcgaccaacccgcucacgaucgaggugcccuacaucugcaccgagggggaggaccagaucaccguguggggcuuccacuccgacaacgagacccagauggccaagcuguacggggacucgaagccccagaaguucacguccagugccaacggcgucaccacccacuacgugucccagaucggcggguuccccaaccagaccgaggacggcgggcugccgcagagcggccggaucguggucgacuacauggugcagaaguccgggaagacgggcaccaucaccuaccagcgcggcauccuccugccccagaagguguggugcgucucggggcgguccaaggugaucaagggcagccugccccucaucggggaggccgauugccugcacgagaaguacggcgggcugaacaagucgaagcccuacuacaccggcgagcacgccaaggcgaucggcaacugcccgaucugggugaagacgccccucaagcuggccaacgggaccaaguaccgcccgcccgccaagcugcucaaggagcggggcuucuuuggggccaucgccggcuuccuggagggcgggugggagggcaugaucgcgggguggcacggcuacaccucccacggggcccacggcgucgccguggccgccgaccugaaguccacccaggaggcgaucaacaagaucacgaagaaccucaacucccugagcgagcuggaggucaagaaccuccagcgccuguccggcgccauggacgagcugcacaacgagauccucgagcuggaugagaagguggacgaccugcgggccgacaccaucucgucccagaucgagcucgccgugcugcugucgaacgaggggaucaucaacuccgaggacgagcaccuccuggcccuggagcgcaagcucaagaagaugcugggccccagcgcggucgagaucgggaacggcugcuucgagaccaagcauaagugcaaccagaccugccuggaccggaucgccgccgggaccuucgacgccggcgaguucucccuccccacguucgacucgcugaacaucaccgcggccucccugaacgacgauggccucgacaaccacaccauccugcuguacuacagcaccgccgccuccucgcuggccgugacgcucaugaucgcgaucuucguggucuacauggugucccgcgacaacgugagcugcuccaucugccuguga

SEQ ID NO: 15104 - RNA, 1758 nt, Artificial Sequence
  derived and/or modified CDS sequence (AUadapt) from InfluenzaB__AGX19997__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugccccaagugucugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcauauccgccugucgacccacaacgugaucaacgccgagaacgcgccgggcgggcccuacaagaucggcaccuccgggagcugccccaacaucacgaacggcaacggcuucuucgccaccauggccugggccguccccaagaaugacaagaacaagaccgcgaccaacccgcucacgaucgaggugcccuacaucugcaccgagggggaggaccagaucaccguguggggcuuccacuccgacaacgagacccagauggccaagcuguacggggacucgaagccccagaaguucacguccagugccaacggcgucaccacccacuacgugucccagaucggcggguuccccaaccagaucgaggacggcgggcugccgcagagcggccggaucguggucgacuacauggugcagaaguccgggaagaccggcacgaucaccuaccagcgcggcauccuccugccccagaagguguggugcgccucggggcgguccaaggucaucaagggcagccugccccucaucggggaggccgauugccugcacgagaaguacggcgggcugaacaagucgaagcccuacuacaccggcgagcacgcgaaggccaucggcaacugcccgaucugggugaagacgccccucaagcuggccaacgggaccaaguaccgcccgcccgccaagcugcucaaggagcggggcuucuuuggggccaucgcgggcuuccuggagggcgggugggagggcaugaucgccggguggcacggcuacaccucccacggggcccacggcguggccgucgccgcggaccugaaguccacccaggaggccaucaacaagaucaccaagaaccucaacucccugagcgagcuggaggugaagaaccuccagcgccuguccggcgccauggacgagcugcacaacgagauccucgagcuggaugagaaggucgacgaccugcgggccgacacgaucucgucccagaucgagcucgccgugcugcugucgaacgaggggaucaucaacuccgaggacgagcaccuccuggcgcuggagcgcaagcucaagaagaugcugggccccagcgccguggagaucgggaacggcugcuucgagaccaagcauaagugcaaccagaccugccuggaccggaucgccgccgggaccuucgacgcgggcgaguucucccuccccaccuucgacucgcugaacaucacggccgccucccugaacgacgauggccucgacaaccacaccauccugcuguacuacagcaccgccgccuccucgcuggcggucacccucaugaucgccaucuucgugguguacauggucucccgcgacaacgugagcugcuccaucugccuguga

SEQ ID NO: 15105 - RNA, 1758 nt, Artificial Sequence; identical to SEQ ID NO: 14085
  derived and/or modified CDS sequence (AUadapt) from InfluenzaB__AGX20008__HA

SEQ ID NO: 15106 - RNA, 1758 nt, Artificial Sequence; identical to SEQ ID NO: 14085
  derived and/or modified CDS sequence (AUadapt) from InfluenzaB__AGX20019__HA

SEQ ID NO: 15107 - RNA, 1758 nt, Artificial Sequence; identical to SEQ ID NO: 14085
  derived and/or modified CDS sequence (AUadapt) from InfluenzaB__AGX20030__HA

SEQ ID NO: 15108 - RNA, 1758 nt, Artificial Sequence
  derived and/or modified CDS sequence (AUadapt) from InfluenzaB__AGX20041__HA
augaaggccaucaucgugcugcucauggucgugaccagugacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggaaggagacgcggggcaagcucugucccaagugccugaacugcaccgaccuggacguggcccucgggcgccccaagugcaccggcaagaucccguccgcccgggugagcauccugcacgagguccgccccgugaccuccggcugcuuccccaucaugcacgaccggacgaagauccgccagcugcccaaucuccugcggggguacgagcacauccgccugucgacccacaacgugaucaacgccgagaacgcgccgggcgggcccuacaagaucggcaccuccgggagcugccccaacaucaccaacggcaauggcuucuucgccacgauggccugggccguccccaagaacgacaagaacaagaccgcgaccaacccgcucaccaucgaggugcccuacaucugcacggagggggaggaccagaucaccguguggggcuuccacuccgacaaugagacccagauggccaagcuguacggggacucgaagccccagaaguucaccuccucggccaacggcgucacgacccacuacgugucccagaucggcggguuccccaaccagaccgaggacggcgggcugccgcagagcggccggaucguggucgauuacauggugcagaaguccgggaagaccggcacgaucaccuaccagcgcggcauccuccugccccagaagguguggugcgccucggggcgguccaaggucaucaagggcagccugccccucaucggggaggccgacugccugcacgagaaguacggcgggcugaacaagucgaagcccuacuauaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcguggccgucgccgcggaucugaaguccacccaggaggccaucaacaagaucaccaagaaccucaacucccugagcgagcuggaggugaagaaccuccagcgccuguccggcgccauggacgagcugcacaacgagauccucgagcuggacgagaaggucgacgaccugcgggccgacacgaucaguucccagaucgagcucgccgugcugcugucgaacgaggggaucaucaacuccgaggacgagcaccuccuggcgcuggagcgcaagcucaagaagaugcugggccccagcgccguggagaucgggaacggcugcuucgagaccaagcacaagugcaaccagaccugucuggaccggaucgccgccgggaccuucgacgcgggcgaguucucccuccccaccuucgacucgcugaacaucacggccgccucccugaacgacgacggccucgacaaucacaccauccugcuguacuacagcaccgccgccuccucgcuggcggucacccucaugaucgccaucuucgugguguacauggucucccgcgacaacgugagcugcuccaucugccuguga

SEQ ID NO: 15109 - RNA, 1758 nt, Artificial Sequence; identical to SEQ ID NO: 14085
  derived and/or modified CDS sequence (AUadapt) from InfluenzaB__AGX20052__HA

SEQ ID NO: 15110 - RNA, 1758 nt, Artificial Sequence; identical to SEQ ID NO: 14085
  derived and/or modified CDS sequence (AUadapt) from InfluenzaB__AGX20063__HA

SEQ ID NO: 15111 - RNA, 1758 nt, Artificial Sequence
  derived and/or modified CDS sequence (AUadapt) from InfluenzaB__AGX20074__HA
augaaggccaucaucgcccugcucaugguggucaccaguaacgcggaccgcaucugcaccggcaucacguccucgaacagcccccacguggugaagaccgccacccagggggaggucaacgugaccggcgugaucccgcugacgaccacccccaccaagucgcacuuugccaaccugaaggggacggagacccggggcaagcucugccccaagugccugaacugcaccgaccuggacgucgcccucgggcgccccaagugcaccggcaagaucccguccgcccgggugagcauccugcacgaggugcgccccgucacguccggcugcuuucccaucaugcacgaccggaccaagauccgccagcugcccaaccuccugcggggguacgagcacauccgccugucgacccacaacgugaucaacgcggagaacgccccgggcgggcccuacaagaucggcaccuccgggaguugccccaacaucacgaacggcaacggcuucuucgccaccauggccugggcggugcccaagaacgacaagaacaagaccgccaccaacccgcucacgaucgagguccccuacaucuguaccgagggggaggaccagaucaccguguggggcuuccacuccgacaacgagacccagauggccaagcuguacggggacucgaagccccagaaguucacguccucggccaacggcgugaccacccauuacgucucccagaucggcggguuccccaaccagaccgaggacggcgggcugccgcagagcggccggaucgugguggacuacaugguccagaaguccgggaagacgggcaccaucaccuaccagcgcggcauccuccugccccagaagguguggugcgccucggggcgguccaaggugaucaagggcagccugccccucaucggggaggcggauugccugcacgagaaguacggcgggcugaacaagucgaagcccuacuacaccggcgagcacgccaaggccaucggcaacugcccgaucugggucaagacgccccucaagcuggccaacgggaccaaguaucgcccgcccgccaagcugcucaaggagcggggcuucuucggggcgaucgccggcuuccuggagggcgggugggagggcaugaucgccggguggcacggcuacaccucccacggggcccacggcguggccguggcggccgaccugaaguccacccaggaggccaucaacaagaucacgaagaaccucaacucccugagugagcuggaggucaagaaccuccagcgccuguccggcgccauggacgagcugcacaacgagauccucgagcuggacgagaagguggacgaccugcgggccgacaccaucucgucccagaucgagcucgcgguccugcugucgaacgaggggaucaucaauuccgaggacgagcaccuccuggcccuggagcgcaagcucaagaagaugcugggccccagcgccguggagaucgggaacggcugcuucgagaccaagcacaagugcaaccagaccugccuggaccggaucgccgcggggaccuuugacgccggcgaguucucccuccccacguucgacucgcugaacaucaccgccgccucccugaacgacgacggccucgacaaccauaccauccugcuguacuacagcaccgccgcguccucgcuggccgugacgcucaugaucgccaucuucgucguguacauggugucccgcgacaacgucagcugcuccaucugccuguga

SEQ ID NO: 15112 - RNA, 1758 nt, Artificial Sequence
  derived and/or modified CDS sequence (AUadapt) from InfluenzaB__AGX20085__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugccccaagugucugaacugcaccgaccuggacguggcccucgggcgccccaagugcaccggcaagaucccguccgcccgggugucgauccugcacgagguccgccccgugacguccggcugcuuccccaucaugcacgaccggaccaagauccgccagcugcccaaccuccugcggggguacgagcauauccgccugagcacccacaacgugaucaacgccgagaacgcgccgggcgggcccuacaagaucggcaccuccgggucgugccccaacaucacgaacggcaacggcuucuucgccaccauggccugggccguccccaagaaugacaagaacaagaccgcgaccaacccgcucacgaucgaggugcccuacaucugcaccgagggggaggaccagaucaccaucuggggcuuccacuccgacaacgagacccagauggccaagcuguacggggacagcaagccccagaaguucacguccagugccaacggcgugaccacccacuacgucucccagaucggcggguuccccaaccagaccgaggacggcgggcugccgcagucgggccggaucgugguggacuacaugguccagaaguccgggaagacgggcaccaucaccuaccagcgcggcauccuccugccccagaagguguggugcgccagcgggcgguccaaggugaucaagggcucgcugccccucaucggggaggccgauugccugcacgagaaguacggcgggcugaacaagucgaagcccuacuacaccggcgagcacgcgaaggccaucggcaacugcccgaucugggucaagacgccccucaagcuggccaacgggaccaaguaccgcccgcccgccaagcugcucaaggagcggggcuucuuuggggccaucgcgggcuuccuggagggcgggugggagggcaugaucgccggguggcacggcuacaccucccacggggcccacggcguggccguggccgcggaccugaaguccacccaggaggccaucaacaagaucacgaagaaccucaacucccugagcgagcuggaggucaagaaccuccagcgccuguccggcgccauggacgagcugcacaacgagauccucgagcuggaugagaagguggacgaccugcgggccgacaccaucucgucccagaucgagcucgccguccugcugagcaacgaggggaucaucaacuccgaggacgagcaccuccuggcgcuggagcgcaagcucaagaagaugcugggccccucggccguggagaucgggaacggcugcuucgagaccaagcauaagugcaaccagaccugccuggaccggaucgccgccgggaccuucgacgcgggcgaguucucccuccccacguucgacucgcugaacaucaccgccgccucccugaacgacgauggccucgacaaccacaccauccugcuguacuacagcaccgccgccuccucgcuggcggugacgcucaugaucgccaucuucgucguguacauggugucccgcgacaacgucagcugcuccaucugccuguga

SEQ ID NO: 15113 - RNA, 1758 nt, Artificial Sequence
  derived and/or modified CDS sequence (AUadapt) from InfluenzaB__AGX20096__HA
augaaggccaucaucgugcugcucauggucgugaccaguaacgccgaccgcaucugcaccggcgugacguccagcaacucgccccacgucgugaagaccgcgacccagggggaggugaacgucaccggcgugaucccgcugacgaccacccccaccaagagccacuucgccaaucugaaggggacggagacccggggcaagcucugccccaagugccugaacugcaccgaccuggacguggcccucgggcgccccaagugcaccggcaacaucccguccgcccgggucucgauccugcacgaggugcgccccgugacguccggcugcuuucccaucaugcacgaccggaccaagauccgccagcugcccaaccuccugcggggguacgagcacauccgccugagcacccacaacgucaucaacgccgagaacgcgccgggcgggcccuacaagaucggcaccuccgggaguugccccaacgugacgaacggcaacggcuucuucgccaccauggccugggccgugcccaagaacgacaacaacaagaccgcgaccaacucccucacgaucgaggucccguauaucugcaccgagggggaggaccagaucaccguguggggcuuccacagcgacaacgagacccagauggccaagcuguacggggacuccaagccccagaaguucacgucguccgccaauggcgugaccacccacuacgucagccagaucggcggguuccccaaccagaccgaggacggcgggcugccccaguccggccggaucgugguggacuacaugguccagaaguccgggaagacgggcaccaucaccuaccagcgcggcauccuccugccgcagaagguguggugcgccuccgggcggucgaaggugaucaagggcagccugccccucaucggggaggccgauugccugcacgagaaguacggcgggcugaacaaguccaagcccuacuacaccggcgagcacgcgaaggccaucggcaacugccccaucugggucaagacgccgcucaagcuggccaacgggaccaaguaccgcccgcccgccaagcugcucaaggagcggggcuuuuucggggccaucgcgggcuuccuggagggcgggugggagggcaugaucgccggguggcacggcuacaccucgcacggggcccacggcguggccgucgccgcggaccugaaguccacccaggaggccaucaacaagaucacgaagaaccucaacagucuguccgagcuggaggugaagaaccuccagcgccugucgggcgccauggacgagcugcacaacgagauccucgagcuggacgagaagguggacgaccugcgggccgacaccaucuccagccagaucgagcucgccguccugcuguccaacgaggggaucaucaauucggaggacgagcaccuccuggcgcuggagcgcaagcucaagaagaugcugggccccuccgccguggagaucgggaacggcugcuucgagaccaagcacaagugcaaccagaccugccuggaccggaucgccgccgggaccuuugacgcgggcgaguucagccuccccacguucgacucccugaacaucaccgccgccucgcugaacgacgacggccucgacaaucacaccauccugcuguacuacuccaccgccgccagcucccuggcggugacgcucaugaucgccaucuucgucguguacauggugucgcgcgacaacgucuccugcagcaucugccuguga

SEQ ID NO: 15114 - RNA, 1758 nt, Artificial Sequence; identical to SEQ ID NO: 14348
  derived and/or modified CDS sequence (AUadapt) from InfluenzaB__AGX20107__HA

SEQ ID NO: 15115 - RNA, 1758 nt, Artificial Sequence; identical to SEQ ID NO: 14348
  derived and/or modified CDS sequence (AUadapt) from InfluenzaB__AGX20118__HA

SEQ ID NO: 15116 - RNA, 1758 nt, Artificial Sequence; identical to SEQ ID NO: 14348
  derived and/or modified CDS sequence (AUadapt) from InfluenzaB__AGX20129__HA

SEQ ID NO: 15117 - RNA, 1758 nt, Artificial Sequence; identical to SEQ ID NO: 14348
  derived and/or modified CDS sequence (AUadapt) from InfluenzaB__AGX20140__HA

SEQ ID NO: 15118 - RNA, 1758 nt, Artificial Sequence; identical to SEQ ID NO: 14348
  derived and/or modified CDS sequence (AUadapt) from InfluenzaB__AGX20151__HA

SEQ ID NO: 15119 - RNA, 1758 nt, Artificial Sequence; identical to SEQ ID NO: 14348
  derived and/or modified CDS sequence (AUadapt) from InfluenzaB__AGX20162__HA

SEQ ID NO: 15120 - RNA, 1758 nt, Artificial Sequence; identical to SEQ ID NO: 14348
  derived and/or modified CDS sequence (AUadapt) from InfluenzaB__AGX20173__HA

SEQ ID NO: 15121 - RNA, 1758 nt, Artificial Sequence; identical to SEQ ID NO: 14348
  derived and/or modified CDS sequence (AUadapt) from InfluenzaB__AGX20184__HA

SEQ ID NO: 15122 - RNA, 1758 nt, Artificial Sequence; identical to SEQ ID NO: 14348
  derived and/or modified CDS sequence (AUadapt) from InfluenzaB__AGX20195__HA

SEQ ID NO: 15123 - RNA, 1758 nt, Artificial Sequence; identical to SEQ ID NO: 14348
  derived and/or modified CDS sequence (AUadapt) from InfluenzaB__AGX20206__HA

SEQ ID NO: 15124 - RNA, 1758 nt, Artificial Sequence; identical to SEQ ID NO: 14348
  derived and/or modified CDS sequence (AUadapt) from InfluenzaB__AGX20217__HA

SEQ ID NO: 15125 - RNA, 1758 nt, Artificial Sequence; identical to SEQ ID NO: 14118
  derived and/or modified CDS sequence (AUadapt) from InfluenzaB__AGX20228__HA

SEQ ID NO: 15126 - RNA, 1758 nt, Artificial Sequence
  derived and/or modified CDS sequence (AUadapt) from InfluenzaB__AGX20239__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuuugccaaccugaaggggacggagacccggggcaagcucugccccaagugccccaacugcaccgaccuggacguggcccuggggcgcccgaagugcaccggcaagauccccuccgcccgggugagcauccuccacgagguccgccccgugacguccggcugcuuucccaucaugcacgaccggaccaagauccgccagcugccgaaccugcuccggggguacgagcacauccgccugucgacccacaacgugaucaacgccgagaacgcgcccggcgggcccuacaagaucggcaccuccgggaguugccccaacgucacgaacggcaacggcuucuucgccaccauggccugggccgugccgaagaacgacaagaacaagaccgcgaccaacccccugacgaucgaggugcccuacaucuguaccgagggggaggaccagaucaucgucuggggcuuccacuccgacaacgagacccagauggccaagcucuacggggacucgaagccccagaaguucaccuccagcgccaacggcgugacgacccauuacgugucccagaucggcggguucccgaaccagaccgaggacggcgggcugccccagucgggccggaucgucguggacuacauggugcagaaguccgggaagaccggcacgaucaccuaccagcgcggcauccugcucccccagaaggucuggugcgccagcgggcgguccaaggugaucaagggcucgcugccccugaucggggaggccgauugccuccacgagaaguacggcgggcugaacaagagcaagccguacuacaccggcgagcacgcgaaggccaucggcaacugccccaucugggugaagacgccccugaagcucgccaacgggaccaaguaucggcccccggccaagcugcugaaggagcgcggcuucuucggggccaucgcgggcuuccucgagggcgggugggagggcaugaucgccggguggcacggcuacaccucccacggggcccacggcgucgccguggccgcggaccugaaguccacccaggaggccaucaacaagaucaccaagaaccugaacucccucagugagcuggaggucaagaaccugcagcgccucuccggcgccauggacgagcugcacaacgagauccuggagcucgacgagaagguggacgaccugcgggccgacacgaucagcucccagaucgagcuggccgugcuccugucgaacgaggggaucaucaauuccgaggacgagcaccuccuggcgcuggagcgcaagcugaagaagaugcucggccccagcgccgucgagaucgggaacggcugcuucgagaccaagcacaagugcaaccagaccugccuggaccggaucgccgccgggaccuuugacgcgggcgaguucucccugcccaccuucgacucgcucaacaucacggccgccucccugaacgacgacggccuggacaaccauaccauccuccuguacuacagcaccgccgccuccucgcuggcggugacccugaugaucgccaucuucguggucuacauggugucccgcgacaacgugagcugcuccaucugccucuga

SEQ ID NO: 15127 - RNA, 1758 nt, Artificial Sequence; identical to SEQ ID NO: 14348
  derived and/or modified CDS sequence (AUadapt) from InfluenzaB__AGX20250__HA

SEQ ID NO: 15128 - RNA, 1758 nt, Artificial Sequence; identical to SEQ ID NO: 14348
  derived and/or modified CDS sequence (AUadapt) from InfluenzaB__AGX20261__HA

SEQ ID NO: 15129 - RNA, 1758 nt, Artificial Sequence; identical to SEQ ID NO: 14348
  derived and/or modified CDS sequence (AUadapt) from InfluenzaB__AGX20272__HA

SEQ ID NO: 15130 - RNA, 1758 nt, Artificial Sequence; identical to SEQ ID NO: 14348
  derived and/or modified CDS sequence (AUadapt) from InfluenzaB__AGX20283__HA

SEQ ID NO: 15131 - RNA, 1758 nt, Artificial Sequence; identical to SEQ ID NO: 14348
  derived and/or modified CDS sequence (AUadapt) from InfluenzaB__AGX20294__HA

SEQ ID NO: 15132 - RNA, 1758 nt, Artificial Sequence
  derived and/or modified CDS sequence (AUadapt) from InfluenzaB__AGX20305__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuuugccaaccugaaggggacggagacccggggcaagcucugccccaagugccccaacugcaccgaccuggacguggcccuggggcgcccgaagugcaccggcaagauccccuccgcccgggugagcauccuccacgagguccgccccgugacguccggcugcuuucccaucaugcacgaccggaccaagauccgccagcugccgaaccugcuccggggguacgagcacauccgccugucgacccacaacgugaucaacgccgagaacgcgcccggcgggcccuacaagaucggcaccuccgggaguugccccaacgucacgaacggcaacggcuucuucgccaccauggccugggccgugccgaagaacgacaagaacaagaccgcgaccaaccagcugacgaucgaggugcccuacaucuguaccgagggggaggaccagaucaccgucuggggcuuccacuccgacaacgagacccagauggccaagcucuacggggacucgaagccccagaaguucacguccucggccaacggcgugaccacccauuacgugucccagaucggcggguuccccaaccagaccgaggacggcgggcugccgcagagcggccggaucgucguggacuacauggugcagaaguccgggaagacgggcaccaucaccuaccagcgcggcauccugcucccccagaaggucuggugcgccucggggcgguccaaggugaucaagggcagccugccccugaucggggaggccgauugccuccacgagaaguacggcgggcugaacaagucgaagcccuacuacaccggcgagcacgcgaaggccaucggcaacugcccgaucugggugaagacgccccugaagcucgccaacgggaccaaguaucgcccgcccgccaagcugcugaaggagcggggcuucuucggggccaucgcgggcuuccucgagggcgggugggagggcaugaucgccggguggcacggcuacaccucccacggggcccacggcgucgccguggccgcggaccugaaguccacccaggaggccaucaacaagaucacgaagaaccugaacucccucagugagcuggaggucaagaaccugcagcgccucuccggcgccauggacgagcugcacaacgagauccuggagcucgacgagaagguggacgaccugcgggccgacaccaucucgucccagaucgagcuggccgugcuccugucgaacgaggggaucaucaauuccgaggacgagcaccuccuggcgcuggagcgcaagcugaagaagaugcucggccccagcgccgucgagaucgggaacggcugcuucgagaccaagcacaagugcaaccagaccugccuggaccggaucgccgccgggaccuuugacgcgggcgaguucucccugcccacguucgacucgcucaacaucaccgccgccucccugaacgacgacggccuggacaaccauaccauccuccuguacuacagcaccgccgccuccucgcuggcggugacgcugaugaucgccaucuucguggucuacauggugucccgcgacaacgugagcugcuccaucugccucuga

SEQ ID NO: 15133 - RNA, 1758 nt, Artificial Sequence; identical to SEQ ID NO: 14348
  derived and/or modified CDS sequence (AUadapt) from InfluenzaB__AGX20316__HA

SEQ ID NO: 15134 - RNA, 1758 nt, Artificial Sequence; identical to SEQ ID NO: 14348
  derived and/or modified CDS sequence (AUadapt) from InfluenzaB__AGX20327__HA

SEQ ID NO: 15135 - RNA, 1758 nt, Artificial Sequence
  derived and/or modified CDS sequence (AUadapt) from InfluenzaB__AGX20338__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuuugccaaccugaaggggacggagacccggggcaagcucugccccaagugccccaacugcaccgaccuggacguggcccuggggcgcccgaagugcaccggcaagauccccuccgcccgggugagcauccuccacgagguccgccccgugacguccggcuguuuccccaucaugcacgaccggaccaagauccgccagcugccgaaccugcuccggggguacgagcacauccgccugucgacccacaacgugaucaacgccgagaaugcgcccggcgggcccuacaagaucggcaccuccgggagcugccccaacgucacgaacggcaacggcuucuucgccaccauggccugggccgugccgaagaacgacaagaauaagaccgcgaccaacccccugacgaucgaggugcccuacaucugcaccgagggggaggaccagaucaccgucuggggcuuccacuccgacaacgagacccagauggccaaccucuacggggauucgaagccccagaaguucacguccagcgccaacggcgugaccacccacuacgugucccagaucggcggguucccgaaccagaccgaggacggcgggcugccccagucgggccggaucgucguggauuacauggugcagaaguccgggaagacgggcaccaucaccuaccagcgcggcauccugcucccccagaaggucuggugcgccagcgggcgguccaaggugaucaagggcucgcugccccugaucggggaggccgacugccuccacgagaaguacggcgggcugaacaagaguaagccguacuacaccggcgagcacgcgaaggccaucggcaacugccccaucugggugaagacgccccugaagcucgccaacgggaccaaguaccggcccccggccaagcugcugaaggagcgcggcuucuucggggccaucgcgggcuuccucgagggcgggugggagggcaugaucgccggguggcauggcuacaccucccacggggcccacggcgucgccguggccgcggaccugaaguccacccaggaggccaucaacaagaucacgaagaaccugaacucccucucggagcuggaggucaagaaccugcagcgccucuccggcgccauggacgagcugcauaacgagauccuggagcucgacgagaagguggacgaccugcgggccgacaccaucagcucccagaucgagcuggccgugcuccugucgaacgaggggaucaucaacuccgaggacgagcaucuccuggcgcuggagcgcaagcugaagaagaugcucggccccagcgccgucgagaucgggaacggcugcuucgagaccaagcacaagugcaaccagaccugccuggaccggaucgccgccgggaccuucgaugcgggcgaguucucccugcccacguucgacucgcucaacaucaccgccgccucccugaacgacgacggccuggacaaccauaccauccuccuguacuacagcaccgccgccuccucgcuggcggugacgcugaugaucgccaucuucguggucuacauggugucccgcgacaacgugagcugcuccaucugccucuga

SEQ ID NO: 15136 - RNA, 1758 nt, Artificial Sequence; identical to SEQ ID NO: 14348
  derived and/or modified CDS sequence (AUadapt) from InfluenzaB__AGX20349__HA

SEQ ID NO: 15137 - RNA, 1758 nt, Artificial Sequence; identical to SEQ ID NO: 14348
  derived and/or modified CDS sequence (AUadapt) from InfluenzaB__AGX20360__HA

SEQ ID NO: 15138 - RNA, 1758 nt, Artificial Sequence; identical to SEQ ID NO: 14118
  derived and/or modified CDS sequence (AUadapt) from InfluenzaB__AGX20371__HA

SEQ ID NO: 15139 - RNA, 1758 nt, Artificial Sequence
  derived and/or modified CDS sequence (AUadapt) from InfluenzaB__AGX20382__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuuugccaaccugaaggggacggagacccggggcaagcucugccccaagugccccaacugcaccgaccuggacguggcccuggggcgcccgaagugcaccggcaagauccccuccgcccgggugagcauccuccacgagguccgccccgugacguccggcugcuuucccaucaugcacgaccggaccaagauccgccagcugccgaaccugcuccggggguacgagcacauccgccugucgacccacaacgugaucaacgccgagaacgcgcccggcgggcccuacaagaucggcaccuccgggaguugccccaacgucacgaacggcaacggcuucuucgccaccauggccugggccgugccgaagaacgacaagaacaagaccgcgaccaacccccugacgaucgaggugcccuacaucuguaccgagggggaggaccagaucaccgucuggggcuuccacuccgacaacgagacccagauggccaagcucuacggggacucgaagccccagaaguucacguccucggccaacggcgugaccacccauuacgugucccagaucggcggguucccgaaccagaccgaggacggcgggcugccccagagcggccggaucgucguggacuacauggugcagaaguccgggaagacgggcaccaucaccuaccagcgcggcauccugcucccccagaaggucuggugcgccucggggcgguccaaggugaucaagggcagccugccccugaucggggaggccgauugccuccacgagaaguacggcgggcugaacaagucgaagccguacuacaccggcgagcacgcgaaggccaucggcaacugccccaucugggugaagacgccccugaagcucgccaacgggaccaaguaucggcccccggccaagcugcugaaggagcgcggcuucuucggggccaucgcgggcuuccucgagggcgggugggagggcaugaucgccggguggcacggcuacaccucccacggggcccacggcgucgccguggccgcggaccugaaguccacccaggaggccaucaacaagaucacgaagaaccugaacucccucagugagcuggaggucaagaaccugcagcgccucuccggcgccaugaacgagcugcacaacgagauccuggagcucgacgagaagguggacgaccugcgggccgacaccaucucgucccagaucgagcuggccgugcuccugucgaacgaggggaucaucaauuccgaggacgagcaccuccuggcgcuggagcgcaagcugaagaagaugcucggccccagcgccgucgagaucgggaacggcugcuucgagaccaagcacaagugcaaccagaccugccuggaccggaucgccgccgggaccuuugacgcgggcgaguucucccugcccacguucgacucgcucaacaucaccgccgccucccugaacgacgacggccuggacaaccauaccauccuccuguacuacagcaccgccgccuccucgcuggcggugacgcugaugaucgccaucuucguggucuacauggugucccgcgacaacgugagcugcuccaucugccucuga

SEQ ID NO: 15140 - RNA, 1758 nt, Artificial Sequence; identical to SEQ ID NO: 14348
  derived and/or modified CDS sequence (AUadapt) from InfluenzaB__AGX20393__HA

SEQ ID NO: 15141 - RNA, 1758 nt, Artificial Sequence; identical to SEQ ID NO: 14118
  derived and/or modified CDS sequence (AUadapt) from InfluenzaB__AGX20404__HA

SEQ ID NO: 15142 - RNA, 1758 nt, Artificial Sequence; identical to SEQ ID NO: 14348
  derived and/or modified CDS sequence (AUadapt) from InfluenzaB__AGX20415__HA

SEQ ID NO: 15143 - RNA, 1758 nt, Artificial Sequence; identical to SEQ ID NO: 14348
  derived and/or modified CDS sequence (AUadapt) from InfluenzaB__AGX20426__HA

SEQ ID NO: 15144 - RNA, 1758 nt, Artificial Sequence; identical to SEQ ID NO: 14348
  derived and/or modified CDS sequence (AUadapt) from InfluenzaB__AGX20437__HA

SEQ ID NO: 15145 - RNA, 1758 nt, Artificial Sequence; identical to SEQ ID NO: 14348
  derived and/or modified CDS sequence (AUadapt) from InfluenzaB__AGX20448__HA

SEQ ID NO: 15146 - RNA, 1758 nt, Artificial Sequence; identical to SEQ ID NO: 14348
  derived and/or modified CDS sequence (AUadapt) from InfluenzaB__AGX20459__HA

SEQ ID NO: 15147 - RNA, 1758 nt, Artificial Sequence; identical to SEQ ID NO: 14348
  derived and/or modified CDS sequence (AUadapt) from InfluenzaB__AGX20470__HA

SEQ ID NO: 15148 - RNA, 1758 nt, Artificial Sequence; identical to SEQ ID NO: 14348
  derived and/or modified CDS sequence (AUadapt) from InfluenzaB__AGX20481__HA

SEQ ID NO: 15149 - RNA, 1758 nt, Artificial Sequence; identical to SEQ ID NO: 14348
  derived and/or modified CDS sequence (AUadapt) from InfluenzaB__AGX20492__HA

SEQ ID NO: 15150 - RNA, 1758 nt, Artificial Sequence; identical to SEQ ID NO: 14348
  derived and/or modified CDS sequence (AUadapt) from InfluenzaB__AGX20503__HA

SEQ ID NO: 15151 - RNA, 1758 nt, Artificial Sequence; identical to SEQ ID NO: 14348
  derived and/or modified CDS sequence (AUadapt) from InfluenzaB__AGX20514__HA

SEQ ID NO: 15152 - RNA, 1758 nt, Artificial Sequence
  derived and/or modified CDS sequence (AUadapt) from InfluenzaB__AGX20525__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucuccaaucugaaggggacggagacccggggcaagcucugccccaagugccccaacugcaccgaccuggacguggcccuggggcgcccgaagugcaccggcaagauccccagcgcccggguguccauccuccacgagguccgccccgugacgucgggcugcuuucccaucaugcacgaccggaccaagauccgccagcugccgaaccugcuccggggguacgagcacauccgccuguccacccacaacgugaucaacgccgagaacgcccccggcgggcccuacaagaucggcaccagcggguccugucccaacgucacgaacggcaacggcuucuucgcgaccauggccugggccgugccgaagaacgacaagaacaagaccgccaccaacccccugacgaucgaggugcccuacaucugcaccgagggggaggaucagaucaccgucuggggcuuccacucggacaacgagacccagauggcgaagcucuacggggacuccaagccccagaaguucacgagcuccgccaacggcgugaccacccacuaugugucgcagaucggcggguucccgaaccagaccgaggacggcgggcugccccaguccggccggaucgucguggacuacauggugcagaaguccgggaagacgggcaccaucaccuaccagcgcggcauccugcucccccagaaggucuggugcgccuccgggcggagcaaggugaucaagggcucgcugccccugaucggggaggccgacugucuccacgagaaguacggcgggcugaacaaguccaagccguacuacaccggcgagcacgccaaggcgaucggcaacugccccaucugggugaagacgccccugaagcucgccaacgggaccaaguaccggcccccggccaagcugcugaaggagcgcggcuucuuuggggccaucgccggcuuccucgagggcgggugggagggcaugaucgcgggguggcacggcuacaccucgcacggggcccacggcgucgccguggccgccgaccugaaguccacccaggaggcgaucaacaagaucacgaagaaccugaacagccucuccgagcuggaggucaagaaucugcagcgccucucgggcgccauggacgagcugcacaacgagauccuggagcucgacgagaagguggacgaccugcgggccgacaccaucuccagccagaucgagcuggccgugcuccuguccaacgaggggaucaucaacagugaggacgagcaccuccuggcccuggagcgcaagcugaagaagaugcucggccccuccgcggucgagaucgggaacggcugcuucgagaccaagcacaagugcaaccagaccugccuggaccggaucgccgccgggaccuucgaugccggcgaguucagccugcccacguucgacucccucaacaucaccgcggccucgcugaacgacgacggccuggacaaccauaccauccuccuguacuacuccaccgccgccagcucccuggccgugacgcugaugaucgcgaucuucguggucuacauggugucgcgcgacaacguguccugcagcaucugccucuga

SEQ ID NO: 15153 - RNA, 1758 nt, Artificial Sequence; identical to SEQ ID NO: 14348
  derived and/or modified CDS sequence (AUadapt) from InfluenzaB__AGX20536__HA

SEQ ID NO: 15154 - RNA, 1758 nt, Artificial Sequence
  derived and/or modified CDS sequence (AUadapt) from InfluenzaB__AGX20547__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuuugccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuucccaucaugcacgaccggaccaagauccgccagcugcccaaccuccugcggggguacgagcacauccgccugucgacccacaacgugaucaacgccgagaacgcgccgggcgggcccuacaagaucggcaccuccgggaguugccccaacgucacgaacggcaacggcuucuucgccaccauggccugggccgugcccaagaacgacaagaacaagaccgcgaccaacccgcucacgaucgaggugcccuacaucuguaccgagggggaggaccagaucaccgucuggggcuuccacuccgacaacgagacccagauggccaagcuguacggggacucgaagccccagaaguucacguccucggccaacggcgugaccacccaucacgugucccagaucggcggguuccccaaccagaccgaggacggcgggcugccgcagagcggccggaucgucguggacuacauggugcagaaguccgggaagacgggcaccaucaccuaccagcgcggcauccuccugccccagaaggucuggugcgccucggggcgguccaaggugaucaagggcagccugccccucaucggggaggccgauugccugcacgagaaguacggcgggcugaacaagucgaagcccuacuacaccggcgagcacgcgaaggccaucggcaacugcccgaucugggugaagacgccccucaagcuggccaacgggaccaaguaucgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagugagcuggagaucaagaaccuccagcgccuguccggcgccauggacgagcugcacaacgagauccucgagcuggacgagaaggucgacgaccugcgggccgacaccaucucgucccagaucgagcucgccgugcugcugucgaacgaggggaucaucaauuccgaggacgagcaccuccuggcgcuggagcgcaagcucaagaagaugcugggccccagcgccguggagaucgggaacggcugcuucgagaccaagcacaagugcaaccagaccugccuggaccggaucgccgccgggaccuuugacgcgggcgaguucucccuccccacguucgacucgcugaacaucaccgccgccucccugaacgacgacggccucgacaaccauaccauccugcuguacuacagcaccgccgccuccucgcuggcggucacgcucaugaucgccaucuucgugguguacauggucucccgcgacaacgugagcugcuccaucugccuguga

SEQ ID NO: 15155 - RNA, 1758 nt, Artificial Sequence; identical to SEQ ID NO: 14402
  derived and/or modified CDS sequence (AUadapt) from InfluenzaB__AGX20558__HA

SEQ ID NO: 15156 - RNA, 1758 nt, Artificial Sequence; identical to SEQ ID NO: 14348
  derived and/or modified CDS sequence (AUadapt) from InfluenzaB__AGX20569__HA

SEQ ID NO: 15157 - RNA, 1758 nt, Artificial Sequence; identical to SEQ ID NO: 14118
  derived and/or modified CDS sequence (AUadapt) from InfluenzaB__AGX20580__HA

SEQ ID NO: 15158 - RNA, 1758 nt, Artificial Sequence; identical to SEQ ID NO: 14348
  derived and/or modified CDS sequence (AUadapt) from InfluenzaB__AGX20591__HA

SEQ ID NO: 15159 - RNA, 1758 nt, Artificial Sequence; identical to SEQ ID NO: 14348
  derived and/or modified CDS sequence (AUadapt) from InfluenzaB__AGX20602__HA

SEQ ID NO: 15160 - RNA, 1758 nt, Artificial Sequence; identical to SEQ ID NO: 14348
  derived and/or modified CDS sequence (AUadapt) from InfluenzaB__AGX20613__HA

SEQ ID NO: 15161 - RNA, 1758 nt, Artificial Sequence; identical to SEQ ID NO: 14348
  derived and/or modified CDS sequence (AUadapt) from InfluenzaB__AGX20624__HA

SEQ ID NO: 15162 - RNA, 1758 nt, Artificial Sequence
  derived and/or modified CDS sequence (AUadapt) from InfluenzaB__AGX20635__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagucccacuucgccaaucugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcaugaccggaccaagauccgccagcugcccaaccuccugcggggguacgagcacauccgccugucgacccacaacgugaucaacgccgagaacgcgccgggcgggcccuacaagaucggcaccuccgggagcugucccaacgucacgaacggcaacggcuucuucgccaccauggccugggccgugcccaagaacgacaagaacaagaccgcgaccaacccgcucacgaucgaggugcccuacaucugcaccgagggggaggaucagaucaccgucuggggcuuccacuccgacaacgagacccugauggccaagcuguacggggacucgaagccccagaaguucacguccagcgccaacggcgugaccacccacuaugugucccagaucggcggguuccccaaccagaccgaggacggcgggcucccgcagucgggccggaucgucguggacuacauggugcagaaguccgggaagacgggcaccaucaccuaccagcgcggcauccugcugccccagaaggucuggugcgccagcgggcgguccaaggugaucaagggcucgcucccccugaucggggaggccgacugucugcacgagaaguacggcgggcucaacaagagcaagcccuacuacaccggcgagcacgcgaaggccaucggcaacugcccgaucugggugaagacgccccugaagcuggccaacgggaccaaguaccgcccgcccgccaagcuccugaaggagcggggcuuuuucggggccaucgcgggcuuccuggagggcgggugggagggcaugaucgccggguggcacggcuacaccucccacggggcccacggcgucgccguggccgcggaccucaagucgacccaggaggccaucaacaagaucacgaagaaccugaacucccugagugagcucgaggucaagaaccugcagcgccuguccggcgccauggacgagcuccacaacgagauccuggagcuggacgagaagguggacgaccuccgggccgacaccaucucgucccagaucgagcuggccgugcugcucagcaacgaggggaucaucaauuccgaggacgagcaccuccuggcgcuggagcgcaagcugaagaagaugcugggccccucggccgucgagaucgggaacggcugcuucgagaccaagcacaagugcaaccagaccugccucgaccggaucgccgccgggaccuuugacgcgggcgaguucucccugcccacguucgacagccugaacaucaccgccgccucccucaacgacgacggccuggacaaccauaccauccugcuguacuacucgaccgccgccuccagccucgcggugacgcugaugaucgccaucuucguggucuacauggugucccgcgacaacgugagcugcuccaucugccuguga

SEQ ID NO: 15163 - RNA, 1758 nt, Artificial Sequence; identical to SEQ ID NO: 14348
  derived and/or modified CDS sequence (AUadapt) from InfluenzaB__AGX20646__HA

SEQ ID NO: 15164 - RNA, 1758 nt, Artificial Sequence
  derived and/or modified CDS sequence (AUadapt) from InfluenzaB__AGX20668__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccauuucgccaaccugaaggggacggagacccggggcaagcucugccccaagugccccaacugcaccgaccuggacguggcccuggggcgcccgaagugcaccggcaagauccccuccgcccgggugaguauccuccacgagguccgccccgugacguccggcugcuuccccaucaugcacgaccggaccaagauccgccagcugccgaaccugcuccggggguacgagcacauccgccugagcacccauaacgugaucaacgccgagaacgcgcccggcgggcccuacaagaucggcaccuccgggucgugccccaacgucacgaacggcaacggcuuuuucgccaccauggccugggccgugccgaagaacgacaagaccaagaccgcgacgaacccccugaccaucgaggugcccuacaucugcaccgagggggaggaccagaucaccgucuggggcuuccacuccgauaacgagacgcagauggccaagcucuacggggacagcaagccccagaaguucaccuccucggccaacggcgugaccacccacuacgugucccagaucggcggguuuccgaaccagacggaggacggcgggcugccccagagcggccggaucgucguggacuacauggugcagaaguccgggaagaccggcaccaucaccuaccagcgcggcauccugcucccccagaaggucuggugcgccucggggcgguccaaggugaucaagggcagccugccccugaucggggaggccgacugucuccacgagaaguacggcgggcugaacaagucgaagccguacuacacgggcgagcacgcgaaggccaucggcaacugccccaucugggugaagacgccccugaagcucgccaaugggaccaaguaccggcccccggccaagcugcugaaggagcgcggcuucuucggggccaucgcgggcuuccucgagggcgggugggagggcaugaucgccggguggcacggcuacaccucccacggggcccacggcgucgccguggccgcggaccugaaguccacccaggaggccaucaauaagaucaccaagaaccugaacucccucagcgagcuggaggucaagaaccugcagcgccucuccggcgccauggacgagcugcacaacgagauccuggagcucgacgagaagguggacgaucugcgggccgacaccaucucgucccagaucgagcuggccgugcuccugagcaacgaggggaucaucaacuccgaggacgagcaccuccuggcgcuggagcgcaagcugaagaagaugcucggccccucggccgucgagaucgggaacggcuguuucgagaccaagcacaagugcaaccagaccugccuggaccggaucgccgccgggacguucgacgcgggcgaguucucccugcccaccuuugacagccucaacaucaccgccgccucccugaacgacgacggccuggacaaccacaccauccuccuguauuacucgacggccgccuccagccuggcggugacccugaugaucgccaucuucguggucuacauggugucccgcgacaacgugagcugcuccaucugccucuga

SEQ ID NO: 15165 - RNA, 1758 nt, Artificial Sequence; identical to SEQ ID NO: 14423
  derived and/or modified CDS sequence (AUadapt) from InfluenzaB__AGX20679__HA

SEQ ID NO: 15166 - RNA, 1758 nt, Artificial Sequence; identical to SEQ ID NO: 14118
  derived and/or modified CDS sequence (AUadapt) from InfluenzaB__AGX20690__HA

SEQ ID NO: 15167 - RNA, 1758 nt, Artificial Sequence; identical to SEQ ID NO: 14118
  derived and/or modified CDS sequence (AUadapt) from InfluenzaB__AGX20701__HA

SEQ ID NO: 15168 - RNA, 1758 nt, Artificial Sequence; identical to SEQ ID NO: 14085
  derived and/or modified CDS sequence (AUadapt) from InfluenzaB__AGX20712__HA

SEQ ID NO: 15169 - RNA, 1758 nt, Artificial Sequence; identical to SEQ ID NO: 14348
  derived and/or modified CDS sequence (AUadapt) from InfluenzaB__AGX20723__HA

SEQ ID NO: 15170 - RNA, 1758 nt, Artificial Sequence
  derived and/or modified CDS sequence (AUadapt) from InfluenzaB__AGX20734__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugucccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaucuccugcggggguacgagcacauccgccugucgaccaacaacgugaucaacgccgagaacgcgccgggcgggcccuacaagaucggcaccuccgggagcugccccaacgucacgaacggcaauggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaaugagacccagauggccaagcuguacggggacucgaagccccagaaguucacguccucggccaacggcgugaccacccacuacgugucccagaucggcggguuccccaaccagaccgaggacggcgggcugccgcagagcggccggaucgucguggauuacauggugcagaaguccgggaagacgggcaccaucaccuaccagcgcggcauccuccugccccagaaggucuggugcgccucggggcgguccaaggugaucaagggcagccugccccucaucggggaggccgacugccugcacgagaaguacggcgggcugaacaagucgaagcccuacuauaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaucugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucaguucccagaucgagcucgccgugcugcugucgaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugucuggaccggaucgccgccgggaccuucgacgcgggcgaguucucccuccccacguucgacucgcugaacaucaccgccgccucccugaacgacgacggccucgacaaucacaccauccugcuguacuacagcaccgccgccuccucgcuggcggugacgcucaugaucgccaucuucguggucuacauggugucccgcgacaacgugagcugcuccaucugccuguga

SEQ ID NO: 15171 - RNA, 1758 nt, Artificial Sequence
  derived and/or modified CDS sequence (AUadapt) from InfluenzaB__AGX20745__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuuugccaaccugaaggggacggagacccggggcaagcucugccccaagugccccaacugcaccgaccuggacguggcccuggggcgcccgaagugcaccggcaagauccccuccgcccgggugagcauccuccacgagguccgccccgugacguccggcugcuuucccaucaugcacgaccggaccaagauccgccagcugccgaaccugcuccggggguacgagcacauccgccugucgacccacaacgugaucaacgccgagaacgcgcccggcgggcccuacaagaucggcaccuccgggaguugccccaacgucacgaacggcaacggcuucuucgccaccauggccugggccgugccgaagaacgacaagaacaagaccgcgaccaacccccugacgaucgaggugcccuacaucuguaccgagggggaggaccagaucaccaucuggggcuuccacuccgacaacgagacccagauggccaagcucuacggggacucgaagccccagaaguucacguccucggccaacggcgucaccacccauuacgugucccagaucggcggguucccgaaccagaccgaggacggcgggcugccccagagcggccggaucguggucgacuacauggugcagaaguccgggaagacgggcaccaucaccuaccagcgcggcauccugcucccccagaagguguggugcgccucggggcgguccaaggucaucaagggcagccugccccugaucggggaggccgauugccuccacgagaaguacggcgggcugaacaagucgaagccguacuacaccggcgagcacgcgaaggccaucggcaacugccccaucugggugaagacgccccugaagcucgccaacgggaccaaguaucggcccccggccaagcugcugaaggagcgcggcuucuucggggccaucgcgggcuuccucgagggcgggugggagggcaugaucgccggguggcacggcuacaccucccacggggcccacggcguggccgucgccgcggaccugaaguccacccaggaggccaucaacaagaucacgaagaaccugaacucccucagugagcuggaggugaagaaccugcagcgccucuccggcgccauggacgagcugcacaacgagauccuggagcucgacgagaaggucgacgaccugcgggccgacaccaucucgucccagaucgagcuggccgugcuccugucgaacgaggggaucaucaauuccgaggacgagcaccuccuggcgcuggagcgcaagcugaagaagaugcucggccccagcgccguggagaucgggaacggcugcuucgagaccaagcacaagugcaaccagaccugccuggaccggaucgccgccgggaccuuugacgcgggcgaguucucccugcccacguucgacucgcucaacaucaccgccgccucccugaacgacgacggccuggacaaccauaccauccuccuguacuacagcaccgccgccuccucgcuggcggucacgcugaugaucgccaucuucgugguguacauggucucccgcgacaacgugagcugcuccaucugccucuga

SEQ ID NO: 15172 - RNA, 1758 nt, Artificial Sequence; identical to SEQ ID NO: 14085
  derived and/or modified CDS sequence (AUadapt) from InfluenzaB__AGX20756__HA

SEQ ID NO: 15173 - RNA, 1758 nt, Artificial Sequence; identical to SEQ ID NO: 14348
  derived and/or modified CDS sequence (AUadapt) from InfluenzaB__AGX20767__HA

SEQ ID NO: 15174 - RNA, 1758 nt, Artificial Sequence; identical to SEQ ID NO: 14118
  derived and/or modified CDS sequence (AUadapt) from InfluenzaB__AGX20778__HA

SEQ ID NO: 15175 - RNA, 1758 nt, Artificial Sequence
  derived and/or modified CDS sequence (AUadapt) from InfluenzaB__AGX20789__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagucacuucgccaaccugaaggggacggagacccggggcaagcucugccccaagugccccaacugcaccgaccuggauguggcccuggggcgcccgaagugcaccggcaagauccccuccgcccgggugucgauccuccacgagguccgccccgugacguccggcugcuuccccaucaugcacgaccggaccaagauccgccagcugccgaaccugcuccggggguacgagcauauccgccugagcacccacaacgugaucaacgccgagaacgcgcccggcgggcccuacaagaucggcaccuccgggagcugccccaaugucacgaacggcaacggcuucuucgccaccauggccugggccgugccgaagaacgacaagaacaagaccgcgaccaacccccugacgaucgaggugcccuacaucuguaccgagggggaggaccagaucaccgucuggggcuuccacuccgacaacgagacccagauggccaagcucuacggggacucgaagccccagaaguuuacguccagcgccaacggcgugaccacccacuacgugucccagaucggcggguucccgaaccagaccgaggacggcgggcugccccagucgggccggaucgucguggacuauauggugcagaaguccgggaagacgggcaccaucaccuaccagcgcggcauccugcucccccagaaggucuggugcgccagcgggcgguccaaggugaucaagggcucgcugccccugaucggggaggccgacugccuccacgagaaguacggcgggcugaauaagagcaagccguacuacaccggcgagcacgcgaaggccaucggcaacugccccaucugggugaagacgccccugaagcucgccaacgggaccaaguaccggcccccggccaagcugcugaaggagcgcggcuucuuuggggccaucgcgggcuuccucgagggcgggugggagggcaugaucgccggguggcacggcuacaccucccacggggcccacggcgucgccguggccgcggaccugaaguccacccaggaggccaucaacaagaucacgaagaaccugaauucccucagcgagcuggaggucaagaaccugcagcgccucuccggcgccauggacgagcugcacggggagauccuggagcucgacgagaagguggacgaccugcgggccgacaccaucucgucccagaucgagcuggccgugcuccugaguaacgagggcaucaucaacuccgaggacgagcaccuccuggcgcuggagcgcaagcugaagaagaugcucgggcccucggccgucgagaucggcaacgggugcuucgagaccaagcauaagugcaaccagaccugccuggaccggaucgccgccggcaccuucgacgcgggcgaguucucccugcccacguucgacagucucaacaucaccgccgccucccugaacgacgacgggcuggacaaccacaccauccuccuguacuauucgaccgccgccuccagccuggcggugacgcugaugaucgccaucuucguggucuacauggugucccgcgacaacgugagcugcuccaucugccucuga

SEQ ID NO: 15176 - RNA, 1758 nt, Artificial Sequence
  derived and/or modified CDS sequence (AUadapt) from InfluenzaB__AGX20800__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuuugccaaccugaaggggacggagacccggggcaagcucugccccaagugccccaacugcaccgaccuggacguggcccuggggcgcccgaagugcaccggcaagauccccuccgcccgggugagcauccuccacgagguccgccccgugacguccggcugcuuucccaucaugcacgaccggaccaagauccgccagcugccgaaccugcuccggggguacgagcacauccgccugucgacccacaacgugaucaacgccgagaacgcgcccggcgggcccuacaagaucggcaccuccgggaguugccccaacgucacgaacggcaacggcuucuucgccaccauggccugggccgugccgaagaacgacaagaacaagaccgcgaccaacccccugacgaucgaggugcccuacaucuguaccgagggggaggaccagaucaccgucuggggcuuccacuccgacaacgagacccagauggccaagcucuacggggacucgaagccccagaaguucacguccucggccaacggcgugaccacccauuacgugucccagaucggcggguucccgaaccagaccgaggacggcgggcugccccagagcggccggaucgucguggacuacauggugcagaaguccgggaagacgggcaccaucaccuaccagcgcggcauccugcucccccagaaggucuggugcgccucggggcgguccaaggugaucaagggcagccugccccugaucggggaggccgauugccuccacgagaaguacggcgggcugaacaagucgaagccguacuacaccggcgagcacgcgaaggccaucggcaacugccccaucugggugaagacgccccugaagcucgccaacgggaccaaguaucggcccccggccaagcugcugaaggagcgcggcuucuucggggccaucgcgggcuuccucgagggcgggugggagggcaugaucgccggguggcacggcuacaccucccacggggcccacggcgucgccguggccgcggaccugaaguccacccaggaggccaucaacaagaucacgaagaaccugaacucccucagugagcuggaggucaagaaccugcagcgccucuccggcgccauggacgagcugcacaacgagauccuggagcucgacgagaagguggacgaccugcgggccgacaccaucucgucccagaucgagcuggccgugcuccugucgaacgaggggaucaucaauuccgaggacgagcaccuccuggcgcuggagcgcaagcugaagaagaugcucggccccagcgccgucgagaucgggaacggcugcuucgagaccaagcacaagugcaaccagaccugccuggaccggaucgccgccgggaccuuugacgcgggcgaguucucccugcccacguucgacucgcucaacaucaccgccgccucccugaacgacgacgagcuggacaaccauaccauccuccuguacuacagcaccgccgccuccucgcuggcggugacgcugaugaucgccaucuucguggucuacauggugucccgcgacaacgugagcugcuccaucugccucuga

SEQ ID NO: 15177 - RNA, 1758 nt, Artificial Sequence; identical to SEQ ID NO: 14423
  derived and/or modified CDS sequence (AUadapt) from InfluenzaB__AGX20811__HA

SEQ ID NO: 15178 - RNA, 1758 nt, Artificial Sequence; identical to SEQ ID NO: 14423
  derived and/or modified CDS sequence (AUadapt) from InfluenzaB__AGX20822__HA

SEQ ID NO: 15179 - RNA, 1758 nt, Artificial Sequence; identical to SEQ ID NO: 14423
  derived and/or modified CDS sequence (AUadapt) from InfluenzaB__AGX20833__HA

SEQ ID NO: 15180 - RNA, 1758 nt, Artificial Sequence
  derived and/or modified CDS sequence (AUadapt) from InfluenzaB__AGX20844__HA
augaaggccaucaucgugcugcucauggucgugaccaguaacgccgaccgcaucugcaccggcaucacguccucgaacagcccccacaucgugaagaccgcgacccagggggaggucaacgugaccggcgugaucccgcugacgaccacccccaccaagucgcacuucgccaaccugaaggggacggagacccggggcaagcucugccccaagugccugaauugcaccgaccuggacgucgcccucgggcgccccaagugcaugggcaagaucccguccgcccgggugucgauccugcacgaggugcgccccgucaccuccggcugcuuccccaucaugcacgaccggacgaagauccgccagcugcccaaccuccugcggggguacgagcacauccgccugagcacccacaaugugaucaacgccgagaacgcgccgggcgggcccuacaagaucggcaccuccgggucgugccccaacaucaccaacggcaacggcuucuucgccacgauggccugggccgugcccaagaacgacaagaacaagaccgcgaccaacccgcucaccaucgagguccccuacaucuguacggagggggaggaccagaucaccguguggggcuuccacuccgacaacgagacccagauggccaagcuguacggggacagcaagccccagaaguucaccuccucggccaacggcgugacgacccacuacgucucccagaucggcggguuccccaaccagaccgaggauggcgggcugccgcagucgggccggaucgugguggacuacaugguccagaaguccgggaagaccggcacgaucaccuaccagcgcggcauccuccugccccagaagguguggugcgccagcgggcgguccaaggugaucaagggcucgcugccccucaucggggaggccgacugccugcacgagaaguacggcgggcugaacaagucgaagcccuacuacaccggcgagcaugcgaaggccaucggcaacugcccgaucugggucaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcguggccguggccgcggaccugaaguccacccaggaggccaucaacaagaucaccaagaaccucaacucccugagugagcuggaggucaagaaccuccagcgccuguccggcgccauggacgagcugcacaacgagauccucgagcuggacgagaagguggacgaccugcgggccgacacgaucucgucccagaucgagcucgccguccugcugagcaacgaggggaucaucaacuccgaggacgagcaccuccuggcgcuggagcgcaagcucaagaagaugcugggccccucggccguggagaucgggaauggcugcuucgagaccaagcacaagugcaaccagaccugccuggaccggaucgccgccgggaccuucgacgcgggcgaguucucccuccccaccuucgacucgcugaacaucacggccgccucccugaacgaugacggccucgacaaccacaccauccugcuguacuacagcaccgccgccuccucgcuggcggugacccucaugaucgccaucuucgucguguacauggugucccgcgacaacgucagcugcuccaucugccuguga

SEQ ID NO: 15181 - RNA, 1758 nt, Artificial Sequence; identical to SEQ ID NO: 14348
  derived and/or modified CDS sequence (AUadapt) from InfluenzaB__AGX20855__HA

SEQ ID NO: 15182 - RNA, 1758 nt, Artificial Sequence; identical to SEQ ID NO: 14423
  derived and/or modified CDS sequence (AUadapt) from InfluenzaB__AGX20866__HA

SEQ ID NO: 15183 - RNA, 1758 nt, Artificial Sequence; identical to SEQ ID NO: 14423
  derived and/or modified CDS sequence (AUadapt) from InfluenzaB__AGX20877__HA

SEQ ID NO: 15184 - RNA, 1758 nt, Artificial Sequence
  derived and/or modified CDS sequence (AUadapt) from InfluenzaB__AGX20888__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccauuucgccaaccugaaggggacggagacccggggcaagcucugccccaagugccccaacugcaccgaccuggacguggcccuggggcgcccgaagugcaccggcaagauccccuccgcccgggugaguauccuccacgagguccgccccgugacguccggcugcuuccccaucaugcacgaccggaccaagauccgccagcugccgaaccugcuccggggguacgagcacauccgccugagcacccauaacgugaucaacgccgagaacgcgcccggcgggcccuacaagaucggcaccuccgggucgugccccaacgucacgaacggcaacggcuuuuucgccaccauggccugggccgugccgaagaacgacaagaacaagaccgcgaccaacccccugacgaucgaggugcccuacaucugcaccgagggggaggaccagaucaccgucuggggcuuccacuccgauagcgagacccagauggccaagcucuacggggacuccaagccccagaaguucacgucguccgccaacggcgugaccacccacuacgugagccagaucggcggguuuccgaaccagaccgaggacggcgggcugccccaguccggccggaucgucguggacuacauggugcagaaguccgggaagacgggcaccaucaccuaccagcgcggcauccugcucccccagaaggucuggugcgccuccgggcggagcaaggugaucaagggcucgcugccccugaucggggaggccgacugucuccacgagaaguacggcgggcugaacaaguccaagccguacuacaccggcgagcacgcgaaggccaucggcaacugccccaucugggugaagacgccccugaagcucgccaacgggaccaaguaucggcccccggccaagcugcugaaggagcgcggcuucuucggggccaucgcgggcuuccucgagggcgggugggagggcaugaucgccggguggcacggcuacaccagccacggggcccacggcgucgccguggccgcggaccugaaguccacccaggaggccaucaauaagaucacgaagaaccugaacucgcucuccgagcuggaggucaagaaccugcagcgccucagcggcgccauggacgagcugcacaacgagauccuggagcucgacgagaagguggacgaucugcgggccgacaccaucuccucgcagaucgagcuggccgugcuccuguccaacgaggggaucaucaacagcgaggacgagcaccuccuggcgcuggagcgcaagcugaagaagaugcucggccccuccgccgucgagaucgggaacggcugcuuugagaccaagcacaagugcaaccagaccugccuggaccggaucgccgccgggaccuucgacgcgggcgaguucucgcugcccacguuugacucccucaacaucaccgccgccagccugaacgacgacggccuggacaaccacaccauccuccuguauuacuccaccgccgccucgucccuggcggugacgcugaugaucgccaucuucguggucuacauggugagccgcgacaacguguccugcagcaucugccucuga

SEQ ID NO: 15185 - RNA, 1758 nt, Artificial Sequence; identical to SEQ ID NO: 14423
  derived and/or modified CDS sequence (AUadapt) from InfluenzaB__AGX20899__HA

SEQ ID NO: 15186 - RNA, 1758 nt, Artificial Sequence; identical to SEQ ID NO: 14423
  derived and/or modified CDS sequence (AUadapt) from InfluenzaB__AGX20910__HA

SEQ ID NO: 15187 - RNA, 1758 nt, Artificial Sequence; identical to SEQ ID NO: 14348
  derived and/or modified CDS sequence (AUadapt) from InfluenzaB__AGX20921__HA

SEQ ID NO: 15188 - RNA, 1758 nt, Artificial Sequence
  derived and/or modified CDS sequence (AUadapt) from InfluenzaB__AGX20932__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcauuucgccaaccugaaggggacggagacccggggcaagcucugccccaagugccccaacugcaccgaccuggacguggcccuggggcgcccgaagugcaccggcaagauccccuccgcccgggugaguauccuccacgagguccgccccgugacguccggcugcuuccccaucaugcacgaccggaccaagauccgccagcugccgaaccugcuccggggguacgagcacauccgccugucgacccauaacgugaucaacgccgagaacgcgcccggcgggcccuacaagaucggcaccuccgggagcugccccaacgucacgaacggcaacggcuuuuucgccaccauggccugggccgugccgaagaacgacaagaacaagaccgcgaccaacccccugacgaucgaggugcccuacaucugcaccgagggggaggaccagaucaccgucuggggcuuccacuccgauaacgagacccagauggccaagcucuacggggaccccaagccgcagaaguucacgucguccgccaacggcgugaccacccacuacgugagccagaucggcggguuucccaaccagaccgaggacggcgggcugccccaguccggccggaucgucguggacuacauggugcagaaguccgggaagacgggcaccaucaccuaccagcgcggcauccugcucccccagaaggucuggugcgccuccgggcggucgaaggugaucaagggcucccugccgcugaucggggaggccgacugccuccaugagaaguacggcgggcugaacaagagcaagcccuacuacaccggcgagcacgcgaaggccaucggcaacugccccaucugggugaagacgccccugaagcucgccaacgggaccaaguaucgcccgcccgccaagcugcugaaggagcggggcuucuucggggccaucgcgggcuuccucgagggcgggugggagggcaugaucgccggguggcacggcuacaccucgcacggggcccacggcgucgccguggccgcggaccugaaguccacccaggaggccaucaauaagaucacgaagaaccugaacagccucuccgagcuggaggucaagaaccugcagcgccucucgggcgccauggacgagcugcacaacgagauccuggagcucgacgagaagguggacgaucugcgggccgacaccaucuccagccagaucgagcuggccgugcuccuguccaacgaggggaucaucaacucggaggacgagcaccuccuggcgcuggagcgcaagcugaagaagaugcucggccccuccgccgucgagaucgggaacggcugcuuugagaccaagcacaagugcaaccagaccugccuggaccggaucgccgccgggaccuucgacgcgggcgaguucagccugcccacguuugacucccucaacaucaccgccgccucgcugaacgacgacggccuggacaaccacaccauccuccuguauuacuccaccgccgccagcucccuggcggugacgcugaugaucgccaucuucguggucuacauggugucgcgcgacaacguguccugcagcaucugccucuga

SEQ ID NO: 15189 - RNA, 1758 nt, Artificial Sequence; identical to SEQ ID NO: 14348
  derived and/or modified CDS sequence (AUadapt) from InfluenzaB__AGX20943__HA

SEQ ID NO: 15190 - RNA, 1758 nt, Artificial Sequence; identical to SEQ ID NO: 14348
  derived and/or modified CDS sequence (AUadapt) from InfluenzaB__AGX20954__HA

SEQ ID NO: 15191 - RNA, 1758 nt, Artificial Sequence; identical to SEQ ID NO: 14348
  derived and/or modified CDS sequence (AUadapt) from InfluenzaB__AGX20965__HA

SEQ ID NO: 15192 - RNA, 1758 nt, Artificial Sequence
  derived and/or modified CDS sequence (AUadapt) from InfluenzaB__AGX20976__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccauuucgccaaccugaaggggacggagacccggggcaagcucugccccaagugccugaacugcaccgaccuggacguggcccucgggcgccccaagugcaccggcaagaucccguccgcccgggugaguauccugcacgagguccgccccgugacguccggcugcuuccccaucaugcacgaccggaccaagauccgccagcugcccaaccuccugcggggguacgagcacauccgccugagcacccauaacgugaucaacgccgagaacgcgccgggcgggcccuacaagaucggcaccuccgggagcugccccaacgucacgaacggcaacggcuuuuucgccaccauggccugggccgugcccaagaacgacaagaacaagaccgcgaccaacccgcucacgaucgaggugcccuacaucugcaccgagggggaggaccagaucaccgucuggggcuuccauuccgacaacgagacccagauggccaagcuguacggggacucgaagccccagaaguucacguccagcgccaacggcgugaccacccacuaugugucccagaucggcggguuccccaaccagaccgaggacggcgggcugccgcagucgggccggaucgucguggacuacauggugcagaaguccgggaagacgggcaccaucaccuaccagcgcggcauccuccugccccagaaggucuggugcgccagcgggcgguccaaggugaucaagggcucgcugccccucaucggggaggccgauugccugcacgagaaguacggcgggcugaacaagagcaagcccuacuacaccggcgagcacgcgaaggccaucggcaacuguccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaucugaaguccacccaggaggccaucaacaagaucacgaagaaccucaacucccugagcgagcuggaggucaagaaccuccagcgccuguccggcgccauggacgagcugcacggggagauccucgagcuggacgagaagguggacgaucugcgggccgacaccaucucgucccagaucgagcucgccgugcugcugagcaacgagggcaucaucaacuccgaggacgagcaccuccuggcgcuggagcgcaagcucaagaagaugcuggggcccucggccgucgagaucggcaacggguguuucgagaccaagcacaagugcaaccagaccugccuggaccggaucgccgccggcaccuucgacgcgggcgaguucucccuccccacguuugacagccugaacaucaccgccgccucccugaacgacgacgggcucgacaaccacaccauccugcuguauuacucgaccgccgccuccagccuggcggugacgcucaugaucgccaucuucguggucuacauggugucccgcgacaacgugagcugcuccaucugccuguga

SEQ ID NO: 15193 - RNA, 1758 nt, Artificial Sequence; identical to SEQ ID NO: 14348
  derived and/or modified CDS sequence (AUadapt) from InfluenzaB__AGX20987__HA

SEQ ID NO: 15194 - RNA, 1758 nt, Artificial Sequence; identical to SEQ ID NO: 14423
  derived and/or modified CDS sequence (AUadapt) from InfluenzaB__AGX20998__HA

SEQ ID NO: 15195 - RNA, 1758 nt, Artificial Sequence
  derived and/or modified CDS sequence (AUadapt) from InfluenzaB__AGX21009__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuuugccaaccugaaggggacggagacccggggcaagcucugccccaagugccccaacugcaccgaccuggacguggcccuggggcgcccgaagugcaccggcaagauccccuccgcccgggugagcauccuccacgagguccgccccgugacguccggcugcuuucccaucaugcacgaccggaccaagauccgccagcugccgaaccugcuccggggguacgagcacauccgccugucgacccacaacgugaucaacgccgagaacgcgcccggcgggcccuacaagaucggcaccuccgggaguugccccaacgucacgaacggcaacggcuucuucgccaccauggccugggccgugccgaagaacgacaagaacaagaccgcgaccaacccccugacgaucgaggugcccuacaucuguaccgagggggaggaccagaucaccgucuggggcuuccacuccgacaacgagacccagauggccaagcucuacggggacucgaagccccagaaguucacguccucggccaacggcgugaccacccauuacgugucccagaucggcggguucccgaaccagaccgaggacggcgggcugccccagagcggccggaucgucguggacuacauggugcagaaguccgggaagacgggcaccaucaccuaccagcgcggcauccugcucccccagaaggucuggugcgccucggggcgguccaaggugaucaagggcagccugccccugaucggggaggccgauugccuccacgagaaguacggcgggcugaacaagucgaagccguacuacaccggcgagcacgcgaaggccaucggcaacugccccaucugggugaagacgccccugaagcucgccaacgggaccaaguaucggcccccggccaagcugcugaaggagcgcggcuucuucggggccaucgcgggcuuccucgagggcgggugggagggcaugaucgccggguggcacggcuacaccucccacggggcccacggcgucgccguggccgcggaccugaaguccacccaggaggccaucaacaagaucacgaagaaccugaacucccucagugagcuggaggucaagaaccugcagcgccucuccggcgccauggacgagcugcacaacgagauccuggagcucgacgagaagguggacgaccugcgggccgacaccaucucgucccagaucgagcuggccgugcuccugucgaacgaggggaucaucaauuccgaggacgagcaccuccuggcgcuggagcgcaagcugaagaagaugcucggccccagcgccgucgagaucgggaacggcugcuucgagaccaagcacaagugcaaccagaccugccuggaccggaucgccgccgggaccuuugacgcgggcgaguucucccugcccacguucgacucgcucaacaucaccgccgccucccugaacgacgacggccuggacaaccauaccauccuccuguacuacagcaccgccgccuccucgcuggcggugacgcugaugaucgccaucuucguggucuacaugaucucccgcgacaacgugagcugcuccaucugccucuga

SEQ ID NO: 15196 - RNA, 1758 nt, Artificial Sequence
  derived and/or modified CDS sequence (AUadapt) from InfluenzaB__AGX21020__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccacuuugccaaccugaaggggacggagacccggggcaagcucugccccaagugccugaacugcaccgaccuggacguggcccucgggcgccccaagugcaccggcaagaucccguccgcccgggugucgauccugcacgagguccgccccgugacguccggcuguuuccccaucaugcacgaccggaccaagauccgccagcugcccaaccuccugcggggguacgagcacauccgccugagcacccacaacgugaucaacgccgagaaugcgccgggcgggcccuacaagaucggcaccuccgggucgugccccaacgucacgaacggcaacggcuucuucgccaccauggccugggccgugcccaagaacgacaagaauaagaccgcgaccaacccgcucacgaucgaggugcccuacaucugcaccgagggggaggaccagaucaccgucuggggcuuccacuccgacaacgagacccagauggccaagcuguacggggacagugagccccagaaguucacguccucggccaacggcgugaccacccacuacgugucccagaucggcggguuccccaaccagaccgaggacggcgggcugccgcagagcggccggaucgucguggacuauauggugcagaaguccgggaagacgggcaccaucaccuaccagcgcggcauccuccugccccagaaggucuggugcgccucggggcgguccaaggugaucaagggcagccugccccucaucggggaggccgacugccugcacgagaaguacggcgggcugaacaagucgaagcccuauuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuauaccucccacggggcccacggcgucgccguggccgcggaccugaaguccacccaggaggccaucaacaagaucacgaagaaccucaacucccugagcgagcuggaggucaagaaccuccagcgccuguccggcgccauggacgagcugcacaaugagauccucgagcuggacgagaagguggacgaccugcgggccgacaccaucucgucccagaucgagcucgccgugcugcugagcaacgaggggaucaucaacuccgaggacgagcaccuccuggcgcuggagcgcaagcucaagaagaugcugggccccagugccgucgagaucgggaacggcugcuucgagaccaagcacaagugcaaccagaccugccuggaccggaucgccgccgggaccuucgacgcgggcgaguuuucccuccccacguucgacagccugaacaucaccgccgccucccugaacgacgacggccucgacaaccacaccauccugcuguauuacucgaccgccgccuccagccuggcggugacgcucaugaucgccaucuucguggucuacauggugucccgcgacaacgugagcugcuccaucugccuguga

SEQ ID NO: 15197 - RNA, 1758 nt, Artificial Sequence; identical to SEQ ID NO: 14423
  derived and/or modified CDS sequence (AUadapt) from InfluenzaB__AGX21031__HA

SEQ ID NO: 15198 - RNA, 1758 nt, Artificial Sequence
  derived and/or modified CDS sequence (AUadapt) from InfluenzaB__AGX21042__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugucccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaucuccugcggggguacgagcacauccgccugucgacccacaacgugaucaacaccgagaacgccccgggcgggcccuacaagaucggcacguccgggagcugccccaacgucaccaacggcaauggcuucuucgcgaccauggccugggccgugcccaagaacgacaagaacaagaccgccacgaacccgcucaccaucgaggugcccuacaucugcaccgagggggaggaccagaucaccgucuggggcuuccacuccgacaaugagacgcagauggcgaagcuguacggggacucgaagccccagaaguucaccuccucggccaacggcgugaccacccacuacgugucccagaucggcggguuccccaaccagacggaggacggcgggcugccgcagagcggccggaucgucguggauuacauggugcagaaguccgggaagaccggcaccaucaccuaccagcgcggcauccuccugccccagaaggucuggugcgccucggggcgguccaaggugaucaagggcagccugccccucaucggggaggccgacugccugcacgagaaguacggcgggcugaacaagucgaagcccuacuauacgggcgagcacgccaaggcgaucggcaacugcccgaucugggugaagacgccccucaagcuggccaacgggaccaaguaccgcccgcccgccaagcugcucaaggagcggggcuucuucggggccaucgccggcuuccuggagggcgggugggagggcaugaucgcgggguggcacggcuacaccucccacggggcccacggcgucgccguggccgccgaucugaaguccacccaggaggcgaucaacaagaucaccaagaaccucaacucccugagcgagcuggaggucaagaaccuccagcgccuguccggcgccauggacgagcugcacaacgagauccucgagcuggacgagaagguggacgaccugcgggccgacaccaucaguucccagaucgagcucgccgugcugcugucgaacgaggggaucaucaacuccgaggacgagcaccuccuggcccuggagcgcaagcucaagaagaugcugggccccagcgcggucgagaucgggaacggcugcuucgagaccaagcacaagugcaaccagaccugucuggaccggaucgccgccgggacguucgacgccggcgaguucucccuccccaccuucgacucgcugaacaucaccgcggccucccugaacgacgacggccucgacaaucacaccauccugcuguacuacagcacggccgccuccucgcuggccgugacccucaugaucgcgaucuucguggucuacauggugucccgcgacaacgugagcugcuccaucugccuguga

SEQ ID NO: 15199 - RNA, 1758 nt, Artificial Sequence; identical to SEQ ID NO: 14118
  derived and/or modified CDS sequence (AUadapt) from InfluenzaB__AGX21053__HA

SEQ ID NO: 15200 - RNA, 1758 nt, Artificial Sequence; identical to SEQ ID NO: 14348
  derived and/or modified CDS sequence (AUadapt) from InfluenzaB__AGX21064__HA

SEQ ID NO: 15201 - RNA, 1758 nt, Artificial Sequence; identical to SEQ ID NO: 14118
  derived and/or modified CDS sequence (AUadapt) from InfluenzaB__AGX21075__HA

SEQ ID NO: 15202 - RNA, 1758 nt, Artificial Sequence; identical to SEQ ID NO: 14118
  derived and/or modified CDS sequence (AUadapt) from InfluenzaB__AGX21084__HA

SEQ ID NO: 15203 - RNA, 1758 nt, Artificial Sequence; identical to SEQ ID NO: 14118
  derived and/or modified CDS sequence (AUadapt) from InfluenzaB__AGX21095__HA

SEQ ID NO: 15204 - RNA, 1758 nt, Artificial Sequence
  derived and/or modified CDS sequence (AUadapt) from InfluenzaB__AGX21106__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccauuucgccaaccugaaggggacggagacccggggcaagcucugccccaagugccccaacugcaccgaccuggacguggcccuggggcgcccgaagugcaccggcaagauccccuccgcccgggugaguauccuccacgagguccgccccgugacguccggcugcuuccccaucaugcacgaccggaccaagauccgccagcugccgaaccugcuccggggguacgagcacauccgccugagcacccauaacgugaucaacgccgagaacgcgcccggcgggcccuacaagaucggcaccuccgggucgugccccaacgucacgaacggcaacggcuuuuucgccaccauggccugggccgugccgaagaacgacaagaacaagaccgcgaccaacccccugacgaucgaggugcccuacaucugcaccgagggggaggaccagaucaccgucuggggcuuccacuccgauaacgaggcccagauggccaagcucuacggggacagcaagccccagaaguucaccuccucggccaacggcgugacgacccacuacgugucccagaucggcggguuuccgaaccagaccgaggacggcgggcugccccagagcggccggaucgucguggacuacauggugcagaaguccgggaagaccggcacgaucaccuaccagcgcggcauccugcucccccagaaggucuggugcgccucggggcgguccaaggugaucaagggcagccugccccugaucggggaggcggauugccuccacgagaaguacggcgggcugaacaagucgaagccguacuacaccggcgagcacgccaaggccaucggcaacugucccaucugggugaagacgccccugaagcucgccaacgggaccaaguaccggcccccggccaagcugcugaaggagcgcggcuucuucggggcgaucgccggcuuccucgagggcgggugggagggcaugaucgccggguggcacggcuacaccucccacggggcccacggcgucgccguggcggccgaucugaaguccacccaggaggccaucaacaagaucaccaagaaccugaacucccucagcgagcuggaggucaagaaccugcagcgccucuccggcgccauggacgagcugcacaacgagauccuggagcucgacgagaagguggacgaucugcgggccgacacgaucucgucccagaucgagcuggcggugcuccugagcaacgaggggaucaucaacuccgaggacgagcaccuccuggcccuggagcgcaagcugaagaagaugcucggccccucggccgucgagaucgggaacggcuguuucgagaccaagcacaagugcaaccagaccugccuggaccggaucgccgcggggaccuucgacgccggcgaguucucccugcccaccuuugacagccucaacaucacggccgccucccugaacgacgacggccuggacaaccacaccauccuccuguauuacucgaccgccgcguccagccuggccgugacccugaugaucgccaucuucguggucuacauggugucccgcgacaacgugagcugcuccaucugccucuga

SEQ ID NO: 15205 - RNA, 1758 nt, Artificial Sequence; identical to SEQ ID NO: 14348
  derived and/or modified CDS sequence (AUadapt) from InfluenzaB__AGX21117__HA

SEQ ID NO: 15206 - RNA, 1758 nt, Artificial Sequence; identical to SEQ ID NO: 15198
  derived and/or modified CDS sequence (AUadapt) from InfluenzaB__AGX21128__HA

SEQ ID NO: 15207 - RNA, 1758 nt, Artificial Sequence
  derived and/or modified CDS sequence (AUadapt) from InfluenzaB__AGX21139__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaucugaaggggacggagacccggggcaagcucugccccaagugccccaacugcaccgaccuggacguggcccuggggcgcccgaagugcaccggcaagauccccuccgcccgggugagcauccuccacgagguccgccccgugacguccggcugcuuccccaucaugcaugaccggaccaagauccgccagcugccgaaccugcuccggggguacgagcacauccgccugucgacccacaacgugaucaacgccgagaacgcgcccggcgggcccuacaagaucggcaccuccgggagcugucccaacgucacgaacggcaacggcuucuucgccaccauggccugggccgugccgaagaacgacaagaacaagaccgcgaccaacccccugacgaucgaggugcccuacaucugcaccgagggggaggaucagaucaccgucuggggcuuccacuccgacaacgagacccagauggccaagcucuacggggacucgaagccccagaaguucacguccucggccaacggcgugaccacccacuaugugucccagaucggcgacuucccgaaccagaccgaggacgggggccugccccagagcgggcggaucgucguggacuacauggugcagaaguccggcaagacggggaccaucaccuaccagcgcggcauccugcucccccagaaggucuggugcgccucgggccgguccaaggugaucaaggggagccugccccugaucggcgaggccgauugccuccacgagaaguacgggggccugaacaagucgaagccguacuacaccggggagcacgcgaaggccaucggcaacugccccaucugggugaagacgccccugaagcucgccaacggcaccaaguaucggcccccggccaagcugcugaaggagcgcggguucuucggcgccaucgcgggguuccucgagggcgggugggagggcaugaucgccggcuggcacggguacaccucccacggcgcccacggggucgccguggccgcggaccugaaguccacccaggaggccaucaacaagaucacgaagaaccugaacucccucagugagcuggaggucaagaaccugcagcgccucuccggcgccauggacgagcugcacaacgagauccuggagcucgacgagaagguggacgaccugcgggccgacaccaucucgucccagaucgagcuggccgugcuccugucgaacgagggcaucaucaauuccgaggacgagcaccuccuggcgcuggagcgcaagcugaagaagaugcucgggcccagcgccgucgagaucggcaacgggugcuucgagaccaagcacaagugcaaccagaccugccuggaccggaucgccgccggcaccuuugacgcgggggaguucucccugcccacguucgacucgcucaacaucaccgccgccucccugaacgacgacggccuggacaaccauaccauccuccuguacuacagcaccgccgccuccucgcuggcggugacgcugaugaucgccaucuucguggucuacauggugucccgcgacaacgugagcugcuccaucugccucuga

SEQ ID NO: 15208 - RNA, 1758 nt, Artificial Sequence; identical to SEQ ID NO: 14423
  derived and/or modified CDS sequence (AUadapt) from InfluenzaB__AGX21150__HA

SEQ ID NO: 15209 - RNA, 1758 nt, Artificial Sequence; identical to SEQ ID NO: 14348
  derived and/or modified CDS sequence (AUadapt) from InfluenzaB__AGX21161__HA

SEQ ID NO: 15210 - RNA, 1758 nt, Artificial Sequence; identical to SEQ ID NO: 14423
  derived and/or modified CDS sequence (AUadapt) from InfluenzaB__AGX21172__HA

SEQ ID NO: 15211 - RNA, 1758 nt, Artificial Sequence; identical to SEQ ID NO: 14118
  derived and/or modified CDS sequence (AUadapt) from InfluenzaB__AGX21183__HA

SEQ ID NO: 15212 - RNA, 1758 nt, Artificial Sequence; identical to SEQ ID NO: 14423
  derived and/or modified CDS sequence (AUadapt) from InfluenzaB__AGX21194__HA

SEQ ID NO: 15213 - RNA, 1758 nt, Artificial Sequence
  derived and/or modified CDS sequence (AUadapt) from InfluenzaB__AGX21205__HA
augaaggccaucaucgugcugcucauggucgugaccaguaacgccgaccgcaucugcaccggcaucacguccucgaacagcccccacaucgugaagaccgcgacccagggggaggucaacgugaccggcgugaucccgcugacgaccacccccaccaagucgcacuucgccaaccugaaggggacggagacccggggcaagcucugccccaagugccugaauugcaccgaccuggacgucgcccucgggcgccccaagugcaccggcaagaucccguccgcccgggugucgauccugcacgaggugcgccccgucacguccggcugcuuccccaucaugcacgaccggaccaagauccgccagcugcccaaccuccugcggggguacgagcacauccgccugagcacccacaaugugaucaacgccaagaacgcgccgggcgggcccuacaagaucggcaccuccgggucgugccccaacaucacgaacggcaacggcuucuucgccaccauggccugggccgugcccaagaacgacaagaacaagaccgcgaccaacccgcucacgaucgagguccccuacaucuguaccgagggggaggaccagaucaccguguggggcuuccacuccgacaacgagacccagauggccaagcuguacggggacucgaagccccagaaguucacguccagcgccaacggcgugaccacccacuacgucucccagaucggcggguuccccaaccagaccgaggauggcgggcugccgcagucgggccggaucgugguggacuacaugguccagaaguccgggaagacgggcaccaucaccuaccagcgcggcauccuccugccccagaagguguggugcgccucggggcgguccaaggugaucaagggcagccugccccucaucggggaggccgacugccugcacgagaaguacggcgggcugaacaagucgaagcccuacuacaccggcgagcaugcgaaggccaucggcaacugcccgaucugggucaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcguggccguggccgcggaccugaaguccacccaggaggccaucaacaagaucacgaagaaccucaacucccugagugagcuggaggucaagaaccuccagcgccuguccggcgccauggacgagcugcacaacgagauccucgagcuggacgagaagguggacgaccugcgggccgacaccaucagcucccagaucgagcucgccguccugcugucgaacgaggggaucaucaacuccgaggacgagcaccuccuggcgcuggagcgcaagcucaagaagaugcugggccccucggccguggagaucgggaauggcugcuucgagaccaagcacaagugcaaccagaccugccuggaccggaucgccgccgggaccuucgacgcgggcgaguucucccuccccacguucgacagccugaacaucaccgccgccucccugaacgaugacggccucgacaaccacaccauccugcuguacuacucgaccgccgccuccucgcuggcggugacgcucaugaucgccaucuucgucguguacauggugucccgcgacaacgucagcugcuccaucugccuguga

SEQ ID NO: 15214 - RNA, 1758 nt, Artificial Sequence; identical to SEQ ID NO: 14118
  derived and/or modified CDS sequence (AUadapt) from InfluenzaB__AGX21216__HA

SEQ ID NO: 15215 - RNA, 1758 nt, Artificial Sequence; identical to SEQ ID NO: 14348
  derived and/or modified CDS sequence (AUadapt) from InfluenzaB__AGX21227__HA

SEQ ID NO: 15216 - RNA, 1758 nt, Artificial Sequence
  derived and/or modified CDS sequence (AUadapt) from InfluenzaB__AGX21238__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucccacuucgccaaccugaaggggacggagacccggggcaagcucugccccaagugccugaauugcaccgaccuggacguggcccucgggcgccccaagugcaccggcaagaucccguccgcccgggugucgauccugcacgagguccgccccgugacguccggcugcuuccccaucaugcacgaccggaccaagauccgccagcugcccaaccuccugcggggguacgagcacauccgccugaguacccacaacgugaucaacgccgagaacgcgccgggcgggcccuacaagaucggcaccuccgggagcugccccaacgucacgaacggcaacggcuucuucgccaccauggccugggccgugcccaagaacgacaagaauaagaccgcgaccaacccgcucacgaucgaggugcccuacaucugcaccgagggggaggaccagaucaccgucuggggcuuccacuccgacaacgagacccagauggccaagcuguacggggacucgaagccccagaaguucacguccucggccaauggcgugaccacccacuacgugucccagaucggcggguuccccaaccagaccgaggacggcgggcugccgcagagcggccggaucgucguggacuacauggugcagaaguccgggaagacgggcaccaucaccuaccagcgcggcauccuccugccccagaaggucuggugcgccaacgggcggucgaaggugaucaagggcucccugccccucaucggggaggccgacugccugcaugagaaguacggcgggcugaacaagucgaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcauggcuacaccagccacggggcccacggcgucgccguggccgcggaccugaaguccacccaggaggccaucaacaagaucacgaagaaccucaacucgcuguccgagcuggaggucaagaaccuccagcgccugucgggcgccauggacgagcugcacaaugagauccucgagcuggacgagaagguggacgaccugcgggccgacaccaucuccagccagaucgagcucgccgugcugcuguccaacgaggggaucaucaacucggaggacgagcaccuccuggcgcuggagcgcaagcucaagaagaugcugggccccuccgccgucgagaucgggaacggcugcuucgagaccaagcacaaguguaaccagaccugccuggaccggaucgccgccgggaccuucgacgcgggcgaguucucgcuccccacguucgacucccugaacaucaccgccgccagccugaacgacgauggccucgacaaccacaccauccugcuguacuacuccaccgccgccucgucccuggcggugacgcucaugaucgccaucuucguggucuacaugaucucgcgcgacaacguguccugcagcaucugccuguga

SEQ ID NO: 15217 - RNA, 1758 nt, Artificial Sequence; identical to SEQ ID NO: 14423
  derived and/or modified CDS sequence (AUadapt) from InfluenzaB__AGX21249__HA

SEQ ID NO: 15218 - RNA, 1758 nt, Artificial Sequence
  derived and/or modified CDS sequence (AUadapt) from InfluenzaB__AGX21260__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccauuucgccaaccugaaggggacggagacccggggcaagcucugccccaagugccugaacugcaccgaccuggacguggcccucgggcgccccaagugcaccggcaagaucccguccgcccgggugaguauccugcacgagguccgccccgugacguccggcugcuuccccaucaugcacgaccggaccaagauccgccagcugcccaaccuccugcggggguacgagcacauccgccugagcacccauaacgugaucaacgccgagaacgcgccgggcgggcccuacaagaucggcaccuccgggagcugccccaacgucacgaacggcaacggcuuuuucgccaccauggccugggccgugcccaagaacgacaagaacaagaccgcgaccaacccgcucacgaucgaggugcccuacaucugcaccgagggggaggaccagaucaccgucuggggcuuccacuccgauaacgagacccagauggccaagcuguacggggacucgaagccccagaaguucacguccagcgccaacggcgugaccacccacuacgugucccagaucggcggguuucccaaccagaccgaggacggcgggcugccgcagucgggccggaucgucguggacuacauggugcagaaguccgggaagacgggcaccaucaccuaccagcgcggcauccuccugccccagcgggucuggugcgccagcgggcgcuccaaggugaucaagggcucgcugccccucaucggggaggccgauugccugcacgagaaguacggcgggcugaacaagagcaagcccuacuacaccggcgagcacgcgaaggccaucggcaacuguccgaucugggugaagacgccccucaagcuggccaacgggaccaaguaccggccgcccgccaagcugcucaaggagcgcggcuucuucggggccaucgcgggcuuccuggagggcgggugggagggcaugaucgccggguggcacggcuacaccucccacggggcccacggcgucgccguggccgcggaucugaaguccacccaggaggccaucaacaagaucacgaagaaccucaacucccugagcgagcuggaggucaagaaccuccagcggcuguccggcgccauggacgagcugcacaacgagauccucgagcuggacgagaagguggacgaucugcgcgccgacaccaucucgucccagaucgagcucgccgugcugcugagcaacgaggggaucaucaacuccgaggacgagcaccuccuggcgcuggagcggaagcucaagaagaugcugggccccucggccgucgagaucgggaacggcuguuucgagaccaagcacaagugcaaccagaccugccuggaccgcaucgccgccgggaccuucgacgcgggcgaguucucccuccccacguuugacagccugaacaucaccgccgccucccugaacgacgacggccucgacaaccacaccauccugcuguauuacucgaccgccgccuccagccuggcggugacgcucaugaucgccaucuucguggucuacauggugucccgggacaacgugagcugcuccaucugccuguga

SEQ ID NO: 15219 - RNA, 1758 nt, Artificial Sequence; identical to SEQ ID NO: 14348
  derived and/or modified CDS sequence (AUadapt) from InfluenzaB__AGX21271__HA

SEQ ID NO: 15220 - RNA, 1758 nt, Artificial Sequence
  derived and/or modified CDS sequence (AUadapt) from InfluenzaB__AGX21282__HA
augaaggccaucaucgugcugcucauggucgugaccaguaacgccgaccgcaucugcaccggcaucacguccucgaacagcccccacaucgugaagaccgcgacccagggggaggucaacgugaccggcgugaucccgcugacgaccucgcccaccaagucccacuucgccaaccugaaggggaccgagacgcggggcaagcucugccccaagugccugaacuguaccgaccuggacgucgcccucgggcgccccaagugcaccggcaagaucccgucggcccggguguccauccugcacgaggugcgccccgucaccagcggcugcuuccccaucaugcacgaccggacgaagauccgccagcugcccaaccuccugcggggguacgagcacauccgccuguccacccacaacgugaucaaugccaagaacgcgccgggcgggcccuacaagaucggcaccucgggguccugccccaacaucaccaacggcaacggcuucuucgccacgauggccugggccgugcccaagaacgacaagaacaagaccgcgaccaacccgcucaccaucgagguccccuacaucugcacggagggggaggaucagaucaccguguggggcuuccacucggacaacgagacccagauggccaagcuguacggggacuccaagccccagaaguucaccagcuccgccaacggcgugacgacccacuacgucucgcagaucggcggguuccccaaccagaccgaggauggcgggcugccgcaguccggccggaucgugguggacuacaugguccagaaguccgggaagaccggcacgaucaccuaccagcgcggcauccuccugccccagaagguguggugcgccuccgggcggagcaaggugaucaagggcucgcugccccucaucggggaggccgacugccugcacgagaaguacggcgggcugaacaaguccaagcccuacuacaccggcgagcacgcgaaggccaucggcaacuguccgaucugggucaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucgcacggggcccacggcguggccguggccgcggaccugaaguccacccaggaggccaucaacaagaucaccaagaaccucaacagccuguccgagcuggaggucaagaaucuccagcgccugucgggcgccauggacgagcugcacaacgagauccucgagcuggacgagaagguggacgaccugcgggccgacacgaucuccucgcagaucgagcucgccguccugcuguccaacgaggggaucaucaacagcgaggacgagcaccuccuggcgcuggagcgcaagcucaagaagaugcugggccccuccgccguggagaucgggaacggcuguuucgagaccaagcacaagugcaaccagaccugccuggaccggaucgccgccgggaccuucgacgcgggcgaguucucgcuccccaccuucgacucccugaacaucacggccgccucgcugaacgaugacggccucgacaaccacaccauccugcuguacuacuccaccgccgccagcucccuggcggugacccucaugaucgccaucuucgucguguacauggugucgcgcgacaacgucuccugcagcaucugccuguga

SEQ ID NO: 15221 - RNA, 1758 nt, Artificial Sequence; identical to SEQ ID NO: 14118
  derived and/or modified CDS sequence (AUadapt) from InfluenzaB__AGX21293__HA

SEQ ID NO: 15222 - RNA, 1758 nt, Artificial Sequence; identical to SEQ ID NO: 14423
  derived and/or modified CDS sequence (AUadapt) from InfluenzaB__AGX21304__HA

SEQ ID NO: 15223 - RNA, 1758 nt, Artificial Sequence; identical to SEQ ID NO: 14118
  derived and/or modified CDS sequence (AUadapt) from InfluenzaB__AGX21315__HA

SEQ ID NO: 15224 - RNA, 1758 nt, Artificial Sequence; identical to SEQ ID NO: 14348
  derived and/or modified CDS sequence (AUadapt) from InfluenzaB__AGX21326__HA

SEQ ID NO: 15225 - RNA, 1758 nt, Artificial Sequence
  derived and/or modified CDS sequence (AUadapt) from InfluenzaB__AGX21337__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcauuucgccaaccugaaggggacggagacccggggcaagcucugccccaagugccccaacugcaccgaccuggacguggcccuggggcgcccgaagugcaccggcaagauccccuccgcccgggugagcauccuccaugagguccgccccgugacguccggcugcuuccccaucaugcacgaccggaccaagauccgccagcugccgaaccugcuccggggguacgagcacauccgccugucgacccacaacgugaucaaugccgagaacgcgcccggcgggcccuacaagaucggcaccuccgggagcugccccaacgucacgaacggcaacggcuucuucgccaccauggccugggccgugccgaagaacgauaagaacaagaccgcgaccaacccccugacgaucgaggugcccuacaucugcaccgagggggaggaccagaucaccgucuggggcuuccacuccgacaaggagacccagauggccaagcucuacggggacaguaagccccagaaguucacguccagcgccaacggcgugaccacccacuacgugucccagaucggcggguucccgaaccagaccgaggacggcgggcugccccagucgggccggaucgucguggacuauauggugcagaaguccgggaagacgggcaccaucaccuaccagcgcggcauccugcucccccagaaggucuggugcgccagcgggcgguccaaggugaucaagggcucgcugccccugaucggggaggccgacugccuccacgagaaguacggcgggcugaacaagagcaagccguauuacaccggcgagcacgcgaaggccaucggcaacugccccaucugggugaagacgccccugaagcucgccaacgggaccaaguaccggcccccggccaagcugcugaaggagcgcggcuucuucggggccaucgcgggcuuccucgagggcgggugggagggcaugaucgccggguggcacggcuauaccucccacggggcccacggcgucgccguggccgcggaccugaaguccacccaggaggccaucaacaagaucacgaagaaccugaacucccucucggagcuggaggucaagaaccugcagcgccucuccggcgccauggacgagcugcacaaugagauccuggagcucgacgagaagguggacgaccugcgggccgacaccaucagcucccagaucgagcuggccgugcuccugucgaacgaggggaucaucaacuccgaggacgagcaccuccuggcgcuggagcgcaagcugaagaagaugcucggccccagugccgucgagaucgggaacggcugcuucgagaccaagcacaagugcaaccagaccugccuggaccggaucgccgccgggaccuucgacgcgggcgaguuuucccugcccacguucgacucgcucaacaucaccgccgccucccugaacgacgacggccuggacaaccacaccauccuccuguauuacagcaccgccgccuccucgcuggcggugacgcugaugaucgccaucuucguggucuacauggugucccgcgacaacgugagcugcuccaucugccucuga

SEQ ID NO: 15226 - RNA, 1758 nt, Artificial Sequence; identical to SEQ ID NO: 14118
  derived and/or modified CDS sequence (AUadapt) from InfluenzaB__AGX21348__HA

SEQ ID NO: 15227 - RNA, 1758 nt, Artificial Sequence; identical to SEQ ID NO: 14118
  derived and/or modified CDS sequence (AUadapt) from InfluenzaB__AGX21359__HA

SEQ ID NO: 15228 - RNA, 1758 nt, Artificial Sequence
  derived and/or modified CDS sequence (AUadapt) from InfluenzaB__AGX21370__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuuugccaaccugaaggggacggagacccggggcaagcucugccccaagugccccaacugcaccgaccuggacguggcccuggggcgcccgaagugcaugggcaagauccccuccgcccgggugagcauccuccacgagguccgccccgugaccuccggcugcuuucccaucaugcacgaccggacgaagauccgccagcugccgaaccugcuccggggguacgagcacauccgccugucgacccacaacgugaucaacgccgagaacgcgcccggcgggcccuacaagaucggcaccuccgggaguugccccaacgucaccaacggcaacggcuucuucgccacgauggccugggccgugccgaagaacgacaagaacaagaccgcgaccaacccccugaccaucgaggugcccuacaucuguacggagggggaggaccagaucaccgucuggggcuuccacuccgacaacgagacccagauggccaagcucuacggggacucgaagccccagaaguucaccuccagcgccaacggcgugacgacccauuacgugucccagaucggcggguucccgaaccagaccgaggacggcgggcugccccagucgggccggaucgucguggacuacauggugcagaaguccgggaagaccggcacgaucaccuaccagcgcggcauccugcucccccagaaggucuggugcgccagcgggcgguccaaggugaucaagggcucgcugccccugaucggggaggccgauugccuccacgagaaguacggcgggcugaacaagagcaagccguacuacaccggcgagcacgcgaaggccaucggcaacugccccaucugggugaagacgccccugaagcucgccaacgggaccaaguaucggcccccggccaagcugcugaaggagcgcggcuucuucggggccaucgcgggcuuccucgagggcgggugggagggcaugaucgccggguggcacggcuacaccucccacggggcccacggcgucgccguggccgcggaccugaaguccacccaggaggccaucaacaagaucaccaagaaccugaacucccucagugagcuggaggucaagaaccugcagcgccucuccggcgccauggacgagcugcacaacgagauccuggagcucgacgagaagguggacgaccugcgggccgacacgaucagcucccagaucgagcuggccgugcuccugucgaacgaggggaucaucaauuccgaggacgagcaccuccuggcgcuggagcgcaagcugaagaagaugcucggccccagcgccgucgagaucgggaacggcugcuucgagaccaagcacaagugcaaccagaccugccuggaccggaucgccgccgggaccuuugacgcgggcgaguucucccugcccaccuucgacucgcucaacaucacggccgccucccugaacgacgacggccuggacaaccauaccauccuccuguacuacagcaccgccgccuccucgcuggcggugacccugaugaucgccaucuucguggucuacauggugucccgcgacaacgugagcugcuccaucugccucuga

SEQ ID NO: 15229 - RNA, 1758 nt, Artificial Sequence
  derived and/or modified CDS sequence (AUadapt) from InfluenzaB__AGX21381__HA
augaaggccaucaucgugcugcucauggucgugaccaguaacgccgaccgcaucugcaccggcaucacguccucgaacagcccccacaucgugaagaccgcgacccagggggaggucaacgugaccggcgugaucccgcugacgaccacccccaccaagucgcacuucgccaaccugaaggggacggagacccggggcaagcucugccccaagugccugaauugcaccgaccuggacgucgcccucgggcgccccaagugcaccggcaagaucccguccgcccgggugucgauccugcacgaggugcgccccgucacguccggcugcuuccccaucaugcacgaccggaccaagauccgccagcugcccaaccuccugcggggguacgagcacauccgccugagcacccacaaugugaucaacgccgagaacgcgccgggcgggcccuacaagaucggcaccuccgggucgugccccaacaucacgaacggcaacggcuucuucgccaccauggccugggccgugcccaagaacgacaagaacaagaccgcgaccaacccgcucacgaucgagguccccuacaucuguaccgagggggaggaccagaucaccguguggggcuuccacuccgacaacgagacccagauggccaagcuguacggggacucgaagccccagaaguucacguccagcgccaacggcgugaccacccacuacaucucccagaucggcggguuccccaaccagaccgaggauggcgggcugccgcagucgggccggaucgucguggacuacauggugcagaaguccgggaagacgggcaccaucaccuaccagcgcggcauccuccugccccagaaggucuggugcgccucggggcgguccaaggugaucaagggcagccugccccucaucggggaggccgacugccugcacgagaaguacggcgggcugaacaagucgaagcccuacuacaccggcgagcaugcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagugagcuggaggugaagaaccuccagcgccuguccggcgccauggacgagcugcacaacgagauccucgagcuggacgagaaggucgacgaccugcgggccgacaccaucagcucccagaucgagcucgccgugcugcugucgaacgaggggaucaucaacuccgaggacgagcaccuccuggcgcuggagcgcaagcucaagaagaugcugggccccucggccgucgagaucgggaauggcugcuucgagaccaagcacaagugcaaccagaccugccuggaccggaucgccgccgggaccuucgacgcgggcgaguucucccuccccacguucgacagccugaacaucaccgccgccucccugaacgaugacggccucgacaaccacaccauccugcuguacuacucgaccgccgccuccucgcuggcggugacgcucaugaucgccaucuucguggucuacauggugucccgcgacaacgugagcugcuccaucugccuguga

SEQ ID NO: 15230 - RNA, 1758 nt, Artificial Sequence
  derived and/or modified CDS sequence (AUadapt) from InfluenzaB__AGX21392__HA
augaaggccaucaucgugcugcucauggucgugaccaguaacgccgaccgcaucugcaccggcaucacguccucgaacagcccccacaucgugaagaccgcgacccagggggaggucaacgugaccggcgugaucccgcugacgaccacccccaccaagucgcacuucgccaaccugaaggggacggagacccggggcaagcucugucccaagugccugaacugcaccgaccuggacgucgcccucgggcgccccaagugcaccggcaagaucccguccgcccgggugagcauccugcacgaggugcgccccgucacguccggcugcuuccccaucaugcacgaccggaccaagauccgccagcugcccaaucuccugcggggguacgagcacauccgccugucgacccacaacgugaucaacgccgagaacgcgccgggcgggcccuacaagaucggcaccuccgggagcugccccaacaucacgaacggcaauggcuucuucgccaccauggccugggccgugcccaagaacgacaagaacaagaccgcgaccaacccgcucacgaucgagguccccuacaucugcaccgagggggaggaccagaucaccguguggggcuuccacuccgacaaugaggcccagauggccaagcuguacggggacucgaagccccagaaguucaccuccucggccaacggcgugacgacccacuacgucucccagaucggcggguuccccaaccagaccgaggacggcgggcugccgcagagcggccggaucgugguggauuacaugguccagaaguccgggaagaccggcacgaucaccuaccagcgcggcauccuccugccccagaagguguggugcgccucggggcgguccaaggugaucaagggcagccugccccucaucggggaggcggacugccugcacgagaaguacggcgggcugaacaagucgaagcccuacuauaccggcgagcacgccaaggccaucggcaacugcccgaucugggucaagacgccccucaagcuggccaacgggaccaaguaccgcccgcccgccaagcugcucaaggagcggggcuucuucggggcgaucgccggcuuccuggagggcgggugggagggcaugaucgccggguggcacggcuacaccucccacggggcccacggcguggccguggcggccgaucugaaguccacccaggaggccaucaacaagaucaccaagaaccucaacucccugagcgagcuggaggucaagaaccuccagcgccuguccggcgccauggacgagcugcacaacgagauccucgagcuggacgagaagguggacgaccugcgggccgacacgaucaguucccagaucgagcucgcgguccugcugucgaacgaggggaucaucaacuccgaggacgagcaccuccuggcccuggagcgcaagcucaagaagaugcugggccccagcgccguggagaucgggaacggcugcuucgagaccaagcacaagugcaaccagaccugucuggaccggaucgccgcggggaccuucgacgccggcgaguucucccuccccaccuucgacucgcugaacaucacggccgccucccugaacgacgacggccucgacaaucacaccauccugcuguacuacagcaccgccgcguccucgcuggccgugacccucaugaucgccaucuucgucguguacauggugucccgcgacaacgucagcugcuccaucugccuguga

SEQ ID NO: 15231 - RNA, 1758 nt, Artificial Sequence
  derived and/or modified CDS sequence (AUadapt) from InfluenzaB__AGX21403__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuuugccaaccugaaggggacggagacccggggcaagcucugccccaagugccccaacugcaccgaccuggacguggcccuggggcgcccgaagugcaccggcaagauccccuccgcccgggugagcauccuccacgagguccgccccgugacguccggcugcuuucccaucaugcacgaccggaccaagauccgccagcugccgaaccugcuccggggguacgagcacauccgccugucgacccacaacgugaucaacgccgagaacgcgcccggcgggcccuacaagaucggcaccuccgggaguugccccaacgucacgaacggcaacggcuucuucgccaccauggccugggccgugccgaagaacgacaagaacaagaccgcgaccaacccccugacgaucgaggugcccuacaucuguaccgagggggaggaccagaucaccgucuggggcuuccacuccgacaacgagacccagauggccaagcucuacggggacucgaagccccagaaguucacguccucggccaacggcgugaccacccauuacgugucccagaucggcggguucccgaaccagaccgaggacggcgggcugccccagagcggccggaucgucguggacuacauggugcagaaguccgggaagacgggcaccaucaccuaccagcgcggcauccugcucccccagaaggucuggugcgccucggggcgguccaaggugaucaagggcagccugccccugaucggggaggccgauugccuccacgagaaguacggcgggcugaacaagucgaagccguacuacaccggcgagcacgcgaaggccaucggcaacugccccaucugggugaagacgccccugaagcucgccaacgggaccaaguaucggcccccggccaagcugcugaaggagcgcggcuucuucggggccaucgcgggcuuccucgagggcgggugggagggcaugaucgccggguggcacggcuacaccucccacggggcccacggcgucgccguggccgcggaccugaaguccacccaggaggccaucaacaagaucacgaagaaccugaacucccucagugagcuggaggucaagaaccugcagcgccucuccggcgccauggacgagcugcacaacgagauccuggagcucgacgagaagguggacgaccugcgggccgacaccaucucgucccagaucgagcuggccgugcuccugucgaacgaggggaucaucaauuccgaggacgagcaccuccuggcgcuggagcgcaagcugaagaagaugcucggccccagcgccgucgagaucgggaacggcugcuucgagaccaagcacaagugcaaccagaccugccugaaccggaucgccgccgggaccuuugacgcgggcgaguucucccugcccacguucgacucgcucaacaucaccgccgccucccugaacgacgacggccuggacaaccauaccauccuccuguacuacagcaccgccgccuccucgcuggcggugacgcugaugaucgccaucuucguggucuacauggugucccgcgacaacgugagcugcuccaucugccucuga

SEQ ID NO: 15232 - RNA, 1758 nt, Artificial Sequence
  derived and/or modified CDS sequence (AUadapt) from InfluenzaB__AGX21414__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccacuuugccaaccugaaggggacggagacccggggcaagcucugccccaagugccccaacugcaccgaccuggacguggcccuggggcgcccgaagugcaccggcaagauccccuccgcccgggugucgauccuccacgagguccgccccgugacguccggcuguuuccccaucaugcacgaccggaccaagauccgccagcugccgaaccugcuccggggguacgagcacauccgccugagcacccacaacgugaucaacgccgagaaugcgcccggcgggcccuacaagaucggcaccuccgggucgugccccaacgucacgaacggcaacggcuucuucgccaccauggccugggccgugccgaagaacgacaagaauaagaccgcgaccgacccccugacgaucgaggugcccuacaucugcaccgagggggaggaccagaucaccgucuggggcuuccacuccgacaacgagacccagauggccaagcucuacggggacaguaagccccagaaguucacguccucguccaacggcgugaccacccacuacgugagccagaucggcggguucccgaaccagaccgaggacggcgggcugccccaguccggccggaucgucguggacuauauggugcagaaguccgggaagacgggcaccaucaccuaccagcgcggcauccugcucccccagaaggucuggugcgccuccgggcggucgaaggugaucaagggcagccugccccugaucggggaggccgacugccuccacgagaaguacggcgggcugaacaaguccaagccguacuauaccggcgagcacgccaaggcgaucggcaacugccccaucugggugaagacgccccugaagcucgccaacgggaccaaguaccggcccccggccaagcugcugaaggagcgcggcuucuucggggccaucgccggcuuccucgagggcgggugggagggcaugaucgcgggguggcacggcuacaccagucacggggcccacggcgucgccguggccgccgaccugaaguccacccaggaggcgaucaacaagaucacgaagaaccugaacagccucuccgagcuggaggucaagaaccugcagcgccucucgggcgccauggacgagcugcauaacgagauccuggagcucgacgagaagguggacgaccugcgggccgacaccaucuccagccagaucgagcuggccgugcuccuguccaacgaggggaucaucaacucggaggacgagcaucuccuggcccuggagcgcaagcugaagaagaugcucggccccuccgcggucgagaucgggaacggcugcuucgagaccaagcacaagugcaaccagaccugccuggaccggaucgccgccgggaccuucgacgccggcgaguuuagccugcccacguucgacucccucaacaucaccgcggccucgcugaacgacgacggccuggacaaccauaccauccuccuguacuacuccaccgccgccagcucccuggccgugacgcugaugaucgcgaucuucguggucuacauggugucgcgcgacaacguguccugcagcaucugccucuga

SEQ ID NO: 15233 - RNA, 1758 nt, Artificial Sequence; identical to SEQ ID NO: 14348
  derived and/or modified CDS sequence (AUadapt) from InfluenzaB__AGX21425__HA

SEQ ID NO: 15234 - RNA, 1758 nt, Artificial Sequence
  derived and/or modified CDS sequence (AUadapt) from InfluenzaB__AGX21436__HA
augaaggccaucaucgugcugcucauggucgugaccaguaacgccgaccgcaucugcaccggcaucacguccucgaacagcccccacaucgugaagaccgcgacccagggggaggucaacgugaccggcgugaucccgcugacgaccacccccaccaagucgcacuucgccaaccugaaggggacggagacccggggcaagcucugccccaagugccugaauugcaccgaccuggacgucgcccucgggcgccccaagugcaccggcaagaucccguccgcccgggugucgauccugcacgaggugcgccccgucacguccggcugcuuccccaucaugcacgaccggaccaagauccgccagcugcccaaccuccugcggggguacgagcacauccgccugagcacccacaaugugaucaacgccgagaacgcgccgggcgggcccuacaagaucggcaccuccgggucgugccccaacaucacgaacggcaacggcuucuucgccaccauggccugggccgugcccaagaacgacaagaacaagaccgcgaccaacccgcucacgaucgagguccccuacaucuguaccgagggggaggaccagaucaccguguggggcuuccacuccgacaacgagacccagauggccaagcuguacggggacagcaagccccagaaguucacguccucggccaacggcgugaccacccacuacgucucccagaucggcggguuccccaaccagaccgaggauggcgggcugccgcagucgggccggaucgugguggacuacaugguccagaaguccgggaagacgggcaccaucaccuaccagcgcggcauccuccugccccagaagguguggugcgccagcgggcgguccaaggugaucaagggcucgcugccccucaucggggaggccgacugccugcacgagaaguacggcgggcugaacaagucgaagcccuacuacaccggcgagcaugcgaaggccaucggcaacugcccgaucugggucaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcguggccguggccgcggaccugaaguccacccaggaggccaucaacaagaucacgaagaaccucaacucccugagugagcuggaggucaagaaccuccagcgccuguccggcgccauggacgagcugcacaacgagauccucgagcuggacgagaagguggacgaccugcgggccgacaccaucucgucccagaucgagcucgccguccugcugagcaacgaggggaucaucaacuccgaggacgagcaccuccuggcgcuggagcgcaagcucaagaagaugcugggccccucggccguggagaucgggaauggcugcuucgagaccaagcacaagugcaaccagaccugccuggaccggaucgccgccgggaccuucgacgcgggcgaguucucccuccccacguucgacucgcugaacaucaccgccgccucccugaacgaugacggccucgacaaccacaccauccugcuguacuacagcaccguggccuccucgcuggccgucacgcucaugaucgcgaucuucgugguguacauggucucccgcgacaacgugagcugcuccaucugccuguga

SEQ ID NO: 15235 - RNA, 1758 nt, Artificial Sequence; identical to SEQ ID NO: 14423
  derived and/or modified CDS sequence (AUadapt) from InfluenzaB__AGX21447__HA

SEQ ID NO: 15236 - RNA, 1758 nt, Artificial Sequence; identical to SEQ ID NO: 14348
  derived and/or modified CDS sequence (AUadapt) from InfluenzaB__AGX21458__HA

SEQ ID NO: 15237 - RNA, 1758 nt, Artificial Sequence; identical to SEQ ID NO: 14348
  derived and/or modified CDS sequence (AUadapt) from InfluenzaB__AGX21469__HA

SEQ ID NO: 15238 - RNA, 1758 nt, Artificial Sequence
  derived and/or modified CDS sequence (AUadapt) from InfluenzaB__AGX21480__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuuugccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuucccaucaugcacgaccggaccaagauccgccagcugcccaaccuccugcggggguacgagcacauccgccugucgacccacaacgugaucaacgccgagaacgcgccgggcgggcccuacaagaucggcaccuccgggaguugccccaacgucacgaacggcaacggcuucuucgccaccauggccugggccgugcccaagaacgacaagaacaagaccgcgaccaacccgcucacgaucgaggugcccuacaucuguaccgagggggaggaccagaucaccgucuggggcuuccacuccgacaacgagacccagauggccaagcuguacggggacucgaagccccagaaguucacguccagcgccaacggcgugaccacccauuacgugucccagaucggcggguuccccaaccagaccgaggacggcgggcugccgcagucgggccggaucgucguggacuacauggugcagaaguccgggaagacgggcaccaucaccuaccagcgcggcauccuccugccccagaaggucuggugcgccagcgggcgguccaaggugaucaagggcucgcugccccucaucggggaggccgauugccugcacgagaaguacggcgggcugaacaagagcaagcccuacuacaccggcgagcacgcgaaggccaucggcaacugcccgaucugggugaagacgccccucaagcuggccaaugggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaauucccugucggagcuggaggucaagaaccuccagcgccuguccggcgccauggacgagcugcacaacgagauccucgagcuggacgagaagguggacgaccugcgggccgacaccaucagcucccagaucgagcucgccgugcugcugucgaaugaggggaucaucaacuccgaggacgagcaccuccuggcgcuggagcgcaagcucaagaagaugcugggccccagcgccgucgagaucgggaacggcugcuucgagaccaagcacaagugcaaccagaccugccuggaucggaucgccgccgggaccuucgacgcgggcgaguucucccuccccacguucgacucgcugaacaucaccgccgccucccugaacgaggacggccucgacaaccauaccauccugcuguacuacagcaccgccgccuccucgcuggcggugacgcucaugaucgccaucuucguggucuacauggugucccgcgacaacgugagcugcuccaucugccuguga

SEQ ID NO: 15239 - RNA, 1758 nt, Artificial Sequence; identical to SEQ ID NO: 14423
  derived and/or modified CDS sequence (AUadapt) from InfluenzaB__AGX21491__HA

SEQ ID NO: 15240 - RNA, 1758 nt, Artificial Sequence; identical to SEQ ID NO: 14423
  derived and/or modified CDS sequence (AUadapt) from InfluenzaB__AGX21502__HA

SEQ ID NO: 15241 - RNA, 1758 nt, Artificial Sequence; identical to SEQ ID NO: 14348
  derived and/or modified CDS sequence (AUadapt) from InfluenzaB__AGX21513__HA

SEQ ID NO: 15242 - RNA, 1758 nt, Artificial Sequence; identical to SEQ ID NO: 14118
  derived and/or modified CDS sequence (AUadapt) from InfluenzaB__AGX21524__HA

SEQ ID NO: 15243 - RNA, 1758 nt, Artificial Sequence
  derived and/or modified CDS sequence (AUadapt) from InfluenzaB__AGX21535__HA
augaaggccaucaucgugcugcucauggucgugaccaguaacgccgaccgcaucugcaccggcaucacguccucgaacagcccccacaucgugaagaccgcgacccagggggaggucaacgugaccggcgugaucccgcugacgaccacccccaccaagucgcacuucgccaaccugaaggggacggagacccggggcaagcucugucccaagugccugaacugcaccgaccuggacgucgcccucgggcgccccaagugcaccggcaagaucccguccgcccgggugagcauccugcacgaggugcgccccgucacguccggcugcuuccccaucaugcacgaccggaccaagauccgccagcugcccaaucuccugcggggguacgagcacauccgccugucgacccacaacgugaucaacgccgagaacgcgccgggcgggcccuacaagaucggcaccuccgggagcugccccaacaucacgaacggcaauggcuucuucgccaccauggccugggccgugcccaagaacgacaagaacaagaccgcgaccaacccgcucacgaucgagguccccuacaucugcaccgagggggaggaccagaucaccguguggggcuuccacuccgacagugagacccagauggccaagcuguacggggacuccaagccccagaaguucacgagcuccgccaacggcgugaccacccacuacgucucgcagaucggcggguuccccaaccagaccgaggacggcgggcugccgcaguccggccggaucgugguggacuauaugguccagaaguccgggaagacgggcaccaucaccuaccagcgcggcauccuccugccccagaagguguggugcgccuccgggcggagcaaggugaucaagggcucgcugccccucaucggggaggccgacugccugcacgagaaguacggcgggcugaacaaguccaagcccuacuacaccggcgagcacgcgaaggccaucggcaauugcccgaucugggucaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucgcacggggcccacggcguggccguggccgcggaccugaaguccacccaggaggccaucaauaagaucacgaagaaccucaacagccuguccgagcuggaggucaagaaccuccagcgccugucgggcgccauggacgagcugcacaacgagauccucgagcuggacgagaagguggacgaccugcgggccgacaccaucuccagucagaucgagcucgccguccugcuguccaacgaggggaucaucaacucggaggacgagcaccuccuggcgcuggagcgcaagcucaagaagaugcugggccccuccgccguggagaucgggaacggcugcuucgagaccaagcacaagugcaaccagaccugccuggaucggaucgccgccgggaccuucgacgcgggcgaguucagccuccccacguucgacucccugaacaucaccgccgccucgcugaacgacgacggccucgacaaucacaccauccugcuguacuacuccaccgccgccagcucccuggcggugacgcucaugaucgccaucuucgucguguacauggugucgcgcgacaacgucuccugcagcaucugccuguga

SEQ ID NO: 15244 - RNA, 1758 nt, Artificial Sequence; identical to SEQ ID NO: 14118
  derived and/or modified CDS sequence (AUadapt) from InfluenzaB__AGX21546__HA

SEQ ID NO: 15245 - RNA, 1758 nt, Artificial Sequence
  derived and/or modified CDS sequence (AUadapt) from InfluenzaB__AGX21557__HA
augaaggccaucaucgugcugcucauggucgugaccaguaacgccgaccgcaucugcaccggcaucacguccucgaacagcccccacguggucaagaccgcgacccagggggaggugaacgugaccggcgucaucacgcugaccaccaccccgacgaagucccacuucgccaaccugaaggggaccgagacccggggcaagcucugccccaagugucugaacugcaccgaccuggacguggcccucgggcgccccaagugcacgggcaagauccccuccgcccgggugucgauccugcacgagguccgcccggugaccuccggcugcuuccccaucaugcacgaccggaccaagauccgccagcugcccaaccuccugcggggguaugagcacauccgccugagcacccacaacgugaucaacgccgagaacgcgcccggcgggccguacaagaucggcacguccgggucgugccccaacgucaccaacggcaacggcuuuuucgccaccauggccugggccgugcccaagaacgacaagaacaagaccgcgacgaacccccucaccaucgaggugccguacaucugcaccgagggggaggaccagaucaccgucuggggcuuccacuccgacaacgagacgcagauggccaagcuguauggggacagcaagccccagaaguucaccuccucggccaacggcgugaccacccacuacgugucccagaucggcggguuccccaaccagacggaggacggcgggcugccccagucgggccggaucgucguggacuauauggugcagaaguccgggaagaccggcaccaucaccuaccagcgcggcauccuccugccgcagaaggucuggugcgccagcgggcgguccaaggugaucaagggcucgcugccccucaucggggaggccgacugccugcacgagaaguacggcgggcugaacaagagcaagcccuacuacacgggcgagcaugcgaaggccaucggcaacugccccaucugggugaagaccccgcucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccucaagaguacgcaggaggccaucaacaagaucaccaagaaccugaacucccugagcgagcuggaggucaagaaccuccagcgccuguccggcgccauggacgagcugcacaacgagauccucgagcuggacgagaagguggacgaccugcgggccgacaccaucaguucccagaucgagcucgccgugcugcugucgaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugucuggaccggaucgccgccgggacguucgacgcgggcgaguucucccuccccaccuucgacucgcugaacaucaccgccgccucccugaacgacgacggccucgacaaucacaccauccugcuguacuacagcacggccgccuccucgcuggcggugacccucaugaucgccaucuucguggucuacauggugucccgcgacaacgugagcugcuccaucugccuguga

SEQ ID NO: 15246 - RNA, 1758 nt, Artificial Sequence
  derived and/or modified CDS sequence (AUadapt) from InfluenzaB__AGX21568__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuuugccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuucccaugaugcacgaccggaccaagauccgccagcugcccaaccuccugcggggguacgagcacauccgccugucgacccacaacgugaucaacgccgagaacgcgccgggcgggcccuacaagaucggcaccuccgggaguugccccaacgucacgaacggcaacggcuucuucgccaccauggccugggccgugcccaagaacgacaagaacaagaccgcgaccaacccgcucacgaucgaggugcccuacaucuguaccgagggggaggaccagaucaccgucuggggcuuccacuccgacaacgagacccagauggccaagcuguacggggacucgaagccccagaaguucacguccagcgccaacggcgugaccacccauuacgugucccagaucggcggguuccccaaccagaccgaggacggcgggcugccgcagucgggccggaucgucguggacuacauggugcagaaguccgggaagacgggcaccaucaccuaccagcgcggcauccuccugccccagaaggucuggugcgccagcgggcgguccaaggugaucaagggcucgcugccccucaucggggaggccgauugccugcacgagaaguacggcgggcugaacaagagcaagcccuacuacaccggcgagcacgcgaaggccaucggcaacugcccgaucugggugaagacgccccucaagcuggccaacgggaccaaguaucgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagugagcuggaggucaagaaccuccagcgccuguccggcgccauggacgagcugcacaacgagauccucgagcuggacgagaagguggacgaccugcgggccgacaccaucagcucccagaucgagcucgccgugcugcugucgaacgaggggaucaucaauuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuuugacgcgggcgaguucucccuccccacguucgacucgcugaacaucaccgccgccucccugaacgacgacggccucgacaaccauaccauccugcuguacuacagcaccgccgccuccucgcuggcggugacgcucaugaucgccaucuucguggucuacauggugucccgcgacaacgugagcugcuccaucugccuguga

SEQ ID NO: 15247 - RNA, 1758 nt, Artificial Sequence; identical to SEQ ID NO: 14348
  derived and/or modified CDS sequence (AUadapt) from InfluenzaB__AGX21579__HA

SEQ ID NO: 15248 - RNA, 1758 nt, Artificial Sequence; identical to SEQ ID NO: 14118
  derived and/or modified CDS sequence (AUadapt) from InfluenzaB__AGX21590__HA

SEQ ID NO: 15249 - RNA, 1758 nt, Artificial Sequence; identical to SEQ ID NO: 15198
  derived and/or modified CDS sequence (AUadapt) from InfluenzaB__AGX21601__HA

SEQ ID NO: 15250 - RNA, 1758 nt, Artificial Sequence; identical to SEQ ID NO: 14118
  derived and/or modified CDS sequence (AUadapt) from InfluenzaB__AGX21611__HA

SEQ ID NO: 15251 - RNA, 1758 nt, Artificial Sequence; identical to SEQ ID NO: 14085
  derived and/or modified CDS sequence (AUadapt) from InfluenzaB__AGX21622__HA

SEQ ID NO: 15252 - RNA, 1758 nt, Artificial Sequence
  derived and/or modified CDS sequence (AUadapt) from InfluenzaB__AGX21633__HA
augaaggccaucaucgugcugcucauggucgugaccaguaacgccgaccgcaucugcaccggcaucacguccucgaacagcccccacaucgugaagaccgcgacccagggggaggucaacgugaccggcgugaucccgcugacgaccacccccaccaagucgcacuuugccaaccugaaggggacggagacccggggcaagcucugccccaagugccugaacugcaccgaccuggacgucgcccucgggcgccccaagugcaccggcaagaucccguccgcccgggugagcauccugcacgaggugcgccccgucacguccggcugcuuucccaucaugcacgaccggaccaagauccgccagcugcccaaccuccugcggggguacgagcacauccgccugucgacccacaacgugaucaacgccgagaacgcgccgggcgggcccuacaagaucggcaccuccgggaguugccccaacaucacgaacggcaacggcuucuucgccaccauggccugggccgugcccaagaacgacaagaacaagaccgcgaccaacccgcucacgaucgagguccccuacaucuguaccgagggggaggaccagaucaccguguggggcuuccacuccgacaacgagacccagauggccaagcuguacggggacucgaagccccagaaguucacguccagcgccaacggcgugaccacccauuacgucucccagaucggcggguuccccaaccagaccgaggacggcgggcugccgcagucgggccggaucgugguggacuacaugguccagaaguccgggaagacgggcaccaucaccuaccagcgcggcauccuccugccccagaagguguggugcgccagcgggcgguccaaggugaucaagggcucgcugccccucaucggggaggccgauugccugcacgagaaguacggcgggcugaacaagagcaagcccuacuacaccggcgagcacgcgaaggccaucggcaacugcccgaucugggucaagacgccccucaagcuggccaacgggaccaaguaucgcccgcccgcccggcugcucaaggagcgcggcuucuucggggccaucgcgggcuuccuggagggcgggugggagggcaugaucgccggguggcacggcuacaccucccacggggcccacggcguggccguggccgcggaccugaaguccacccaggaggccaucaacaagaucacgaagaaccucaacucccugagugagcuggaggucaagaaccuccagcggcuguccggcgccauggacgagcugcacaacgagauccucgagcuggacgagaagguggacgaccugcgcgccgacaccaucagcucccagaucgagcucgccguccugcugucgaacgaggggaucaucaauuccgaggacgagcaccuccuggcgcuggagcggaagcucaagaagaugcugggccccagcgccguggagaucgggaacggcugcuucgagaccaagcacaagugcaaccagaccugccuggaccgcaucgccgccgggaccuuugacgcgggcgaguucucccuccccacguucgacucgcugaacaucaccgccgccucccugaacgacgacggccucgacaaccauaccauccugcuguacuacagcaccgccgccuccucgcuggcggugacgcucaugaucgccaucuucgucguguacauggugucccgggacaacgucagcugcuccaucugccuguga

SEQ ID NO: 15253 - RNA, 1758 nt, Artificial Sequence; identical to SEQ ID NO: 14423
  derived and/or modified CDS sequence (AUadapt) from InfluenzaB__AGX21644__HA

SEQ ID NO: 15254 - RNA, 1758 nt, Artificial Sequence; identical to SEQ ID NO: 14348
  derived and/or modified CDS sequence (AUadapt) from InfluenzaB__AGX21655__HA

SEQ ID NO: 15255 - RNA, 1758 nt, Artificial Sequence
  derived and/or modified CDS sequence (AUadapt) from InfluenzaB__AGX21666__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugucccaagugccccaacugcaccgaccuggacguggcccuggggcgcccgaagugcaccggcaagauccccuccgcccgggugucgauccuccacgagguccgccccgugacguccggcugcuuccccaucaugcacgaccggaccaagauccgccagcugccgaaucugcuccggggguacgagcacauccgccugagcacccacaacgugaucaacgccgagaacgcgcccggcgggcccuacaagaucggcaccuccgggucgugccccaacgucacgaacggcaauggcuucuucgccaccauggccugggccgugccgaagaacgacaagaacaagaccgcgaccaacccccugacgaucgaggugcccuacaucugcaccgagggggaggaccagaucaccgucuggggcuuccacuccgacaaugagacccagauggccaagcucuacggggacagcaagccccagaaguucacguccucggccaacggcgugaccacccacuacgugucccagaucggcggguucccgaaccagaccgaggacggcgggcugccccagucgggccggaucgucguggauuacauggugcagaaguccgggaagacgggcaccaucaccuaccagcgcggcauccugcucccccagaaggucuggugcgccagcgggcgguccaaggugaucaagggcucgcugccccugaucggggaggccgacugccuccacgagaaguacggcgggcugaacaagucgaagccguacuauaccggcgagcacgcgaaggccaucggcaacugccccaucugggugaagacgccccugaagcucgccaacgggaccaaguaccggcccccggccaagcugcugaaggagcgcggcuucuucggggccaucgcgggcuuccucgagggcgggugggagggcaugaucgccggguggcacggcuacaccucccacggggcccacggcgucgccguggccgcggaucugaaguccacccaggaggccaucaacaagaucacgaagaaccugaacucccucagcgagcuggaggucaagaaccugcagcgccucuccggcgccauggacgagcugcacaacgagauccuggagcucgacgagaagguggacgaccugcgggccgacaccaucaguucccagaucgagcuggccgugcuccugagcaacgaggggaucaucaacuccgaggacgagcaccuccuggcgcuggagcgcaagcugaagaagaugcucggccccucggccgucgagaucgggaacggcugcuucgagaccaagcacaagugcaaccagaccugucuggacaagaucgccgccgggaccuucgacgcgggcgaguucucccugcccacguucgacucgcucaacaucaccgccgccucccugaacgacgacggccuggacaaucacaccauccuccuguacuacagcaccgccgccuccucgcuggcggugacgcugaugaucgccaucuucguggucuacauggugucccgggacaacgugagcugcuccaucugccucuga

SEQ ID NO: 15256 - RNA, 1758 nt, Artificial Sequence; identical to SEQ ID NO: 14423
  derived and/or modified CDS sequence (AUadapt) from InfluenzaB__AGX21677__HA

SEQ ID NO: 15257 - RNA, 1758 nt, Artificial Sequence; identical to SEQ ID NO: 14348
  derived and/or modified CDS sequence (AUadapt) from InfluenzaB__AGX21688__HA

SEQ ID NO: 15258 - RNA, 1758 nt, Artificial Sequence
  derived and/or modified CDS sequence (AUadapt) from InfluenzaB__AGX21699__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccacuuugccaaccugaaggggacggagacccggggcaagcucugccccaagugccugaacugcaccgaccuggacguggcccucgggcgccccaagugcaccggcaagaucccguccgcccgggugucgauccugcacgagguccgccccgugacguccggcuguuuccccaucaugcacgaccggaccaagauccgccagcugcccaaccuccugcggggguacgagcacauccgccugagcacccacaacgugaucaacgccgagaaugcgccgggcgggcccuacaagaucggcaccuccgggucgugccccaacgucacgaacggcaacggcuucuucgccaccauggccugggccgugcccaagaacgacaagaauaagaccgcgaccaacccgcucacgaucgaggugcccuacaucugcaccgagggggaggaccagaucaccgucuggggcuuccacuccgacaacgagacccagauggccaagcuguacggggacaguaagccccagaaguucacguccucggccaacggcgugaccacccacuacgugucccagaucggcggguuccccaaccagaccgaggacggcgggcugccgcagagcggccggaucgucguggacuauauggugcagaaguccgggaagacgggcaccaucaccuaccagcgcggcauccuccugccccagaaggucuggugcgccagcgggcgguccaaggugaucaagggcucgcugccccucaucggggaggccgacugccugcacgagaaguacggcgggcugaacaagagcaagcccuauuacaccggcgagcacgcgaaggccaucggcaacugcccgaucugggugaagacgccccucaaccuggccaacgggaccaaguaccgcccgcccgccaagcugcucaaggagcggggcuucuucggggccaucgcgggcuuccuggagggcgggugggagggcaugaucgccggguggcauggcuacaccucccacggggcccacggcgucgccguggccgcggaccugaaguccacccaggaggccaucaacaagaucacgaagaaccucaacucccugucggagcuggaggucaagaaccuccagcgccuguccggcgccauggacgagcugcauaacgagauccucgagcuggacgagaagguggacgaccugcgggccgacaccaucagcucccagaucgagcucgccgugcugcugucgaacgaggggaucaucaacuccgaggacgagcaucuccuggcgcuggagcgcaagcucaagaagaugcugggccccagcgccgucgagaucgggaacggcugcuucgagaccaagcacaagugcaaccagaccugccuggaccggaucgccgccgggaccuucgaugcgggcgaguucucccuccccacguucgacucgcugaacaucaccgccgccucccugagcgacgacggccucgacaaccauaccauccugcuguacuacuccaccgccgccucgucccuggcggugacgcucaugaucgccaucuucguggucuacauggugagccgcgacaacguguccugcagcaucugccuguga

SEQ ID NO: 15259 - RNA, 1758 nt, Artificial Sequence; identical to SEQ ID NO: 15198
  derived and/or modified CDS sequence (AUadapt) from InfluenzaB__AGX21710__HA

SEQ ID NO: 15260 - RNA, 1758 nt, Artificial Sequence; identical to SEQ ID NO: 14423
  derived and/or modified CDS sequence (AUadapt) from InfluenzaB__AGX21721__HA

SEQ ID NO: 15261 - RNA, 1755 nt, Artificial Sequence
  derived and/or modified CDS sequence (AUadapt) from InfluenzaB__AGX21732__HA
augaaggccaucaucgugcugcucauggucgugaccaguaacgccgaccgcaucugcaccggcaucacguccagcaacucgccccacguggucaagaccgcgacccagggggaggugaaugugaccggcgccaucccgcugacgaccacccccaccaagucccacuucgccaaccugaaggggacgaagacccggggcaagcucugcccgaccugccugaacugcaccgaccuggaugucgcccucgggggccccaugugcgugggcaucacgccguccgccaaggcgagcauccugcacgaggugcgccccgucaccuccgggugcuuccccaucaugcacgaccggaccaagauccgccagcugcccaaccuccugcggggcuaugagaagauccgccugagcgcccagaacgugaucaacgccgagaaggcccccgggggccccuacaagcucgggaccuccggcucgugccccaacgcgacguccaagagcggcuuuuucgccaccauggccugggccgugccccgggacgacaacaagaccgccaccaacccgcugacggucgaggugccccacaucugcgcgaacgaggaggaucagaucaccguguggggguuccacuccgacaacaagacccagaugaagaaccuguacggcgacagcaauccccagaaguucaccuccucggccaacgggaucacgacccacuacgucucccagaucggcggcuuccccgaccagaccgaggacgggggccucccgcagagugggcgcaucgugguggacuacaugguccagaagcccggcaagaccgggacgaucguguaccagcggggcauccugcugccccagaagguguggugcgccuccggccgcagcaaggucaucaaggggucgcucccccugaucggcgaggccgacugccugcaugagaaguacgggggccucaacaaguccaagccguacuacaccggggagcacgccaaggcgaucggcaacugccccaucugggugaagacgccccugaagcuggccaacggcaccaaguaucggcccccggccaagcuccugaaggagcgcggguucuucggcgccaucgccggguuccuggagggcgggugggagggcaugaucgcgggcuggcacggguacaccagccacggcgcccacgggguggccgucgccgccgaucucaaguccacccaggaggcgaucaacaagaucaccaagaaccugaacucgcuguccgagcucgaggugaagaaccugcagcggcugagcggcgccauggacgagcuccacaaugagauccuggagcuggacgagaaggucgacgaccuccgcgccgacaccaucuccagccagaucgagcuggccgugcugcucuccaacgagggcaucaucaacucggaggaugagcaccuccuggcgcuggagcggaagcugaagaagaugcuggggcccuccgccguggacaucggcaacgggugcuucgagacgaagcacaagugcaaccagaccugucucgaccgcaucgccgccggcaccuucaacgccggggaguucagccugcccaccuucgacucccugaacaucaccgcggccagucucaacgacgacggccuggacaaccacacgauccugcuguacuacuccaccgccgccaguucccucgccgucacccugaugaucgcgaucuucaucguguacaugaucagccgggacaacguguccugcagcaucugccuguga

SEQ ID NO: 15262 - RNA, 1755 nt, Artificial Sequence
  derived and/or modified CDS sequence (AUadapt) from InfluenzaB__AGX21743__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaagucccacuucgccaaccugaaggggacgcggacccgcggcaagcucugccccgacugccugaacugcaccgaucuggacguggcccucgggcggcccaugugcgugggcaccacgccguccgccaaggccagcauccugcacgagguccgccccgugaccuccggcugcuuccccaucaugcacgaucggaccaagauccgccagcugcccaaccuccugcggggguacgagaacauccgccugucgacccagaacgugaucgacgcggagaaggcccucggcgggccguaccggcugggcacguccgggagcugucccaacgccaccuccaagagcggcuucuucgccaccauggcgugggccguccccaaggacaacaacaagaaugccaccaacccccugacgguggaggugccguacaucugcaccgagggcgaggaccagaucaccgucuggggguuccacuccgacaacaagacccagaugaagaaucucuacggcgacagcaacccccagaaguucacguccucggccaacggggugaccacccauuacgugucccagaucggcggcuuccccgaccagaccgaggacgggggccugccccagagcgggcgcaucgucguggacuacauggugcagaagccgggcaagacggggaccaucgucuaccagcggggcgugcugcucccccagaagguguggugugccuccggcaagagcaaggucaucaaggggagccugccccugaucggcgaggcggacugccuccacgagaaguacgggggccugaacaaguccaagcccuauuacaccggggagcacgccaaggccaucggcaacugcccgaucugggugaagacgccccugaagcucgccaacggcaccaaguaccgcccgcccgccaagcugcugaaggagcggggguucuucggcgcgaucgccggguuucucgagggcgggugggagggcaugaucgccggcuggcacggguacaccagccacggcgcccacggggucgccguggcggccgaccugaaguccacccaggaggccaucaacaagaucaccaagaaucugaacucgcucuccgagcuggaggugaagaaccugcagcgccucagcggcgccauggacgagcugcacaacgagauccuggagcucgacgagaaggucgaugaccugcgggccgacacgaucuccagccagaucgagcuggcggugcuccuguccaacgagggcaucaucaacagcgaggacgagcaucuccuggcccuggagcgcaagcugaagaagaugcucgggcccuccgccguggacaucggcaacgggugcuucgagaccaagcacaagugcaaccagaccugccuggaucggaucgccgcgggcaccuucaacgccggggaguucucgcugcccaccuucgacucccucaacaucacggccgccagucugaacgacgacggccuggacaaccacaccauccugcucuacuacuccaccgccgcgaguucccuggccgucacccugaugcucgccaucuucaucguguacauggugagccgcgacaacgucuccugcagcaucugccuguga

SEQ ID NO: 15263 - RNA, 1755 nt, Artificial Sequence
  derived and/or modified CDS sequence (AUadapt) from InfluenzaB__AGX21754__HA
augaaggccaucaucgugcugcucauggucgugaccaguaacgccgaccgcaucugcaccggcaucacguccagcaacagcccccacguggucaagaccgcgacccagggggaggugaaugugaccggcgccaucccgcugacgaccacccccgccaagucccacuucgccaaccugaaggggaccaagacgcggggcaagcucugcccgaccugccugaacugcaccgaucuggacgucgcccucgggggccccaugugcgugggcaucaccccguccgcgaaggccucgauccugcacgaggugcgccccgucacguccgggugcuuccccaucaugcacgaccggaccaagauccgccagcugcccaaucuccugcggggcuacgagaagauccgccugagcgcccagaacgugaucaacgccgagaaggcgcccgggggccccuacaagcucgggaccuccggcagcugccccaaugccaccuccaagucgggcuucuucgccacgauggccugggccgugccccgggacgacaacaagaccgcgaccaacccgcugaccgucgaggugccccacaucugugccaacgaggaggaccagaucacgguguggggguuccacuccgacaacaagacccagaugaagaaccuguauggcgacagcaacccccagaaguucaccuccagcgccaacgggaucaccacgcacuaugucucccagaucggcggcuuccccgaccagaccgaggacgggggccucccgcagucggggcgcaucgugguggacuacaugguccagaagcccggcaagaccgggaccaucguguaccagcggggcauccugcugccccagaagguguggugcgccuccggccgcaguaaggucaucaaggggagccucccccugaucggcgaggccgacugccugcacgagaaguacgggggccucaacaaguccaagccguacuauacgggggagcacgcgaaggccaucggcaacugccccaucugggugaagacgccccugaagcuggccaacggcaccaaguaccggcccccggccaagcuccugaaggagcgcggguucuucggcgccaucgcgggguuccuggagggcgggugggagggcaugaucgccggcuggcauggguacaccucgcacggcgcccacgggguggccgucgccgcggaccucaaguccacccaggaggccaucaacaagaucaccaagaaccugaauagccuguccgagcucgaggugaagaaccugcagcggcugagcggcgccauggacgagcuccacaacgagauccuggagcuggacgagaaggucgaugaccuccgcgccgacaccaucuccucgcagaucgagcuggcggugcugcucuccaacgagggcaucaucaacagcgaggacgagcaccuccuggcccuggagcggaagcugaagaagaugcuggggcccuccgccguggauaucggcaacgggugcuucgagaccaagcacaagugcaaccagacgugccucgaucgcaucgccgccggcaccuucaacgcgggggaguucagccugcccaccuucgacucccugaacaucaccgccgccucgcucaaugacgacggccuggacaaccacaccauccugcuguacuacuccacggccgccaguucccucgcggucacccugaugaucgccaucuucaucguguacaugaucagccgggacaacguguccugcagcaucugccuguga

SEQ ID NO: 15264 - RNA, 1755 nt, Artificial Sequence
  derived and/or modified CDS sequence (AUadapt) from InfluenzaB__AGX21776__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaaguccuacuucgccaaccugaaggggacgcggacccgcggcaagcucugccccgacugccugaauugcaccgaccuggacguggcccucgggcggcccaugugcgugggcaucaccccguccgccaaggccagcauccugcacgagguccgccccgugacguccggcuguuuccccaucaugcacgaccggaccaagauccgccagcugcccaaccuccugcggggguacgagaacauccgccugagcacccagaaugugaucgacgcggagaaggccccgggcgggcccuaccggcucggcaccuccgggagcugccccaacgccacguccaagagcggcuucuuugccaccauggcgugggccguccccaaggacaacaacaagaacgccaccaacccgcugaccguggaggugcccuacgucuguacggagggcgaggaccagaucaccguguggggguuccacuccgacaacaagacccagaugaagaaccuguacggcgauagcaacccccagaaguucaccuccagcgccaacggggugacgacccacuacgucucccagaucggcggcuuucccgaccagaccgaggacgggggccucccgcagagcgggcgcaucgugguggacuacaugguccagaagcccggcaagaccgggacgaucguguaccagcggggcgugcugcugccccagaaggucuggugugccuccggccgcagcaaggugaucaaggggucgcucccccugaucggcgaggcggacugccugcacgagaaguacgggggccucaacaaguccaagccguauuacaccggggagcacgccaaggccaucggcaacugccccaucugggucaagacgccccugaagcuggccaacggcaccaaguaccggcccccggccaagcuccugaaggagcgcggguuuuucggcgcgaucgccggguuccuggagggcgggugggagggcaugaucgccggcuggcacggguacaccagccacggcgcccacgggguggccguggcggccgaucucaaguccacccaggaggccaucaacaagaucaccaagaaccugaacagccuguccgagcucgaggucaagaaccugcagcggcugagcggcgccauggacgagcuccauaacgagauccuggagcuggacgagaagguggacgaccuccgcgccgacaccaucuccagccagaucgagcuggcggugcugcucuccaaugagggcaucaucaacagcgaggacgagcaccuccuggcccuggagcggaagcugaagaagaugcuggggcccuccgccgucgacaucggcaacgggugcuuugagacgaagcacaagugcaaccagaccugccucgaccgcaucgccgcgggcaccuucaacgccggggaguuuagccugcccaccuucgacucccugaacaucaccgccgccagccucaacgaugacggccuggacaaccacacgauccugcuguacuacuccaccgccgcgagcucccucgccgugacccugaugcuggccaucuuuaucguguacauggucagccgggacaacguguccugcagcaucugccucuga

SEQ ID NO: 15265 - RNA, 1758 nt, Artificial Sequence; identical to SEQ ID NO: 14719
  derived and/or modified CDS sequence (AUadapt) from InfluenzaB__AGX21787__HA

SEQ ID NO: 15266 - RNA, 1755 nt, Artificial Sequence
  derived and/or modified CDS sequence (AUadapt) from InfluenzaB__AGX21798__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaaguccuacuucgccaaccugaaggggacgcggacccgcggcaagcucugccccgacugucugaacugcaccgaccuggacguggcccucgggcggcccaugugcgugggcaccacgccguccgccaaggccagcauccugcaugagguccgccccgugaccuccggcugcuuccccaucaugcacgaccggaccaagauccgccagcugcccaaccuccugcggggguacgagaacauccgccugaguacccagaacgugaucgacgcggagaaggccccgggcgggcccuaccggcucggcacguccgggagcugccccaacgccaccuccaagaguggcuucuucgccaccauggcgugggccguccccaaggacaacaacaagaacgccaccaauccgcugacgguggaggugcccuacgucugcaccgagggcgaggaccagaucaccguguggggguuccacuccgacaauaagacccagaugaagaaccuguacggcgacagcaacccccagaaguucacguccagcgccaauggggugaccacccacuacgucucccagaucggcggcuuccccgaccagaccgaggacgggggccucccgcagagcgggcgcaucgugguggauuacaugguccagaagcccggcaagacggggaccaucguguaccagcggggcgugcugcugccccagaaggucuggugcgccuccggccgcagcaaggugaucaaggggucgcucccccugaucggcgaggcggacugucugcacgagaaguacgggggccucaacaaguccaagccguacuacaccggggagcacgccaaggccaucggcaauugccccaucugggucaagacgccccugaagcuggccaacggcaccaaguaccggcccccggccaagcuccugaaggagcgcggguucuucggcgcgaucgccggguuccuggagggcgggugggagggcaugaucgccggcuggcacggguauaccagccacggcgcccacgggguggccguggcggccgaccucaaguccacccaggaggccaucaacaagaucaccaagaaccugaauagccuguccgagcucgaggucaagaaccugcagcggcugagcggcgccauggacgagcuccacaacgagauccuggagcuggaugagaagguggacgaccuccgcgccgacacgaucuccagccagaucgagcuggcggugcugcucuccaacgagggcaucaucaacagugaggacgagcaccuccuggcccuggagcggaagcugaagaagaugcuggggcccuccgccgucgacaucggcaacgggugcuucgagaccaagcacaaguguaaccagaccugccucgaccgcaucgccgcgggcaccuucaacgccggggaguucagucugcccaccuucgacucccugaacaucacggccgccagccucaacgacgauggccuggacaaccacaccauccugcuguacuacuccaccgccgcgagcucccucgccgugacccugaugcuggccaucuuuaucguguacauggucagccgggacaacguguccugcagcaucugccucuga

SEQ ID NO: 15267 - RNA, 1755 nt, Artificial Sequence
  derived and/or modified CDS sequence (AUadapt) from InfluenzaB__AGX21809__HA
augaaggccaucaucgugcugcucauggucgugaccaguaacgccgaccgcaucugcaccggcaucacguccagcaacaguccccacguggucaagaccgcgacccagggggaggugaacgugaccggcgucaucccgcugacgaccacccccaccaaguccuacuucgccaaccugaaggggacgcggacccgcggcaagcucugccccgauugccugaacugcaccgaccuggacguggcccucgggcggcccaugugugugggcaccacgccguccgccaaggccagcauccugcacgagguccgccccgugaccuccggcugcuuccccaucaugcacgaccggaccaagauccgccagcugcccaaucuccugcggggguacgagaacauccgccugagcacccagaacgugaucgacgcggagaaggccccgggcgggcccuaucggcucggcacguccgggagcugccccaacgccaccuccaagagcggcuucuucgccaccauggcgugggccguccccaaggauaacaacaagaacgccaccaacccgcugacgguggaggugcccuacgucugcaccgagggcgaggaucagaucaccguguggggguuccacuccgacaacaagacccagaugaagaaccuguauggcgacagcaacccccagaaguucacguccagcgccaacggggugaccacccauuacgucucccagaucggcggcuuccccgaccagaccgaggacgggggccucccgcagagcgggcgcaucgugguggauuacaugguccagaagcccggcaagacggggaccaucguguaccagcggggcgugcugcugccccagaaggucuggugcgccuccggccgcagcaaggugaucaaggggagccucccccugaucggcgaggcggacugucugcacgagaaguacgggggccucaacaagucccggccguacuacaccggggagcacgccaaggccaucggcaauugccccaucugggucaagacgccccugaagcuggccaacggcaccaaguaccggcccccggccaagcuccugaaggagcgcggguucuucggcgcgaucgccggguuucuggagggcgggugggagggcaugaucgccggcuggcacggguacaccagccacggcgcccacgggguggccguggcggccgaccucaaguccacccaggaggccaucaauaagaucaccaagaaccugaacagccuguccgagcucgaggucaagaaccugcagcgccugagcggcgccauggaugagcuccacaacgagauccuggagcuggacgagaagguggacgaccuccgggccgacacgaucuccagucagaucgagcuggcggugcugcucuccaacgagggcaucaucaacagcgaggacgagcaccuccuggcccuggagcgcaagcugaagaagaugcuggggcccuccgccgucgacaucggcaaugggugcuucgagaccaagcacaagugcaaccagaccugucucgaccggaucgccgcgggcaccuucaacgccggggaguucagccugcccaccuucgauucccugaacaucacggccgccagccucaacgacgacggccuggauaaccacaccauccugcuguacuacuccaccgccgcgagcucccucgccgugacccugaugcuggccaucuucaucguguauauggucagccgcgacaacguguccugcagcaucugccucuga

SEQ ID NO: 15268 - RNA, 1755 nt, Artificial Sequence
  derived and/or modified CDS sequence (AUadapt) from InfluenzaB__AGX21820__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacugcaccgaucuggacguggcccucgggcggcccaugugcgugggcaccacgccguccgccaaggccagcauccugcacgagguccgccccgugaccuccggcugcuuccccaucaugcacgaucggaccaagauccgccagcugcccaaccuccugcggggguacgagaacauccgccugucgacccagaacgugaucgacgcggagaaggccccgggcgggcccuaccggcucggcacguccgggagcugucccaacgccaccaacaaguccggcuucuucgccaccauggcgugggccguccccaaggacaacaacaagaaugccaccaacccgcugacgguggaggugcccuacaucugcaccgagggcgaggaccagaucaccgucuggggguuccacagcgacaauaagacccagaugaagaaccuguacggcgacuccaacccccagaaguucacgagcuccgccaacggggugaccacccauuacgugucgcagaucggcggcuuccccgaccagaccgaggacgggggccucccgcaguccgggcgcaucgucguggacuacaugaugcagaagcccggcaagacggggaccaucguguaccagcggggcguccugcugccccagaagguguggugugccagcggccgcuccaaggugaucaaggggagccucccccugaucggcgaggcggacugccugcacgagaaguacgggggccucaacaagaguaagccguacuacaccggggagcacgccaaggccaucggcaacugccccaucugggucaagacgccccugaagcuggccaacggcaccaaguaccggcccccggccaagcuccugaaggagcgcggguucuuuggcgcgaucgccggguuccuggagggcgggugggagggcaugaucgccggcuggcacggguacaccucccacggcgcccacgggguggccgucgcggccgaccucaagucgacccaggaggccaucaauaagaucaccaagaaccugaacucccugagcgagcucgaggugaagaaccugcagcggcuguccggcgccauggacgagcuccacaacgagauccuggagcuggacgagaagguggaugaccuccgcgccgacacgaucagcucccagaucgagcuggcgguccugcucagcaacgagggcaucaucaacuccgaggacgagcaucuccuggcccuggagcggaagcugaagaagaugcuggggcccucggccguggacaucggcaacgggugcuucgagaccaagcacaagugcaaccagaccugucucgaccgcaucgccgcgggcaccuucaacgccggggaguucucccugcccaccuucgacagccugaauaucacggccgccucccucaacgacgacggccuggacaaccacaccauccugcuguacuacaguaccgccgcguccagccucgccgugacccugaugcuggccaucuucaucgucuacauggugucccgggacaacgugagcugcuccaucugccucuga

SEQ ID NO: 15269 - RNA, 1755 nt, Artificial Sequence; identical to SEQ ID NO: 14763
  derived and/or modified CDS sequence (AUadapt) from InfluenzaB__AGX21831__HA

SEQ ID NO: 15270 - RNA, 1755 nt, Artificial Sequence; identical to SEQ ID NO: 14766
  derived and/or modified CDS sequence (AUadapt) from InfluenzaB__AGX21842__HA

SEQ ID NO: 15271 - RNA, 1755 nt, Artificial Sequence; identical to SEQ ID NO: 14766
  derived and/or modified CDS sequence (AUadapt) from InfluenzaB__AGX21853__HA

SEQ ID NO: 15272 - RNA, 1755 nt, Artificial Sequence
  derived and/or modified CDS sequence (AUadapt) from InfluenzaB__AGX21864__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacugcaccgaucuggacguggcccucgggcggcccaugugcgugggcaccacgccguccgccaaggccagcauccugcacgagguccgccccgugaccuccggcugcuuccccaucaugcacgaucggaccaagauccgccagcugcccaaccuccugcggggguacgagaacauccgccugucgaaccagaacgugaucgacgcggagaaggccccgggcgggcccuaccggcucggcaccuccgggaguugccccaacgccacguccaagagcggcuucuucgccaccauggcgugggccguccccaaggacaacaauaagaacgccaccaacccgcugaccguggaggugcccuacaucugcacggagggcgaggaccagaucaccgucuggggguuccacuccgacaauaagacccagaugaagaaccuguacggcgacagcaacccccagaaguucaccuccucggccaacggggugacgacccauuacgugucccagaucggcggcuuccccgaccagaccgaggacgggggccucccgcagagcgggcgcaucgucguggacuacaugaugcagaagcccggcaagaccgggacgaucguguaucagcggggcguccugcugccccagaagguguggugcgccuccggccgcagcaaggugaucaaggggagccucccccugaucggcgaggcggacugccugcacgagaaguacgggggccucaacaaguccaagccguauuacaccggggagcacgccaaggccaucggcaacugccccaucugggucaagacgccccugaagcuggccaacggcaccaaguaccggcccccggccaagcuccugaaggagcgcggguucuuuggcgcgaucgccggguuccuggagggcgggugggagggcaugaucgccggcuggcacggguacaccagccacggcgcccacgggguggccgucgcggccgaccucaaguccacccaggaggccaucaacaagaucaccaagaaucugaacucgcuguccgagcucgaggugaagaaccugcagcggcugagcggcgccauggacgagcuccacaacgagauccuggagcuggacgagaagguggaugaccuccgcgccgacaccaucuccagccagaucgagcuggcgguccugcucuccaacgagggcaucaucaacagcgaggacgagcaucuccuggcccuggagcggaagcugaagaagaugcuggggcccuccgccguggacaucggcaacgggugcuucgagacgaagcacaagugcaaccagaccugccucgaucgcaucgccgcgggcaccuucaacgccggggaguucucgcugcccaccuucgacucccugaacaucaccgccgccagucucaacgacgacggccuggacaaccacacgauccugcuguacuacuccaccgccgcgaguucccucgccgugacccugaugcuggccaucuucaucgucuacauggugagccgggacaacguguccugcagcaucugccucuga

SEQ ID NO: 15273 - RNA, 1755 nt, Artificial Sequence; identical to SEQ ID NO: 14764
  derived and/or modified CDS sequence (AUadapt) from InfluenzaB__AGX21875__HA

SEQ ID NO: 15274 - RNA, 1755 nt, Artificial Sequence; identical to SEQ ID NO: 14763
  derived and/or modified CDS sequence (AUadapt) from InfluenzaB__AGX21886__HA

SEQ ID NO: 15275 - RNA, 1755 nt, Artificial Sequence; identical to SEQ ID NO: 14763
  derived and/or modified CDS sequence (AUadapt) from InfluenzaB__AGX21897__HA

SEQ ID NO: 15276 - RNA, 1755 nt, Artificial Sequence; identical to SEQ ID NO: 14763
  derived and/or modified CDS sequence (AUadapt) from InfluenzaB__AGX21908__HA

SEQ ID NO: 15277 - RNA, 1755 nt, Artificial Sequence
  derived and/or modified CDS sequence (AUadapt) from InfluenzaB__AGX21919__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaaguccuacuucgccaaccugaaggggacgcggacccgcggcaagcucugccccgacugccugaauugcaccgaccuggacguggcccucgggcggcccaugugcgugggcaccacgccguccgccaaggccagcauccugcacgagguccgccccgugaccuccggcuguuuccccaucaugcacgaccggaccaagauccgccagcugcccaaccuccugcggggguacgagaacauccgccugagcacccagaaugugaucgacgcggagaaggccccgggcgggcccuaccggcucggcacguccgggagcugccccaacgccaccuccaagagcggcuucuuugccaccauggcgugggccguccccaaggacaacaacaagaacgccaccaacccgcugacgguggaggugcccuacaucuguaccgagggcgaggaccagaucaccgucuggggguuccacuccgacaacaagacccagaugaagaaccuguacggcgauucgaacccccagaaguucacguccagcgccaacggggugaccacccacuacgugucccagaucggcggcuuucccgaccagaccgaggacgggggccucccgcagagcgggcgcaucgucguggacuacaugaugcagaagcccggcaaggccgggacgaucguguaccagcggggcguccugcugccccagaagguguggugugcguccggccgcagcaaggugaucaaggggagccucccccugaucggcgaggccgacugccugcacgagaaguacgggggccucaacaaguccaagccguauuacaccggggagcacgccaaggccaucggcaacugccccaucugggucaagacgccccugaagcuggccaacggcaccaaguaccggcccccggcgaagcuccugaaggagcgcggguuuuucggcgccaucgccggguuccuggagggcgggugggagggcaugaucgccggcuggcacggguacaccagccacggcgcccacgggguggcggucgccgccgaucucaaguccacccaggaggccaucaacaagaucaccaagaaccugaacagccuguccgagcucgaggugaagaaccugcagcggcugucgggcgccauggacgagcuccauaacgagauccuggagcuggacgagaagguggacgaccuccgcgcggacaccaucuccagccagaucgagcuggccguccugcucuccaaugagggcaucaucaacagcgaggacgagcaccuccuggcccuggagcggaagcugaagaagaugcuggggcccuccgccguggacaucggcaacgggugcuuugagacgaagcacaagugcaaccagaccugccucgaccgcaucgcggccggcaccuucaacgccggggaguuuagccugcccaccuucgacucccugaacaucaccgccgccagccucaacgaugacggccuggacaaccacacgauccugcuguacuacuccaccgcggccagcucccucgccgugacccugaugcuggccaucuuuaucgucuacauggugagccgggacaacguguccugcagcaucugccucuga

SEQ ID NO: 15278 - RNA, 1755 nt, Artificial Sequence; identical to SEQ ID NO: 14766
  derived and/or modified CDS sequence (AUadapt) from InfluenzaB__AGX21941__HA

SEQ ID NO: 15279 - RNA, 1755 nt, Artificial Sequence; identical to SEQ ID NO: 14763
  derived and/or modified CDS sequence (AUadapt) from InfluenzaB__AGX21952__HA

SEQ ID NO: 15280 - RNA, 1755 nt, Artificial Sequence; identical to SEQ ID NO: 14766
  derived and/or modified CDS sequence (AUadapt) from InfluenzaB__AGX21963__HA

SEQ ID NO: 15281 - RNA, 1755 nt, Artificial Sequence
  derived and/or modified CDS sequence (AUadapt) from InfluenzaB__AGX21974__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuauuucgccaaccugaaggggacgcggacccgcggcaagcucugccccgacugccugaacugcaccgaccuggauguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguaugagaacauccgccugucgacccagaacgugaucgacgcggagaaggccccgggcgggcccuaccggcucggcacguccgggagcugccccaacgccaccuccaagaguggcuucuucgccaccauggcgugggccguccccaaggugaacaacaagaacgccaccaacccgcugacgguggagguccccuacaucugcaccgagggcgaggaucagaucaccguguggggguuccacuccgacaacaagacccagaugaagaaccuguacggcgacagcaauccccagaaguucacguccagcgccaacggggugaccacccacuacgucucccagaucggcucguuccccgaccagaccgaggauggcgggcucccgcaguccggccgcaucgugguggacuacaugaugcagaagcccgggaagacgggcaccaucgucuaccagcgcggggugcugcugccccagaagguguggugcgccagcggccggagcaaggucaucaagggcucccucccccugaucggggaggcggacugccugcaugagaaguacggcgggcucaacaagagcaagccguacuacaccggcgagcacgccaaggccaucgggaacugccccaucugggugaagacgccccugaagcuggccaauggcaccaaguaccggcccccggccaagcuccugaaggagcgcggcuucuucggggcgaucgccggcuuccuggagggcgggugggaggggaugaucgccggcuggcacggcuacaccucccacggggcccacggcgucgccguggcggccgaucucaagucgacccaggaggccaucaacaagaucaccaagaaccugaacucccugagcgagcucgaggugaagaaccugcagcggcuguccggggccauggacgagcuccacaaugagauccuggagcuggacgagaaggucgacgaccuccgcgccgacacgaucagcucccagaucgagcuggcggugcugcucagcaacgagggcaucaucaacuccgaggaugagcaccuccuggcccuggagcggaagcugaagaagaugcugggccccagcgccguggacaucgggaacggcugcuucgagaccaagcacaagugcaaucagaccugccucgaccgcaucgccgcggggaccuucaacgccggcgaguucucccugcccaccuucgacucgcugaauaucacggccgccucccucaacgacgacgggcuggacaaccacaccauccugcuguacuacaguaccgccgcguccagccucgccgucacccugaugcuggccaucuucaucguguacaugaucucccgggacaacgugagcugcagcaucugccucuga

SEQ ID NO: 15282 - RNA, 1755 nt, Artificial Sequence; identical to SEQ ID NO: 14766
  derived and/or modified CDS sequence (AUadapt) from InfluenzaB__AGX21985__HA

SEQ ID NO: 15283 - RNA, 1755 nt, Artificial Sequence; identical to SEQ ID NO: 14764
  derived and/or modified CDS sequence (AUadapt) from InfluenzaB__AGX21996__HA

SEQ ID NO: 15284 - RNA, 1755 nt, Artificial Sequence; identical to SEQ ID NO: 14764
  derived and/or modified CDS sequence (AUadapt) from InfluenzaB__AGX22007__HA

SEQ ID NO: 15285 - RNA, 1755 nt, Artificial Sequence; identical to SEQ ID NO: 14763
  derived and/or modified CDS sequence (AUadapt) from InfluenzaB__AGX22018__HA

SEQ ID NO: 15286 - RNA, 1755 nt, Artificial Sequence; identical to SEQ ID NO: 14763
  derived and/or modified CDS sequence (AUadapt) from InfluenzaB__AGX22029__HA

SEQ ID NO: 15287 - RNA, 1755 nt, Artificial Sequence; identical to SEQ ID NO: 14763
  derived and/or modified CDS sequence (AUadapt) from InfluenzaB__AGX22040__HA

SEQ ID NO: 15288 - RNA, 1755 nt, Artificial Sequence
  derived and/or modified CDS sequence (AUadapt) from InfluenzaB__AGX22051__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacuguaccgaccuggacguggcccucgggcggcccaugugcgugggcaccacgccguccgccaaggccagcauccugcacgagguccgccccgugaccuccggcugcuuccccaucaugcaugaccggaccaagauccgccagcugcccaaccuccugcggggguacgagaacauccgccugagcacccagaacgugaucgacgcggagaaggccccgggcgggcccuaucggcucggcacguccgggagcugccccaacgccaccuccaagagcggcuucuucgccaccauggcgugggccguccccaaggacaauaacaagaacgccaccaacccgcugacgguggaggugcccuacaucugcaccgagggcgaggaccagaucaccgucuggggguuccauuccgacaacaagacccagaugaagaaccuguacggcgacucgaacccccagaaguuuacguccagcgccaacggggugaccacccacuacgugucccagaucggcggcuuccccgaccagaucgaggacgggggccucccgcagagugggcgcaucgucguggacuacaugaugcagaagcccggcaagaccgggacgaucguguaccagcggggcguccugcugccccagaagguguggugcgccuccggccgcagcaaggugaucaaggggagccucccccugaucggcgaggcggacugucugcacgagaaguacgggggccucaacaaguccaagccguacuacaccggggagcacgccaaggccaucggcaacugucccaucugggucaagacgccccugaagcuggccaacggcaccaaguaccggcccccggccaagcuccugaaggagcgcggguucuucggcgcgaucgccggguuccuggagggcgggugggagggcaugaucgccggcuggcacggguacaccagucacggcgcccacgggguggccgucgcggccgaccucaaguccacccaggaggccaucaacaagaucaccaagaaccugaacagccuguccgagcucgaggugaagaaucugcagcggcugucgggcgccauggacgcccuccacaacgagauccuggagcuggacgagaagguggacgaccuccgcgcggauaccaucuccagccagaucgagcuggccguccugcucuccaacgagggcaucaucaacagcgaggacgagcaccuccuggcccuggagcggaagcugaagaagaugcuggggcccuccgccguggagaucggcaacggguguuucgagacgaagcacaagugcaaccagaccugccucgaccgcaucgcggccggcaccuucaaugccggggaguucagccugcccaccuucgacucccugaacaucaccgccgccagccucaacgaugacggccuggacaaccacacgauccugcuguacuacuccaccgcggccagcucccucgccgugacccugaugcuggccaucuuuaucgucuacauggugagccgggacaacguguccugcagcaucugccucuga

SEQ ID NO: 15289 - RNA, 1755 nt, Artificial Sequence; identical to SEQ ID NO: 14763
  derived and/or modified CDS sequence (AUadapt) from InfluenzaB__AGX22062__HA

SEQ ID NO: 15290 - RNA, 1755 nt, Artificial Sequence
  derived and/or modified CDS sequence (AUadapt) from InfluenzaB__AGX22073__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacugcaccgaucuggacguggcccucgggcggcccaugugcgugggcaccacgccguccgccaaggccagcauccugcacgagguccgccccgugaccuccggcugcuuccccaucaugcacgaucggaccaagauccgccagcugcccaaccuccugcggggguacgagaacauccgccugucgacccagaacgugaucgacgcggagaaggccccgggcgggcccuaccggcucggcacguccgggagcugucccaacgccaccuccaagagcggcuucuucgccaccauggcgugggccguccccaaggacaacaacaagaaugccaccaacccgcugacgguggaggugcccuacaucugcaccgagggcgaggaccagaucaccgucuggggguuccacuccgacaacaagacccagaugaagaaucuguacggcgacagcaacccccagaaguucacguccucggccaacggggugaccacccacuaugugucccagaucggcggcuuccccgaccagaccgaggacgggggccucccgcagagcgggcgcaucgucguggacuacaugaugcagaagcccggcaagacggggaccaucguguaccagcggggcguccugcugccccagaagguguggugugccuccggccgcagcaaggugaucaaggggagccucccccugaucggcgaggcggacugccugcacgagaaguacgggggccucaacaaguccaagccguacuauaccggggagcacgccaaggccaucggcaacugccccaucugggucaagacgccccugaagcuggccaacggcaccaaguaccggcccccggccaagcuccugaaggagcgcggguucuucggcgcgaucgccggguuuaucgagggcgggugggagggcaugaucgccggcuggcacggguacaccagccacggcgcccacgggguggccgucgcggccgaccugaaguccacccaggaggccaucaacaagaucaccaagaaccucaauucgcuguccgagcuggaggugaagaaccuccagcggcugagcggcgccauggacgagcugcacaacgagauccucgagcuggacgagaagguggacgaucugcgcgccgacacgaucuccagccagaucgagcucgcgguccugcuguccaacgagggcaucaucaacagcgaggacgagcaccuccuggcccuggagcggaagcucaagaagaugcuggggcccuccgccguggauaucggcaacgggugcuucgagaccaagcacaagugcaaccagaccugccuggaccgcaucgccgcgggcaccuuuaacgccggggacuucucgcuccccaccuucgacucccugaacaucacggccgccagucugaacgacgacggccucgacaaccacaccauccugcuguacuacuccaccgccgcgaguucccuggccgugacccucaugcuggccaucuucaucgucuacauggugagccgggacaacguguccugcagcaucugccuguga

SEQ ID NO: 15291 - RNA, 1755 nt, Artificial Sequence; identical to SEQ ID NO: 14766
  derived and/or modified CDS sequence (AUadapt) from InfluenzaB__AGX22095__HA

SEQ ID NO: 15292 - RNA, 1755 nt, Artificial Sequence; identical to SEQ ID NO: 14764
  derived and/or modified CDS sequence (AUadapt) from InfluenzaB__AGX22106__HA

SEQ ID NO: 15293 - RNA, 1755 nt, Artificial Sequence
  derived and/or modified CDS sequence (AUadapt) from InfluenzaB__AGX22128__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaaguccuacuucgccaaccugaaggggacgcggacccgcggcaagcucugccccgacugccugaauugcaccgaccuggacguggcccucgggcggcccaugugcgugggcaccacgccguccgccaaggccagcauccugcacgagguccgccccgugaccuccggcuguuuccccaucaugcacgaccggaccaagauccgccagcugcccaaccuccugcggggguacgagaacauccgccugagcacccagaaugugaucgacgcggagaacgccccgggcgggcccuaccggcucggcacguccgggagcugccccaacgccaccuccaagagcggcuuuuucgccaccauggcgugggccguccccaaggacaacaacaagaacgccaccaacccgcugacgguggaggugcccuaugucugcaccgagggcgaggaccagaucaccguguggggguuccacuccgacaacaagacccagaugaagaaccuguauggcgacucgaacccccagaaguucacguccagcgccaacggggugaccacccacuaugucucccagaucggcggcuuccccgcccagaccgaggacgggggccucccgcagagcgggcgcaucgugguggacuacaugguccagaagccccggaagacgggcaccaucguguaccagcgcggggugcugcugccccagaaggucuggugugcguccggccggagcaaggugaucaagggcagccucccccugaucggggaggccgacugccugcacgagaaguacggcgggcucaacaaguccaagccguauuacaccggcgagcacgccaaggccaucgggaacugccccaucugggucaagacgccccugaagcuggccaacggcaccaaguaccggcccccggcgaagcuccugaaggagcgcggcuuuuucggggccaucgccggcuuccuggagggcgggugggaggggaugaucgccggcuggcacggcuacaccagccacggggcccacggcguggcgguggccgccgaucucaaguccacccaggaggccaucaacaagaucaccaagaaccugaacagccuguccgagcucgagaucaagaaccugcagcgccugucgggggccaugaacgagcuccauaacgagauccuggagcuggacgagaaggucgacgaccuccgggcggacacgaucuccagccagaucgagcuggccgugcugcucuccaaugagggcaucaucaacagcgaggacgagcaccuccuggcccuggagcgcaagcugaagaagaugcugggccccuccgccguggacaucgggaacggcugcuuugagaccaagcacaagugcaaccagaccugccucgaccggaucgcggccgggaccuucaacgccggcgaguuuagccugcccaccuucgacucccugaacaucacggccgccagccucaacgaugacgggcuggacaaccacaccauccugcuguacuacuccaccgcggccagcucccucgccgucacccugaugcuggccaucuuuaucguguacauggugagccgcgacaacgucuccugcagcaucugccucuga

SEQ ID NO: 15294 - RNA, 1755 nt, Artificial Sequence
  derived and/or modified CDS sequence (AUadapt) from InfluenzaB__AGX22139__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaaguccuacuucgccaaccugaaggggacgcggacccgcggcaagcucugccccgacugccugaauugcaccgaccuggacguggcccucgggcggcccaugugcgugggcaccacgccguccgccgaggccagcauccugcacgagguccgccccgugaccuccggcuguuuccccaucaugcacgaccggaccaagauccgccagcugcccaaccuccugcggggguacgagaacauccgccugagcacccagaaugugaucgacgcggagaaggccccgggcgggcccuaccggcucggcacguccgggagcugccccaacgccaccuccaagagcggcuucuuugccaccauggcgugggccguccccaaggacaacaacaagaacgccaccaacccgcugacgguggaggugcccuacaucuguaccgagggcgaggaccagaucaccgucuggggguuccacuccgacaacaagacccagaugaagaaccuguacggcgauucgaacccccagaaguucacguccagcgccaacggggugaccacccacuacgugucccagaucggcggcuuucccgaccagaccgaggacgggggccucccgcagagcgggcgcaucgucguggacuacaugaugcagaagcccggcaagacggggaccaucguguaccagcggggcguccugcugccccagaagguguggugugccuccggccgcagcaaggugaucaaggggagccucccccugaucggcgaggcggacugccugcacgagaaguacgggggccucaacaaguccaagccguauuacaccggggagcacgccaaggccaucggcaacugccccaucugggucaagacgccccugaagcuggccaacggcaccaaguaccggcccccggccaagcuccugaaggagcgcggguuuuucggcgcgaucgccggguuccuggagggcgggugggagggcaugaucgccggcuggcacggguacaccagccacggcgcccacgggguggccgucgcggccgaucucaaguccacccaggaggccaucaacaagaucaccaagaaccugaacagccuguccgagcucgaggugaagaaccugcagcggcugucgggcgccauggacgagcuccauaacgagauccuggagcuggacgagaagguggacgaccuccgcgccgacacgaucuccagccagaucgagcuggcgguccugcucuccaaugagggcaucaucaacagcgaggacgagcaccuccuggcccuggagcggaagcugaagaagaugcuggggcccuccgccguggacaucggcaacgggugcuuugagaccaagcacaagugcaaccagaccugccucgaccgcaucgccgcgggcaccuucaacgccggggaguuuagccugcccaccuucgacucccugaacaucacggccgccagccucaacgaugacggccuggacaaccacaccauccugcuguacuacuccaccgccgcgagcucccucgccgugacccugaugcuggccaucuuuaucgucuacauggugagccgggacaacguguccugcagcaucugccucuga

SEQ ID NO: 15295 - RNA, 1755 nt, Artificial Sequence; identical to SEQ ID NO: 15294
  derived and/or modified CDS sequence (AUadapt) from InfluenzaB__AGX22150__HA

SEQ ID NO: 15296 - RNA, 1755 nt, Artificial Sequence; identical to SEQ ID NO: 15294
  derived and/or modified CDS sequence (AUadapt) from InfluenzaB__AGX22161__HA

SEQ ID NO: 15297 - RNA, 1755 nt, Artificial Sequence; identical to SEQ ID NO: 14763
  derived and/or modified CDS sequence (AUadapt) from InfluenzaB__AGX22172__HA

SEQ ID NO: 15298 - RNA, 1755 nt, Artificial Sequence; identical to SEQ ID NO: 15294
  derived and/or modified CDS sequence (AUadapt) from InfluenzaB__AGX22183__HA

SEQ ID NO: 15299 - RNA, 1755 nt, Artificial Sequence; identical to SEQ ID NO: 15294
  derived and/or modified CDS sequence (AUadapt) from InfluenzaB__AGX22194__HA

SEQ ID NO: 15300 - RNA, 1755 nt, Artificial Sequence; identical to SEQ ID NO: 15294
  derived and/or modified CDS sequence (AUadapt) from InfluenzaB__AGX22205__HA

SEQ ID NO: 15301 - RNA, 1755 nt, Artificial Sequence; identical to SEQ ID NO: 14764
  derived and/or modified CDS sequence (AUadapt) from InfluenzaB__AGX22216__HA

SEQ ID NO: 15302 - RNA, 1755 nt, Artificial Sequence; identical to SEQ ID NO: 14766
  derived and/or modified CDS sequence (AUadapt) from InfluenzaB__AGX22227__HA

SEQ ID NO: 15303 - RNA, 1755 nt, Artificial Sequence
  derived and/or modified CDS sequence (AUadapt) from InfluenzaB__AGX22238__HA
augaaggccaucaucgugcugcucauggucgugaccaguaacgccgaccgcaucugcaccggcaucacguccagcaacagcccccacauggugaagaccgcgacccagggggaggucaaugugaccggcgugaucccgcugacgaccacccccaccaaguccuacuucgccaaccugaaggggacgcggacccgcggcaagcucugccccgacugccugaacugcaccgaucuggacgucgcccucgggcggcccaugugcgugggcaccacgccguccgccaaggccagcauccugcacgaggugcgccccgucaccuccggcugcuuccccaucaugcacgaucggaccaagauccgccagcugcccaaccuccugcggggguacgagaacauccgccugucgacccagaacgugaucgacgcggagaaggccccgggcgggcccuaccggcucggcacguccgggagcugucccaacgccaccuccaagagcggcuucuucgccaccauggcgugggccgugcccaaggacaacaacaagaaugccaccaacccgcugacggucgaggugcccuacaucugcaccgagggcgaggaccagaucaccguguggggguuccacuccgacaacaagacccagaugaagaaucuguacggcgacagcaacccccagaaguucacguccucggccaacggggucaccacccauuacgugucccagaucggcggcuuccccgaccagaccgaggacgggggccucccgcagagcgggcgcaucguggucgacuacaugaugcagaagcccggcaagacggggaccaucguguaccagcggggcgugcugcugccccagaaggucuggugugccuccggccgcagcaaggugaucaaggggagccucccccugaucggcgaggcggacugccugcacgagaaguacgggggccucaacaaguccaagccguauuacaccggggagcacgccaaggccaucggcaacugccccaucugggugaagacgccccugaagcuggccaacggcaccaaguaccggcccccggccaagcuccugaaggagcgcggguucuucggcgcgaucgccggguuucuggagggcgggugggagggcaugaucgccggcuggcacggguacaccagccacggcgcccacggggucgccguggcggccgaccucaaguccacccaggaggccaucaacaagaucaccaagaaucugaacucgcuguccgagcucgaggucaagaaccugcagcggcugagcggcgccauggacgagcuccacaacgagauccuggagcuggacgagaagguggaugaccuccgcgccgacacgaucuccagccagaucgagcuggcggugcugcucuccaacgagggcaucaucaacagcgaggacgagcaucuccuggcccuggagcggaagcugaagaagaugcuggggcccuccgccgucgacaucggcaacgggugcuucgagaccaagcacaagugcaaccagaccugccucgaucgcaucgccgcgggcaccuucaacgccggggaguucucgcugcccaccuucgacucccugaacaucacggccgccagucucaacgacgacggccuggacaaccacaccauccugcuguacuacuccaccgccgcgaguucccucgccgugacccugaugcuggccaucuucaucguguacauggucagccgggacaacguguccugcagcaucugccucuga

SEQ ID NO: 15304 - RNA, 1755 nt, Artificial Sequence; identical to SEQ ID NO: 14764
  derived and/or modified CDS sequence (AUadapt) from InfluenzaB__AGX22249__HA

SEQ ID NO: 15305 - RNA, 1755 nt, Artificial Sequence; identical to SEQ ID NO: 14763
  derived and/or modified CDS sequence (AUadapt) from InfluenzaB__AGX22260__HA

SEQ ID NO: 15306 - RNA, 1755 nt, Artificial Sequence
  derived and/or modified CDS sequence (AUadapt) from InfluenzaB__AGX22271__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacugcaccgaucuggacguggcccucgggcggcccaugugcgugggcaccacgccguccgccaaggccagcauccugcacgagguccgccccgugaccuccggcugcuuccccaucaugcacgaucggaccaagauccgccagcugcccaaccuccugcggggguacgagaacauccgccugucgacccagaacgugaucgacgcggagaaggccccgggcgggcccuaccggcucggcacguccgggagcugucccaacgccaccuccaagagcggcuucuucgccaccauggcgugggccguccccaaggacaacaacaagaaugccaccaacccgcugacgguggaggugcccuacaucugcaccgagggcgaggaccagaucaccgucuggggguuccacuccgacaacaagacccagaugaagaaucuguacggcgacagcaacccccagaaguucacguccagcgccaacggggugaccacccauuacgugucccagaucggcggcuuccccgaccagaccgaggacgggggccucccgcagucggggcgcaucgucguggacuacaugaugcagaagcccggcaagacggggaccaucguguaccagcggggcguccugcugccccagaagguguggugugccuccggccgcagcaaggugaucaaggggagccucccccugaucggcgaggcggacugccugcacgagaaguacgggggccucaacaaguccaagccguauuacaccggggagcacgccaaggccaucggcaacugccccaucugggucaagacgccccugaagcuggccaacggcaccaaguaccggcccagcgccaagcuccugaaggagcgcggguucuuuggcgcgaucgccggguuccuggagggcgggugggagggcaugaucgccggcuggcacggguacaccucccacggcgcccacgggguggccgucgcggccgaccucaagucgacccaggaggccaucaauaagaucaccaagaaccugaacucccugagcgagcucgaggugaagaaccugcagcggcuguccggcgccauggacgagcuccacaacgagauccuggagcuggacgagaagguggaugaccuccgcgccgacacgaucagcucccagaucgagcuggcgguccugcucagcaacgagggcaucaucaacuccgaggacgagcaucuccuggcccuggagcggaagcugaagaagaugcuggggccgagcgccguggagaucggcaacgggugcuucgagaccaagcacaagugcaaccagaccugccucgaucgcaucgccgcgggcaccuucaacgccggggaguucucccugcccaccuucgacucgcugaacaucacggccgccucccucaaugacgacggccuggacaaccacaccauccugcuguacuacagcaccgccgcguccagucucgccgugacccugaugcuggccaucuucaucgucuacauggugucccgggacaacgugagcugcagcaucugccucuga

SEQ ID NO: 15307 - RNA, 1755 nt, Artificial Sequence
  derived and/or modified CDS sequence (AUadapt) from InfluenzaB__AGX22282__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacugcaccgaucuggacguggcccucgggcggcccaugugcgugggcaccacgccguccgccaaggccagcauccugcacgagguccgccccgugaccuccggcugcuuccccaucaugcacgaucggaccaagauccgccagcugcccaaccuccugcggggguacgagaacauccgccugucgacccagaacgugaucgacgcggagaaggccccgggcgggcccuaccggcucggcacguccgggagcugucccaacgccaccuccaagagcggcuucuucgccaccauggcgugggccguccccaaggacaacaacaagaaugccaccaacccgcugacgguggaggugcccuacaucugcaccgagggcgaggaccagaucaccgucuggggguuccacuccgacaacaagacccagaugaagaaucuguacggcgacagcaacccccagaaguucacguccucggccaacggggugaccacccacuaugugucccagaucggcgacuuccccgaccagaccgaggacggcgggcucccgcagagcggccgcaucgucguggacuacaugaugcagaagcccgggaagacgggcaccaucguguaucagcgcgggguccugcugccccagaagguguggugcgccuccggccggagcaaggugaucaagggcagccucccccugaucggggaggcggacugccugcacgagaaguacggcgggcucaacaaguccaagccguauuacaccggcgagcacgccaaggccaucgggaacugccccaucugggucaagacgccccugaagcuggccaacggcaccaaguaccggcccccggccaagcuccugaaggagcgcggcuucuuuggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaucugaacucgcuguccgagcucgaggugaagaaccugcagcggcugagcggggccauggacgagcuccacaacgagauccuggagcuggacgagaagguggaugaccuccgcgccgacacgaucuccagccagaucgagcuggcgguccugcucuccaacgagggcaucaucaacagcgaggacgagcaucuccuggcccuggagcggaagcugaagaagaugcugggccccuccgccguggacaucgggaacggcugcuucgagaccaagcacaagugcaaccagaccugccucgaucgcaucgccgcggggaccuucaacgccggcgaguucucgcugcccaccuucgacucccugaacaucacggccgccagucucaacgacgacgggcuggacaaccacaccauccugcuguacuacuccaccgccgcgaguucccucgccgugacccugaugcuggccaucuucaucgucuacauggugagccgggacaacguguccugcagcaucugccucuga

SEQ ID NO: 15308 - RNA, 1755 nt, Artificial Sequence; identical to SEQ ID NO: 14763
  derived and/or modified CDS sequence (AUadapt) from InfluenzaB__AGX22293__HA

SEQ ID NO: 15309 - RNA, 1755 nt, Artificial Sequence
  derived and/or modified CDS sequence (AUadapt) from InfluenzaB__AGX22304__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacugcaccgaucuggacguggcccucgggcggcccaugugcgugggcaccacgccguccgccaaggccagcauccugcacgagguccgccccgugaccuccggcugcuuccccaucaugcacgaucggaccaagauccgccagcugcccaaccuccugcggggguacgagaacauccgccugucgacccagaacgugaucgacgcggagaaggccccgggcgggcccuaccggcucggcacguccgggagcugucccaacgccaccuccaagagcggcuucuucgccaccauggcgugggccguccccaaggacaacaacaagaaugccaccaacccgcugacgguggaggugcccuacaucugcaccgagggcgaggaccagaucaccgucuggggguuccacuccgacaacaagacccagaugaagaaucuguacggcgacagcaacccccagaaguucacguccucgaccaacggggugaccacccauuacgugucccagaucggcggcuuccccgaccagacggaggacgggggccucccgcagagcgggcgcaucgucguggacuacaugaugcagaagcccggcaagaccgggaccaucguguaccagcggggcguccugcugccccagaagguguggugugccuccggccgcagcaaggugaucaaggggagccucccccugaucggcgaggccgacugccugcacgagaaguacgggggccucaacaaguccaagccguauuacaccggggagcacgcgaaggccaucggcaacugccccaucugggucaagacgccccugaagcuggccaacggcaccaaguaccggcccccggccaagcuccugaaggagcgcggguucuucggcgccaucgcgggguuucuggagggcgggugggagggcaugaucgccggcuggcacggguacaccagccacggcgcccacgggguggccgucgccgcggaccucaaguccacccaggaggccaucaacaagaucacgaagaaucugaacucgcuguccgagcucgaggugaagaaccugcagcggcugagcggcgccauggacgagcuccacaacgagauccuggagcuggacgagaagguggaugaccuccgcgccgacaccaucuccagccagaucgagcuggccguccugcucuccaacgagggcaucaucaacagcgaggacgagcaucuccuggcgcuggagcggaagcugaagaagaugcuggggcccuccgccguggacaucggcaacgggugcuucgagaccaagcacaagugcaaccagaccugccucgaucgcaucgccgccggcaccuucaacgcgggggaguucucgcugcccacguucgacucccugaacaucaccgccgccagucucaacgacgacggccuggacaaccacaccauccugcuguacuacuccaccgccgccaguucccucgcggugacgcugaugcuggccaucuucaucgucuacauggugagccgggacaacguguccugcagcaucugccucuga

SEQ ID NO: 15310 - RNA, 1755 nt, Artificial Sequence; identical to SEQ ID NO: 14763
  derived and/or modified CDS sequence (AUadapt) from InfluenzaB__AGX22315__HA

SEQ ID NO: 15311 - RNA, 1755 nt, Artificial Sequence; identical to SEQ ID NO: 14166
  derived and/or modified CDS sequence (AUadapt) from InfluenzaB__AGX22326__HA

SEQ ID NO: 15312 - RNA, 1755 nt, Artificial Sequence; identical to SEQ ID NO: 14766
  derived and/or modified CDS sequence (AUadapt) from InfluenzaB__AGX22337__HA

SEQ ID NO: 15313 - RNA, 1755 nt, Artificial Sequence; identical to SEQ ID NO: 14766
  derived and/or modified CDS sequence (AUadapt) from InfluenzaB__AGX22348__HA

SEQ ID NO: 15314 - RNA, 1755 nt, Artificial Sequence
  derived and/or modified CDS sequence (AUadapt) from InfluenzaB__AGX22359__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacuguaccgaccuggacguggcccucgggcggcccaugugcgugggcaccacgccguccgccaaggccagcauccugcacgagguccgccccgugaccuccggcugcuuccccaucaugcaugaccggaccaagauccgccagcugcccaaccuccugcggggguacgagaacauccgccugagcacccagaacgugaucgacgcggagaaugccccgggcgggcccuaccggcucggcacguccgggucgugccccaacgccaccuccaagagcggcuucuucgccaccauggcgugggccguccccaaggauaacaacaagaacgccaccaacccgcugacgguggaggugcccuacgucugcaccgagggcgaggaccagaucaccguguggggguuucacuccgacaacaagacccagaugaagaaccuguacggcgacagcaauccccagaaguucacguccagcgccaacggggugaccacccacuacgucucccagaucggcggcuuccccgcccagaccgaggacgggggccucccgcagagugggcgcaucgugguggacuacaugguccagaagcccaagaagacgggcaccaucguguaccagcgcggggugcugcugccccagaaggucuggugcgcguccggccggagcaaggugaucaagggcucgcucccccugaucggggaggccgacugucugcacgagaaguacggcgggcucaacaaguccaagccguacuacaccggcgagcacgccaaggccaucgggaacugucccaucugggucaagacgccccugaagcuggccaacggcaccaaguaccggcccccggcgaagcuccugaaggagcgcggcuucuucggggccaucgccggcuuccuggagggcgggugggaggggaugaucgccggcuggcacggcuacaccagucacggggcccacggcguggcgguggccgccgaccucaaguccacccaggaggccaucaacaagaucaccaagaaccugaacagccuguccgagcucgagaucaagaaucugcagcggcugagcggggccauggacgagcuccacaacgagauccuggagcuggacgagaaggucgacgaccuccgcgcggauacgaucuccagccagaucgagcuggccgugcugcucuccaacgagggcaucaucaacucggaggacgagcaccuccuggcccuggagcggaagcugaagaagaugcugggccccuccgccguggacaucgggaauggcugcuucgagaccaagcacaagugcaaccagaccugccucgaccgcaucgcggccgggaccuuuaacgccggcgaguucagccugcccaccuucgacucccugaacaucacggccgccagccucaaugacgacgggcuggacaaccacaccauccugcuguacuacuccaccgcggccaguucccucgccgucacccugaugcuggccaucuucaucguguacauggugagccgggacaacgucuccugcagcaucugccucuga

SEQ ID NO: 15315 - RNA, 1755 nt, Artificial Sequence; identical to SEQ ID NO: 14764
  derived and/or modified CDS sequence (AUadapt) from InfluenzaB__AGX22370__HA

SEQ ID NO: 15316 - RNA, 1755 nt, Artificial Sequence
  derived and/or modified CDS sequence (AUadapt) from InfluenzaB__AGX22381__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacugcaccgaucuggacguggcccucgggcggcccaugugcgugggcaccacgccguccgccaaggccagcauccugcacgagguccgccccgugaccuccggcugcuuccccaucaugcacgaucggaccaagauccgccagcugucgaaccuccugcggggguacgagaacauccgccuguccacccagaacgugaucgacgcggagaaggcccccggcgggccguaccggcucggcacgagcggguccugucccaacgccaccagcaaguccggcuucuucgccaccauggcgugggccguccccaaggacaacaacaagaaugccaccaacccccugacgguggaggugccguacaucugcaccgagggcgaggaccagaucaccgucuggggguuccacagcgacaauaagacccagaugaagaaccuguacggcgacuccaacccccagaaguucacgagcuccgccaacggggugaccacccacuaugugucgcagaucggcggcuuccccgaccagaccgaggacgggggccucccccaguccgggcgcaucgucguggacuacaugaugcagaagccgggcaagacggggaccaucguguaccagcggggcguccugcugccccagaagguguggugugccagcggccgcagcaaggugaucaaggggucccucccccugaucggcgaggcggacugccugcacgagaaguacgggggccucaacaagagcaagcccuauuacaccggggagcacgccaaggccaucggcaacugcccgaucugggucaagacgccccugaagcuggccaacggcaccaaguaccggccgcccgccaagcuccugaaggagcgcggguucuuuggcgcgaucgccggguuccuggagggcgggugggagggcaugaucgccggcuggcacggguacaccucccacggcgcccacgggguggccgucgcggccgaccucaagucgacccaggaggccaucaacaagaucaccaagaaucugaacucccugagcgagcucgaggugaagaaccugcagcggcuguccggcgccauggacgagcuccacaacgagauccuggagcuggacgagaagguggacgaucuccgcgccgacacgaucagcucccagaucgagcuggcgguccugcucagcaacgagggcaucaucaacuccgaggacgagcaccuccuggcccuggagcggaagcugaagaagaugcuggggcccagugccguggacaucggcaacgggugcuucgagaccaagcacaagugcaaccagaccugccucgaucgcaucgccgcgggcaccuucaacgccggggaguucucccugcccaccuucgacucgcugaacaucacggccgccucccucaaugacgacggccuggacaaccacaccauccugcuguacuacagcaccgccgcguccagucucgccgugacccugaugcuggccaucuucaucgucuacauggugucccgggacaacgugagcugcagcaucugccucuga

SEQ ID NO: 15317 - RNA, 1755 nt, Artificial Sequence; identical to SEQ ID NO: 14763
  derived and/or modified CDS sequence (AUadapt) from InfluenzaB__AGX22392__HA

SEQ ID NO: 15318 - RNA, 1755 nt, Artificial Sequence
  derived and/or modified CDS sequence (AUadapt) from InfluenzaB__AGX22403__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacuguaccgaccuggacguggcccucgggcggcccaugugcgugggcaccacgccguccgccaaggccagcauccugcacgagguccgccccgugaccuccggcugcuuccccaucaugcaugaccggaccaagauccgccagcugcccaaccuccugcggggguacgagaacauccgccugagcacccagaacgugaucgacgcggagaaggccccgggcgggcccuaucggcucggcacguccgggucgugccccaacgccaccuccaagagcggcuucuucgccaccauggcgugggccguccccaaggacaauaacaagaacgccaccaacccgcugacgguggaggugcccuacaucugcaccgagggcgaggaccagaucaccgucuggggguuccauuccgacaacaagacccagaugaagaaccuguacggcgacagcaacccccagaaguuuacguccagcgccaacggggugaccacccacuacgugucccagaucggcggcuuccccgaccagaccgaggacgggggccucccgcagagugggcgcaucgucguggacuacaugaugcagaagcccggcaagacggggaccaucguguaccagcggggcguccugcugccccagaagguguggugcgccuccggccgcagcaaggugaucaaggggucgcucccccugaucggcgaggcggacugccugcaugagaaguacgggggccucaacaaguccaagccguacuacaccggggagcacgccaaggccaucggcaacugccccaucugggucaagacgccccugaagcuggccaauggcaccaaguaccggcccccggccaagcuccugaaggagcgcggguucuucggcgcgaucgccggguuccuggagggcgggugggagggcaugaucgccggcuggcacggguacaccagccauggcgcccacgggguggccgucgcggccgaccucaaguccacccaggaggccaucaacaagaucaccaagaaccugaacagccuguccgagcucgaggugaagaaccugcagcggcugaguggcgccauggacgagcuccacaacgagauccuggagcuggacgagaagguggacgaccuccgcgccgacacgaucuccagucagaucgagcuggcgguccugcucuccaacgagggcaucaucaacucggaggacgagcaccuccuggcccuggagcggaagcugaagaagaugcuggggcccuccgccguggacaucggcaacggguguuucgagaccaagcacaagugcaaccagaccugccucgaccgcaucgccgcgggcaccuucaaugccggggacuucagccugcccaccuucgacucccugaacaucacggccgccagccucaaugacgacggccuggacaaccacaccauccugcuguacuacuccaccgccgcgaguucccucgccgugacccugaugcuggccaucuucaucgucuacauggugagccgggacaacguguccugcagcaucugccucuga

SEQ ID NO: 15319 - RNA, 1755 nt, Artificial Sequence; identical to SEQ ID NO: 14763
  derived and/or modified CDS sequence (AUadapt) from InfluenzaB__AGX22414__HA

SEQ ID NO: 15320 - RNA, 1755 nt, Artificial Sequence
  derived and/or modified CDS sequence (AUadapt) from InfluenzaB__AGX22425__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacuguaccgaccuggacguggcccucgggcggcccaugugcgugggcaccacgccguccgccaaggccagcauccugcacgagguccgccccgugaccuccggcugcuuccccaucaugcacgaucggaccaagauccgccagcugcccaaccuccugcggggguacgagaacauccgccugagcacccagaacgugaucgacgcggagaaggccccgggcgggcccuaccggcucggcacguccgggaguugccccaacgccaccuccaagagcggcuucuucgccaccauggcgugggccguccccaaggacaacaacaagaaugccaccaacccgcugacgguggaggugcccuacaucugcaccgagggcgaggaccagaucaccgucuggggguuccacuccgacaauaagauccagaugaagaaccuguacggcgacagcaacccccagaaguucaccuccagcgccaacggggugacgacccauuacgugucccagaucggcggcuuccccgaccagaccgaggacgggggccucccgcagagcgggcgcaucgucguggacuacaugaugcagaagcccggcaagaccgggacgaucguguaucagcggggcguccugcugccccagaagguguggugcgccuccggccgcagcaaggugaucaaggggucgcucccccugaucggcgaggcggacugccugcacgagaaguacgggggccucaacaaguccaagccguauuacaccggggagcacgccaaggccaucggcaacugccccaucugggucaagacgccccugaagcuggccaacggcaccaaguaccggcccccggccaagcuccugaaggagcgcggguucuuuggcgcgaucgccggguuccuggagggcgggugggagggcaugaucgccggcuggcacggguacaccagccacggcgcccacgggguggccgucgcggccgaccucaaguccacccaggaggccaucaacaagaucaccaagaaucugaacagccuguccgagcucgaggugaagaaccugcagcggcugagcggcgccauggacgagcuccacaacgagauccuggagcuggaugagaagguggacgaccuccgcgccgacaccaucuccagccagaucgagcuggcgguccugcucuccaacgagggcaucaucaacucggaggacgagcaucuccuggcccuggagcggaagcugaagaagaugcuggggcccuccgccguggagaucggcaacgggugcuucgagacgaagcacaagugcaaccagaccugccucgaucgcaucgccgcgggcaccuucaacgccggggaguucagccugcccaccuucgacucccugaacaucaccgccgccagccucaaugacgacggccuggacaaccacacgauccugcuguacuacuccaccgccgcgaguucccucgccgugacccugaugcuggccaucuucaucgucuacauggugagccgggacaacguguccugcagcaucugccucuga

SEQ ID NO: 15321 - RNA, 1755 nt, Artificial Sequence; identical to SEQ ID NO: 14764
  derived and/or modified CDS sequence (AUadapt) from InfluenzaB__AGX22436__HA

SEQ ID NO: 15322 - RNA, 1755 nt, Artificial Sequence; identical to SEQ ID NO: 14764
  derived and/or modified CDS sequence (AUadapt) from InfluenzaB__AGX22445__HA

SEQ ID NO: 15323 - RNA, 1755 nt, Artificial Sequence
  derived and/or modified CDS sequence (AUadapt) from InfluenzaB__AGX22456__HA
augaaggccaucaucgugcugcucauggucgugaccaguaacgccgaccgcaucugcaccggcaucacguccagcuccagcccccacguggucaagaccgcgacccagggggaggugaaugugaccggcgucaucccgcugacgaccacccccaccaaguccuacuucgccaaccugaaggggacgcggacccgcggcaagcucugccccgacugccugaauugcaccgaccuggacguggcccucgggcggcccaugugcgugggcaccacgccgagcgccaaggccuccauccugcacgagguccgccccgugaccaguggcugcuuccccaucaugcacgaccggaccaagauccgccagcugcccaaccuccugcggggguacgagaauauccgccuguccacccagaacgugaucgacgcggagaaggccccgggcgggcccuaccggcucggcacgagcggguccugccccaacgccaccagcaaguccggcuuuuucgccaccauggcgugggccguccccaaggacaacaacaagaacgccaccaacccgcugacgguggaggugcccuauaucugcaccgagggcgaggaccagaucaccgucuggggguuccacagcgacaauaagacccagaugaagaaccuguacggcgacuccaacccccagaaguucacgagcuccgccaauggggugaccacccacuacgugagccagaucggcggcuuccccgaccagaccgaggacgggggccucccgcaguccgggcgcaucgucguggauuacaugaugcagaagcccggcaagacggggaccaucguguaccagcggggcguccugcugccccagaagguguggugcgccagcggccgcagcaaggugaucaaggggucccucccccugaucggcgaggcggacugccugcaugagaaguacgggggccucaacaagagcaagccguacuacaccggggagcacgccaaggccaucggcaauugccccaucugggucaagacgccccugaagcuggccaacggcaccaaguaccggcccccggccaagcuccugaaggagcgcggguucuucggcgcgaucgccggguuccuggagggcgggugggagggcaugaucgccggcuggcauggguacaccucccacggcgcccacgggguggccgucgcggccgaccucaagagcacccaggaggccaucaacaagaucaccaagaaucugaacucccugagcgagcucgaggugaagaaccugcagcggcuguccggcgccauggacgagcuccacagcgagauccuggagcuggaugagaagguggacgaccuccgcgccgacacgaucuccagccagaucgagcuggcgguccugcucuccaacgagggcaucaucaacagcgaggaugagcaccuccuggcccuggagcggaagcugaagaagaugcuggggcccuccgccguggacaucggcaacgggugcuucgagaccaagcacaaguguaaccagaccugccucgaccgcaucgccgcgggcaccuucaacgccggggaguucagucugcccaccuucgacucccugaacaucacggccgccagccucaacgacgauggccuggacaaccacaccauccugcuguacuacuccaccgccgcgagcucccucgccgugacccugaugcuggccaucuuuaucgucuacaucgugagccgggacaacgugagcugcuccaucugccucuga

SEQ ID NO: 15324 - RNA, 1755 nt, Artificial Sequence; identical to SEQ ID NO: 14763
  derived and/or modified CDS sequence (AUadapt) from InfluenzaB__AGX22467__HA

SEQ ID NO: 15325 - RNA, 1755 nt, Artificial Sequence; identical to SEQ ID NO: 14763
  derived and/or modified CDS sequence (AUadapt) from InfluenzaB__AGX22478__HA

SEQ ID NO: 15326 - RNA, 1755 nt, Artificial Sequence
  derived and/or modified CDS sequence (AUadapt) from InfluenzaB__AGX22489__HA
augaaggccaucaucgugcugcucauggucgugaccaguaacgccgaccgcaucugcaccggcaucacguccagcaacaguccccacguggucaagaccgcgacccagggggaggugaacgugaccggcgucaucccgcugacgaccacccccaccaaguccuacuucgccaaccugaaggggacgcggacccgcggcaagcucugccccgauugccugaacugcaccgaccuggacguggcccucgggcggcccaugugugugggcaccacgccguccgccaaggccagcauccugcacgagguccgccccgugaccuccggcugcuuccccaucaugcacgaccggaccaagauccgccagcugcccaaucuccugcggggguacgagaacauccgccugagcacccaguccgcgaucgacgccgagaaggccccgggcgggcccuaccggcucggcacgaguggguccugccccaacgccaccagcaaguccggcuucuucgcgaccauggccugggccgugcccaaggacaauaacaagaacgccaccaacccgcugacggucgaggugcccuacaucugcaccgagggcgaggaucagaucaccguguggggguuccacagcgacaacaagacccagaugaagaaccuguauggcgacuccaacccccagaaguucacgagcuccgccaacggggucaccacccauuacgugagccagaucggcggcuuccccgggcagaccgaggacggcgggcucccgcaguccggccgcaucguggucgacuacaugauccagaagcccgggaagacgggcaccaucguguaucagcggggcgugcugcugccccagaaggucuggugcgcgagcgggcgcagcaaggugaucaagggcucccucccccugaucggggaggccgacugccugcaugagaaguacggcgggcucaacaagagcaagccguacuacaccggcgagcacgccaaggccaucggcaauugccccaucugggugaagacgccccugaagcuggccaacgggaccaaguaccggcccccggcgaagcuccugaaggagcgcggcuucuucggggccaucgccggcuuucuggagggcgggugggagggcaugaucgccggguggcacggcuacaccucccacggggcccacggcgucgcgguggccgccgaccucaagagcacccaggaggccaucaauaagaucaccaagaaccugaacucccugagcgagcucgaggucaagaaccugcagcggcuguccggcgccauggacgagcuccauaacgagauccuggagcuggacgagaagguggacgaccuccgcgcggacacgaucagcgcccagaucgagcuggccgugcugcucuccaaugaggggaucaucaacagcgaggacgagcaccuccuggcccuggagcggaagcugaagaagaugcugggccccuccgcggucgacaucgggaauggcugcuucgagaccaagcacaagugcaaccagaccugccucgaucgcaucgccgccgggaccuucaacgccggcgaguucagccugcccaccuucgauucccugaacaucacggccgcgagccucaacgacgacggccuggacaaucacaccauccugcuguacuacuccaccgccgccagcucccucgccgugacccugaugcuggccaucuucaucguguauauggucagccgggacaacguguccugcagcaucugccucuga

SEQ ID NO: 15327 - RNA, 1755 nt, Artificial Sequence
  derived and/or modified CDS sequence (AUadapt) from InfluenzaB__AGX22500__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacuguaccgaccuggacguggcccucgggcggcccaugugcgugggcaccacgccguccgccaaggccagcauccugcacgagguccgccccgugaccuccggcugcuuccccaucaugcaugaccggaccaagauccgccagcugcccaaccuccugcggggguacgagaacauccgccugagcacccagaacgugaucgacgcggagaaugccccgggcgggcccuaccggcucggcacguccgggagcugccccaacgccaccuccaagagcggcuucuucgccaccauggcgugggccguccccaaggauaacaacaagaacgccaccaacccgcugacgguggaggugcccuacaucugcaccgagggcgaggaccagaucaccgucuggggguuucacuccgacaacaagacccagaugaagaaccuguacggcgacucgaauccccagaaguucacguccagcgccaacggggugaccacccacuacgugucccagaucggcggcuuccccgcccagaccgaggacgggggccucccgcagagugggcgcaucaucgucgacuacauggugcagaagccccggaagacgggcaccaucguguaccagcgcgggguccugcugccccagaagguguggugcgcguccggccggagcaaggugaucaagggcagccucccccugaucggggaggccgacugucugcacgagaaguacggcgggcucaacaaguccaagccguacuacaccggcgagcacgccaaggccaucgggaacugucccaucugggucaagacgccccugaagcuggccaacggcaccaaguaccggcccccggcgaagcuccugaaggagcgcggcuucuucggggccaucgccggcuuccuggagggcgggugggaggggaugaucgccggcuggcacggcuacaccagucacggggcccacggcguggcggucgccgccgaccucaaguccacccaggaggccaucaacaagaucaccaagaaccugaacagccuguccgagcucgaggugaagaaucugcagcgccugucgggggccauggacgagcuccacaacgagauccuggagcuggacgagaagguggacgaccuccgggcggauacgaucuccagccagaucgagcuggccguccugcucuccaacgagggcaucaucaacagcgaggacgagcaccuccuggcccuggagcgcaagcugaagaagaugcugggccccuccgccguggacaucgggaauggcugcuucgagaccaagcacaagugcaaccagaccugccucgaccggaucgcggccgggaccuuuaacgccggcgaguucagccugcccaccuucgacucccugaacaucacggccgccagccucaaugacgacgggcuggacaaccacaccauccugcuguacuacuccaccguggcgaguucccucgccgucacccugaugcuggccaucuucaucguguacauggugagccgcgacaacgucuccugcagcaucugccucuga

SEQ ID NO: 15328 - RNA, 1755 nt, Artificial Sequence; identical to SEQ ID NO: 14764
  derived and/or modified CDS sequence (AUadapt) from InfluenzaB__AGX22511__HA

SEQ ID NO: 15329 - RNA, 1755 nt, Artificial Sequence
  derived and/or modified CDS sequence (AUadapt) from InfluenzaB__AGX22522__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacugcaccgaucuggacguggcccucgggcggcccaugugcgugggcaccacgccguccgccaaggccagcauccugcacgagguccgccccgugaccuccggcugcuuccccaucaugcacgaucggaccaagauccgccagcuggcgaaccuccugcggggguacgagaacauccgccugucgacccagaacgugaucgacgccgagaaggcccccggcgggccguaccggcucggcacguccgggagcugucccaacgccaccuccaagagcggcuucuucgcgaccauggccugggccguccccaaggacaacaacaagaaugccaccaacccccugacgguggaggugccguacaucugcaccgagggcgaggaccagaucaccgucuggggguuccacuccgacaacaagacccagaugaagaaucuguacggcgacagcaacccccagaaguucacguccucggccaacggggugaccaagcauuacgugucccagaucggcggcuuccccgaccagaccgaggacgggggccucccccagagcgggcgcaucgucguggacuacaugaugcagaagccgggcaagaccgggacgaucguguaccagcggggcguccugcugccccagaagguguggugugcguccggccgcagcaaggugaucaaggggagccucccccugaucggcgaggccgacugccugcacgagaaguacgggggccucaacaaguccaagcccuauuacaccggggagcacgccaaggccaucggcaacugcccgaucugggucaagacgccccugaagcuggccaacggcaccaaguaccggccgcccgcgaagcuccugaaggagcgcggguucuucggcgccaucgccggguuucuggagggcgggugggagggcaugaucgccggcuggcacggguacaccagccacggcgcccacgggguggcggucgccgccgaccucaaguccacccaggaggccaucaacaagaucaccaagaaucugaacucgcuguccgagcucgaggugaagaaccugcagcggcugagcggcgccauggacgagcuccacaacgagauccuggagcuggacgagaagguggaugaccuccgcgcggacaccaucuccagccagaucgagcuggccguccugcucuccaacgagggcaucaucaacagcgaggacgagcaucuccuggcccuggagcggaagcugaagaagaugcuggggcccuccgccguggacaucggcaacgggugcuucgagacgaagcacaagugcaaccagaccugccucgaucgcaucgcggccggcaccuucaacgccggggaguucucgcugcccaccuucgacucccugaacaucaccgccgccagucucaacgacgacggccuggacaaccacacgauccugcuguacuacuccaccgcggccaguucccucgccgugacccugaugcuggccaucuucaucgucuacauggugagccgggacaacguguccugcagcaucugccucuga

SEQ ID NO: 15330 - RNA, 1755 nt, Artificial Sequence; identical to SEQ ID NO: 14166
  derived and/or modified CDS sequence (AUadapt) from InfluenzaB__AGX22533__HA

SEQ ID NO: 15331 - RNA, 1755 nt, Artificial Sequence; identical to SEQ ID NO: 14778
  derived and/or modified CDS sequence (AUadapt) from InfluenzaB__AGX22566__HA

SEQ ID NO: 15332 - RNA, 1755 nt, Artificial Sequence; identical to SEQ ID NO: 14764
  derived and/or modified CDS sequence (AUadapt) from InfluenzaB__AGX22577__HA

SEQ ID NO: 15333 - RNA, 1755 nt, Artificial Sequence; identical to SEQ ID NO: 14778
  derived and/or modified CDS sequence (AUadapt) from InfluenzaB__AGX22588__HA

SEQ ID NO: 15334 - RNA, 1755 nt, Artificial Sequence; identical to SEQ ID NO: 14166
  derived and/or modified CDS sequence (AUadapt) from InfluenzaB__AGX22599__HA

SEQ ID NO: 15335 - RNA, 1755 nt, Artificial Sequence
  derived and/or modified CDS sequence (AUadapt) from InfluenzaB__AGX22610__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaaguccuacuucgccaaccugaaggggacgcggacccgcggcaagcucugccccgacugccugaauugcaccgaccuggacguggcccucgggcggcccaugugcgugggcaccacgccguccgccaaggccagcauccugcacgagguccgccccgugaccuccggcuguuuccccaucaugcacgaccggaccaagauccgccagcugcccaaccuccugcggggguacgagaacauccgccugagcacccagaaugugaucgacgcggagaaggccccgggcgggcccuaccggcucggcacguccgggagcugccccaacgccaccuccaagagcggcuuuuucgccaccauggcgugggccguccccaaggacaacaacaagaacgccaccaacccgcugacgguggaggugcccuacaucuguaccgagggcgaggaccagaucaccgucuggggguuccacuccgacaacaagacccagaugaagaaccuguacggcgaucccaacccccagaaguucacgucguccgccaacggggugaccacccacuacgugagucagaucggcggcuucccggaccagaccgaggacgggggccucccccaguccgggcgcaucgucguggacuacaugaugcagaagcccggcaagacggggaccaucguguaccagcggggcguccugcugccccagaagguguggugcgccaguggccgcuccaaggugaucaaggggagccucccgcugaucggcgaggcggacugccugcacgagaaguacgggggccucaacaagaguaagcccuacuacaccggggagcacgccaaggccaucggcaacugccccaucugggucaagacgccccugaagcuggccaacggcaccaaguaccggccgcccgccaagcuccugaaggagcgcggguuuuucggcgcgaucgccggguuccuggagggcgggugggagggcaugaucgccggcuggcacggguacaccucccacggcgcccacgggguggccgucgcggccgaucucaagagcacccaggaggccaucaacaagaucaccaagaaccugaacucccugagcgagcucgaggugaagaaccugcagcggcuguccggcgccauggacgagcuccauaacgagauccuggagcuggacgagaagguggacgaccuccgcgccgacacgaucucgucccagaucgagcuggcgguccugcucagcaaugagggcaucaucaacuccgaggacgagcaccuccuggcccuggagcggaagcugaagaagaugcuggggcccagcgccguggacaucggcaacggguguuucgagaccaagcacaagugcaaccagaccugccucgaccgcaucgccgcgggcaccuucaaugccggggaguucucccugcccaccuucgacagccugaacaucacggccgccucccucaacgaugacggccuggacaaccacaccauccugcuguacuacagcaccgccgcguccagucucgccgugacccugaugcuggccaucuucaucgucuacauggugucccgggacaacgugagcugcuccaucugccucuga

SEQ ID NO: 15336 - RNA, 1755 nt, Artificial Sequence
  derived and/or modified CDS sequence (AUadapt) from InfluenzaB__AGX22621__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaaguccuacuucgccaaccugaaggggacgcggacccgcggcaagcucugccccgacugccugaauugcaccgaccuggacguggcccucgggcggcccaugugcgugggcaccacgccguccgccaaggccagcauccugcacgagguccgccccgugaccuccggcuguuuccccaucaugcacgaccggaccaagauccgccagcuggcgaaccuccugcggggguacgagaacauccgccugagcacccagaaugugaucgacgccgagaaggcccccggcgggccguaccggcucggcacguccgggagcugccccaacgccaccuccaagagcggcuucuuugcgaccauggccugggccguccccaaggacaacaacaagaacgccaccaacccccugacgguggaggugccguacaucuguaccggcggggaggaccagaucaccgucuggggcuuccacuccgacaacaagacccagaugaagaaccuguacggggauucgaacccccagaaguucacguccagcgccaacggcgugaccacccacuacgugucccagaucggcggguuucccgaccagaccgaggacggcgggcucccccagagcggccgcaucgucguggacuacaugaugcagaagccggggaagacgggcaccaucguguaccagcggggcguccugcugccccagaagguguggugugcguccgggcgcagcaaggugaucaagggcagccucccccugaucggggaggccgacugccugcacgagaaguacggcgggcucaacaaguccaagcccuauuacaccggcgagcacgccaaggccaucggcaacugcccgaucugggucaagacgccccugaagcuggccaacgggaccaaguaccggccgcccgcgaagcuccugaaggagcgcggcuuuuucggggccaucgccggcuuccuggagggcgggugggagggcaugaucgccggguggcacggcuacaccagccacggggcccacggcguggcggucgccgccgaucucaaguccacccaggaggccaucaacaagaucaccaagaaccugaacagccuguccgagcucgaggugaagaaccugcagcggcugucgggcgccauggacgagcuccauaacgagauccuggagcuggacgagaagguggacgaccuccgcgcggacacgaucuccagccagaucgagcuggccguccugcucuccaaugaggggaucaucaacagcgaggacgagcaccuccuggcccuggagcggaagcugaagaagaugcugggccccuccgccguggacaucgggaacggcugcuuugagaccaagcacaagugcaaccagaccugccucgaccgcaucgcggccgggaccuucaacgccggcgaguuuagccugcccaccuucgacucccugaacaucacggccgccagccucaacgaugacggccuggacaaccacaccauccugcuguacuacuccaccgcggccagcucccucgccgugacccugaugcuggccaucuuuaucgucuacauggugagccgggacaacguguccugcagcaucugccucuga

SEQ ID NO: 15337 - RNA, 1755 nt, Artificial Sequence; identical to SEQ ID NO: 14166
  derived and/or modified CDS sequence (AUadapt) from InfluenzaB__AGX22632__HA

SEQ ID NO: 15338 - RNA, 1755 nt, Artificial Sequence
  derived and/or modified CDS sequence (AUadapt) from InfluenzaB__AGX22643__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacugcaccgaucuggacguggcccucgggcggcccaugugcgugggcaccacgccguccgccaaggccagcauccugcacgagguccgccccgugaccuccggcugcuuccccaucaugcacgaucggaccaagauccgccagcuggcgaaccuccugcggggguacgagaacauccgccugagcauccagaacgugaucgacgccgagaaggcccccggcgggccguaccggcucggcaccuccgggucgugucccaacgccacguccaagagcggcuucuucgcgaccauggccugggccguccccaaggacaacaacaagaaugccaccaacccccugaccguggaggugccguacaucugcacggagggcgaggaccagaucaccgucuggggguuccacuccgacaacaagacccagaugaagaaucuguacggcgacagcaacccccagaaguucaccuccagcgccaacggggugacgacccauuacgugucccagaucggcggcuuccccgaccagaccgaggacgggggccucccccagagcgggcgcaucgucguggacuacaugaugcagaagccgggcaagaccgggacgaucguguaccagcggggcguccugcugccccagaagguguggugugcguccggccgcagcaaggugaucaaggggucgcucccccugaucggcgaggccgacugccugcacgagaaguacgggggccucaacaaguccaagcccuauuacaccggggagcacgccaaggccaucggcaacugcccgaucugggucaagacgccccugaagcuggccaacggcaccaaguaccggccgcccgcgaagcuccugaaggagcgcggguucuucggcgccaucgccggguuucuggagggcgggugggagggcaugaucgccggcuggcacggguacaccagccacggcgcccacgggguggcggucgccgccgaccucaaguccacccaggaggccaucaacaagaucaccaagaaucugaacagccuguccgagcucgaggugaagaaccugcagcggcugagcggcgccauggacgagcuccacaacgagauccuggagcuggacgagaagguggaugaccuccgcgcggacaccaucuccagccagaucgagcuggccguccugcucuccaacgagggcaucaucaacucggaggacgagcaucuccuggcccuggagcggaagcugaagaagaugcuggggcccuccgccguggacaucggcaacgggugcuucgagacgaagcacaagugcaaccagaccugccucgaucgcaucgcggccggcaccuucaacgccggggaguucagccugcccaccuucgacucccugaacaucaccgccgccagucucaacgacgacggccuggacaaccacacgauccugcuguacuacuccaccgcggccaguucccucgccgugacccugaugcuggccaucuucaucgucuacauggugagccgggacaacguguccugcagcaucugccucuga

SEQ ID NO: 15339 - RNA, 1755 nt, Artificial Sequence
  derived and/or modified CDS sequence (AUadapt) from InfluenzaB__AGX22654__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaaguccuacuucgccaaccugaaggggacgcggacccgcggcaagcucugccccgacugccugaauugcaccgaccuggacguggcccucgggcggcccaugugcgugggcaccacgccguccgccaaggccagcauccugcacgagguccgccccgugaccuccggcuguuuccccaucaugcacgaccggaccaagauccgccagcuggcgaaccuccugcggggguacgagaacauccgccugagcacccagaaugugaucgacgccgagaaggcccccggcgggccguaccggcucggcacguccgggagcugccccaacgccaccuccaagagcggcuucuuugcgaccauggccugggccguccccaaggacaacaacaagaacgccaccaacccccugacgguggaggugccguacaucuguaccgagggcgaggaccagaucaccgucuggggguuccacuccgacaacaagacccagaugaagaaccuguacggcgauucgaacccccagaaguucacguccagcgccaacggggugaccacccacuacgugucccagaucggcggcuuucccgaccagaccgaggacgggggccucccccagagcgggcgcaucgucguggacuacaugaugcagaagccgggcaagacggggaccaucguguaccagcggggcguccugcugccccagaagguguggugugcguccggccgcagcaaggugaucaaggggagccucccccugaucggcgaggccgacugccugcacgagaaguacgggggccucaacaaguccaagcccuauuacaccggggagcacgccaaggccaucggcaacugcccgaucugggucaagacgccccugaagcuggccaacggcaccaaguaccggccgcccgcgaagcuccugaaggagcgcggguuuuucggcgccaucgccggguuccuggagggcgggugggagggcaugaucgccggcuggcacggguacaccagccacggcgcccacgggguggcggucgccgccgaucucaaguccacccaggaggccaucaacaagaucaccaagaaccugaacagccuguccgagcucgaggugaagaaccugcagcggcugagcggcgccauggacgagcuccauuccgagauccuggagcuggacgagaagguggacgaccuccgcgcggacacgaucucgucccagaucgagcuggccguccugcucagcaaugagggcaucaucaacuccgaggacgagcaccuccuggcccuggagcggaagcugaagaagaugcuggggcccagcgccguggacaucggcaacgggugcuuugagaccaagcacaagugcaaccagaccugccucgaccgcaucgcggccggcaccuucaacgccggggaguuuucccugcccaccuucgacagccugaacaucacggccgccucccucaacgacgauggccuggacaaccacaccauccugcuguacuacagcaccgcggccuccagccucgccgugacccugaugcuggccaucuuuaucgucuacauggugucccgggacaacgugagcugcagcaucugccucuga

SEQ ID NO: 15340 - RNA, 1755 nt, Artificial Sequence; identical to SEQ ID NO: 14778
  derived and/or modified CDS sequence (AUadapt) from InfluenzaB__AGX22665__HA

SEQ ID NO: 15341 - RNA, 1755 nt, Artificial Sequence; identical to SEQ ID NO: 14778
  derived and/or modified CDS sequence (AUadapt) from InfluenzaB__AGX22676__HA

SEQ ID NO: 15342 - RNA, 1755 nt, Artificial Sequence; identical to SEQ ID NO: 14166
  derived and/or modified CDS sequence (AUadapt) from InfluenzaB__AGX22687__HA

SEQ ID NO: 15343 - RNA, 1755 nt, Artificial Sequence; identical to SEQ ID NO: 14778
  derived and/or modified CDS sequence (AUadapt) from InfluenzaB__AGX22698__HA

SEQ ID NO: 15344 - RNA, 1755 nt, Artificial Sequence
  derived and/or modified CDS sequence (AUadapt) from InfluenzaB__AGX22709__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacugcaccgaucuggacguggcccucgggcggcccaugugcgugggcaccacgccguccgccaaggccagcauccugcacgagguccgccccgugaccuccggcugcuuccccaucaugcacgaucggaccaagauccgccagcuggcgaaccuccugcggggguacgagaacauccgccugucgacccagaacgugaucgacgccgagaaggcccccggcgggccguaccggcucggcacguccgggagcugucccaacgccaccuccaagagcggcuucuucgcgaccauggccugggccguccccaaggacaacaacaagaaugccaccaacccccugacgguggaggugccguacaucugcaccgagggcgaggaccagaucaccgucuggggguuccacuccgacaacaagacccagaugaagaaucuguacggcgacagcaacccccagaaguucacguccucggccaacggggugaccacccauuacgugucccagaucggcggcuuccccgaccagaccgaggacgggggccucccccagagcgggcgcaucgucguggacuacaugaugcagaagccggagaagacgggcaccaucguguaccagcgcgggguccugcugccccagaagguguggugugcguccggccggagcaaggugaucaagggcagccucccccugaucggggaggccgacugccugcacgagaaguacggcgggcucaacaaguccaagcccuauuacaccggcgagcacgccaaggccaucgggaacugcccgaucugggucaagacgccccugaagcuggccaacggcaccaaguaccggccgcccgcgaagcuccugaaggagcgcggcuucuucggggccaucgccggcuuucuggagggcgggugggaggggaugaucgccggcuggcacggcuacaccagccacggggcccacggcguggcggucgccgccgaccucaaguccacccaggaggccaucaacaagaucaccaagaaucugaacucgcuguccgagcucgaggugaagaaccugcagcggcugagcggggccauggacgagcuccacaacgagauccuggagcuggacgagaagguggaugaccuccgcgcggacacgaucuccagccagaucgagcuggccguccugcucuccaacgagggcaucaucaacagcgaggacgagcaucuccuggcccuggagcggaagcugaagaagaugcugggccccuccgccguggacaucgggaacggcugcuucgagaccaagcacaagugcaaccagaccugccucgaucgcaucgcggccgggaccuucaacgccggcgaguucucgcugcccaccuucgacucccugaacaucacggccgccagucucaacgacgacgggcuggacaaccacaccauccugcuguacuacuccaccgcggccaguucccucgccgugacccugaugcuggccaucuucaucgucuacauggugagccgggacaacguguccugcagcaucugccucuga

SEQ ID NO: 15345 - RNA, 1755 nt, Artificial Sequence
  derived and/or modified CDS sequence (AUadapt) from InfluenzaB__AGX22720__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaaguccuacuucgccaaccugaaggggacgcggacccgcggcaagcucugccccgacugccugaauugcaccgaccuggacguggcccucgggcggcccaugugcgugggcaccacgccguccgccaaggccagcauccugcacgagguccgccccgugaccuccggcuguuuccccaucaugcacgaccggaccaagauccgccagcugcccaaccuccugcggggguacgagaacauccgccugagcacccagaaugugaucgacgcggagaaggccccgggcgggcccuaccggcucggcacguccgggucgugccccaacgccaccuccaagagcggcuucuuugccaccauggcgugggccguccccaaggacaacaacaagaacgccaccaacccgcugacgguggaggugcccuacaucuguaccgagggcgaggaccagaucaccgucuggggguuccacuccgacaacaagacccagaugaagaaccuguacggcgauagcaacccccagaaguucacguccagcgccaacggggccaccacccacuacgugucccagaucggcggcuuucccgaccagaccgaggacgggggccucccgcagagcgggcgcaucguggucgacuacaugaugcagaagcccggcaagacggggaccaucguguaccagcggggcgugcugcugccccagaaggucuggugugcguccggccgcagcaaggugaucaaggggucgcucccccugaucggcgaggccgacugccugcacgagaaguacgggggccucaacaaguccaagccguauuacaccggggagcacgccaaggccaucggcaacugccccaucugggugaagacgccccugaagcuggccaacggcaccaaguaccggcccccggcgaagcuccugaaggagcgcggguuuuucggcgccaucgccggguuccuggagggcgggugggagggcaugaucgccggcuggcacggguacaccagccacggcgcccacggggucgcgguggccgccgaucucaaguccacccaggaggccaucaacaagaucaccaagaaccugaacagccuguccgagcucgaggucaagaaccugcagcggcugagcggcgccauggacgagcuccauaacgagauccuggagcuggacgagaagguggacgaccuccgcgcggacacgaucuccagccagaucgagcuggccgugcugcucuccaaugagggcaucaucaacucggaggacgagcaccuccuggcccuggagcggaagcugaagaagaugcuggggcccuccgccgucgacaucggcaacgggugcuuugagaccaagcacaagugcaaccagaccugccucgaccgcaucgcggccggcaccuucaacgccggggaguuuagccugcccaccuucgacucccugaacaucacggccgccagccucaacgaugacggccuggacaaccacaccauccugcuguacuacuccaccgcggccagcucccucgccgugacccugaugcuggccaucuuuaucguguacauggucagccgggacaacguguccugcagcaucugccucuga

SEQ ID NO: 15346 - RNA, 1755 nt, Artificial Sequence; identical to SEQ ID NO: 14778
  derived and/or modified CDS sequence (AUadapt) from InfluenzaB__AGX22731__HA

SEQ ID NO: 15347 - RNA, 1755 nt, Artificial Sequence; identical to SEQ ID NO: 15339
  derived and/or modified CDS sequence (AUadapt) from InfluenzaB__AGX22742__HA

SEQ ID NO: 15348 - RNA, 1755 nt, Artificial Sequence
  derived and/or modified CDS sequence (AUadapt) from InfluenzaB__AGX22753__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccgccaaguccuacuucgccaaccugaaggggacccggacgcgcggcaagcucugccccgacugccugaacuguaccgaccuggacguggcccucgggcggcccaugugcgugggcaccaccccguccgccaaggcgagcauccugcacgagguccgccccgugacguccggcugcuuccccaucaugcaugaccggaccaagauccgccagcuggccaaccuccugcggggguacgagaacauccgccugagcacccagaacgugaucgacgccgagaaggcccccggcgggccguaucggcucggcaccuccgggucgugccccaacgcgacguccaagagcggcuucuucgccaccauggccugggccguccccaaggacaauaacaagaacgccaccaacccccugaccguggaggugccguacaucugcaaggagggcgaggaccagaucacggucuggggguuccauuccgacaacaagacccagaugaagaaccuguacggcgacagcaacccccagaaguuuaccuccagcgcgaacggggugaccacgcacuacgugucccagaucggcggcuuccccgaccagaccgaggacgggggccucccccagagugggcgcaucgucguggacuacaugauccagaagccgggcaagaccgggaccaucguguaccagcggggcguccugcugccccagaagguguggugcgccuccggccgcagcaaggugaucaaggggucgcucccccugaucggcgaggccgacugucugcacgagaaguacgggggccucaacaaguccaagcccuacuacacgggggagcacgccaaggccaucggcaacuguccgaucugggucaagacgccccugaagcuggcgaacggcaccaaguaccggccgcccgccaagcuccugaaggagcgcggguucuucggcgccaucgccggguuccuggagggcgggugggagggcaugaucgccggcuggcacggguacaccagucacggcgcgcacgggguggccgucgccgccgaccucaaguccacccaggaggccaucaacaagaucaccaagaaccugaacagccuguccgagcucgaggugaagaaucugcagcggcugagcggcgcgauggacgagcuccacaacgagauccuggagcuggacgagaagguggacgaccuccgcgccgauaccaucuccagccagaucgagcuggccguccugcucuccaacgagggcaucaucaacucggaggacgagcaccuccuggcccuggagcggaagcugaagaagaugcuggggcccuccgcgguggacaucggcaaugggugcuucgagaccaagcacaagugcaaccagacgugccucgaccgcaucgccgccggcaccuuuaacgccggggaguucagccugcccaccuucgacucccugaacaucaccgccgcgagccucaaugacgacggccuggacaaccacaccauccugcuguacuacuccacggccgccaguucccucgccgugacccugaugcuggccaucuucaucgucuacauggugagccgggacaacguguccugcagcaucugccucuga

SEQ ID NO: 15349 - RNA, 1755 nt, Artificial Sequence
  derived and/or modified CDS sequence (AUadapt) from InfluenzaB__AGX22764__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacugcaccgaucuggacguggcccucgggcggcccaugugcgugggcaccacgccguccgccaaggccagcauccugcacgagguccgccccgugaccuccggcugcuuccccaucaugcacgaucggaccaagauccgccagcuggcgaaccuccugcggggguacgagaacauccgccugucgacccagaacgugaucgacgccgagaaggcccccggcgggccguaccggcucggcacguccgggagcugucccaacgccaccuccaagagcggcuucuucgcgaccauggccugggccguccccaaggacaacaacaagaaugccaccaacccccugacgguggaggugccguacaucugcaaggagggcgaggaccagaucaccgucuggggguuccacuccgacaacaagacccagaugaagaaucuguacggcgacagcaacccccagaaguucaccuccucggccaacggggugacgacccacuaugugucccagaucggcggcuuccccgaccagaccgaggacgggggccucccccagagcgggcgcaucgucguggacuacaugauccagaagccgggcaagaccgggacgaucguguaccagcggggcguccugcugccccagaagguguggugugcguccggccgcagcaaggugaucaaggggagccucccccugaucggcgaggccgacugccugcacgagaaguacgggggccucaacaaguccaagcccuacuauaccggggaccacgccaaggccaucggcaacugcccgaucugggucaagacgccccugaagcuggccaacggcaccaaguaccggccgcccgcgaagcuccugaaggagcgcggguucuuuggcgccaucgccggguuccuggagggcgggugggagggcaugaucgccggcuggcacggguacaccagccacggcgcccacgggguggcggucgccgccgaccucaaguccacccaggaggccaucaacaagaucaccaagaaucugaacucgcuguccgagcucgaggugaagaaccugcagcggcugagcggcgccauggacgagcuccacaacgagauccuggagcuggacgagaagguggaugaccuccgcgcggacaccaucuccagccagaucgagcuggccguccugcucuccaacgagggcaucaucaacagcgaggacgagcaucuccuggcccuggagcggaagcugaagaagaugcuggggcccuccgccguggacaucggcaacgggugcuucgagacgaagcacaagugcaaccagaccugccucgaucgcaucgcggccggcaccuucaacgccggggaguucucgcugcccaccuucgacucccugaacaucaccgccgccagucucaacgacgacggccuggacaaccacacgauccugcuguacuacuccaccgcggccaguucccucgccgugacccugaugcuggccaucuucaucgucuacauggugagccgggacaacguguccugcagcaucugccucuga

SEQ ID NO: 15350 - RNA, 1755 nt, Artificial Sequence
  derived and/or modified CDS sequence (AUadapt) from InfluenzaB__AGX22775__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaaguccuacuucgccaaccugaaggggacgcggacccgcggcaagcucugccccgacugucugaacugcaccgaccuggacguggcccucgggcggcccaugugcgugggcaccacgccguccgccaaggccagcauccugcaugagguccgccccgugaccuccggcugcuuccccaucaugcacgaccggaccaagauccgccagcugcccaaccuccugcggggguacgagaauauccgccugagcacccagaacgugaucgacgcggagaaggccccgggcgggcccuaccggcucggcacguccgggagcugccccaacgccaccuccaagaguggcuucuucgccaccauggcgugggccguccccaaggacaacaacaagaacgccaccaauccgcugacgguggaggugcccuacaucugcaccgagggcgaggaccagaucaccgucuggggguuccacuccgacaauaagacccagaugaagaaccuguacggcgacagcaacccccagaaguucacguccagugccaacggggugaccacccacuacgugucccagaucggcggcuuccccgaccagaccgaggacgggggccucccgcagagugggcgcaucgucguggacuacaugaugcagaagcccggcaagacggggaccaucguguaccagcggggcguccugcugccccagaagguguggugcgccuccggccgcagcaaggugaucaaggggucgcucccccugaucggcgaggcggacugucugcacgagaaguacgggggccucaacaaguccaagccguacuacaccggggagcacgccaaggccaucggcaauugccccaucugggucaagacgccccugaagcuggccaacggcaccaaguaccggcccccggccaagcuccugaaggagcgcggguucuucggcgcgaucgccggguuccuggagggcgggugggagggcaugaucgccggcuggcauggguacaccagccacggcgcccacgggguggccgucgcggccgaccucaaguccacccaggaggccaucaacaagaucaccaagaaucugaacagccuguccgagcucgaggugaagaaccugcagcggcugagcggcgccauggacgagcuccacaaugagauccuggagcuggacgagaagguggacgaccuccgcgccgacacgaucuccagccagaucgagcuggcgguccugcucuccaacgagggcaucaucaacagugaggacgagcaccuccuggcccuggagcggcgccugaagaagaugcuggggcccuccgccguggagaucggcaacgggugcuucgagaccaagcacaaguguaaccagaccugccucgaccggaucgccgcgggcaccuucaacgccggggaguucagucugcccaccuucgacucccugaacaucacggccgccagccucaacgacgauggccuggacaaccacaccauccugcuguacuacuccaccgccgcgagcucccucgccgugacccugaugcuggccaucuuuaucgucuacauggugagccgcgacaacguguccugcagcaucugccucuga

SEQ ID NO: 15351 - RNA, 1755 nt, Artificial Sequence; identical to SEQ ID NO: 14778
  derived and/or modified CDS sequence (AUadapt) from InfluenzaB__AGX22786__HA

SEQ ID NO: 15352 - RNA, 1755 nt, Artificial Sequence
  derived and/or modified CDS sequence (AUadapt) from InfluenzaB__AGX22797__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuauuucgccaaccugaaggggacgcggacccgcggcaagcucugccccgacugccugaacugcaccgaccuggauguggcccucgggcggcccaugugcgugggcaccacgccguccgccaaggccagcauccugcacgagguccgccccgugaccuccggcugcuuccccaucaugcacgaccggaccaagauccgccagcuggcgaaccuccugcggggguaugagaacauccgccugucgacccagaacgugaucgacgccgagaaggcccccggcgggccguaccggcucggcacguccgggagcugccccaacgccaccuccaagaguggcuucuucgcgaccauggccugggccguccccaaggacaacaacaagaacgccaccaacccccugacgguggaggugccguacaucuguaaggagggcgaggaccagaucaccgucuggggguuccacuccgacaacaagacccagaugaagaaccuguacggcgacaguaacccccagaaguucaccuccucggccaacggggugacgacccacuacgugucccagaucggcggcuuccccgaccagaccgaggaugggggccucccccagagcgggcgcaucgucguggacuacaugauccagaagccgggcaagaccgggacgaucguguaccagcggggcguccuguucccccagaagguguggugcgcguccggccgcagcaaggugaucaaggggagccugccccucaucggcgaggccgacugucugcacgagaaguacgggggccugaacaaguccaagcccuacuacaccggggagcacgccaaggccaucggcaacugcccgaucugggucaagacgccccucaagcuggccaauggcaccaaguaccggccgcccgcgaagcugcucaaggagcgcggguucuucggcgccaucgccggguuccuggagggcgggugggagggcaugaucgccggcuggcacggguacaccagccacggcgcccaugggguggcggucgccgccgaccugaaguccacccaggaggccaucaacaagaucaccaagaaccucaacucgcuguccgagcuggaggugaagaaccuccagcggcugagcggcgccauggacgagcugcauaacgagauccucgagcuggacgagaagguggacgaccugcgcgcggacaccaucuccagccagaucgagcucgccguccugcuguccaacgagggcaucaucaacagugaggacgagcaccuccuggcccuggagcggaagcucaagaagaugcuggggcccuccgccguggacaucggcaacgggugcuucgagacgaagcacaagugcaaucagaccugccuggaccgcaucgcggccggcaccuucaacgccggggaguucucgcuccccaccuucgacucccugaauaucaccgccgccagccugaacgacgacggccucgacaaccacacgauccugcuguacuauuccaccgcggccagcucccuggccgugacccucaugcuggccaucuucaucgucuacauggugagccgggacaacguguccugcagcaucugccuguga

SEQ ID NO: 15353 - RNA, 1755 nt, Artificial Sequence; identical to SEQ ID NO: 14778
  derived and/or modified CDS sequence (AUadapt) from InfluenzaB__AGX22808__HA

SEQ ID NO: 15354 - RNA, 1755 nt, Artificial Sequence; identical to SEQ ID NO: 14778
  derived and/or modified CDS sequence (AUadapt) from InfluenzaB__AGX22819__HA

SEQ ID NO: 15355 - RNA, 1755 nt, Artificial Sequence; identical to SEQ ID NO: 14778
  derived and/or modified CDS sequence (AUadapt) from InfluenzaB__AGX22830__HA

SEQ ID NO: 15356 - RNA, 1755 nt, Artificial Sequence
  derived and/or modified CDS sequence (AUadapt) from InfluenzaB__AGX22841__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacuguaccgaccuggacguggcccucgggcggcccaugugcgugggcaccacgccguccgccaaggccagcauccugcacgagguccgccccgugaccuccggcugcuuccccaucaugcaugaccggaccaagauccgccagcuggcgaaccuccugcggggguacgagaacauccgccugagcacccagaacgugaucgacgccgagaaggcccccggcgggccguaucggcucggcacguccgggucgugccccaacgccaccuccaagagcggcuucuucgcgaccauggccugggccguccccaaggacaauaacaagaacgccaccaacccccugacgguggaggugccguacaucugcaaggagggcgaggaccagaucaccgucuggggguuccauuccgacaacaagacccagaugaagaaccuguacggcgacagcaacccccagaaguuuaccuccagcgccgacggggugacgacccacuacgugucccagaucggcggcuuccccgaccagaccgaggacgggggccucccccagagugggcgcaucgucguggacuacaugauccagaagccgggcaagaccgggacgaucguguaccagcggggcguccugcugccccagaagguguggugcgcguccggccgcagcaaggugaucaaggggucgcucccccugaucggcgaggccgacugucugcacgagaaguacgggggccucaacaaguccaagcccuacuacaccggggagcacgccaaggccaucggcaacuguccgaucugggucaagacgccccugaagcuggccaacggcaccaaguaccggccgcccgcgaagcuccugaaggagcgcggguucuucggcgccaucgccggguuccuggagggcgggugggagggcaugaucgccggcuggcacggguacaccagucacggcgcccacgggguggcggucgccgccgaccucaaguccacccaggaggccaucaacaagaucaccaagaaccugaacagccuguccgagcucgaggugaagaaucugcagcggcugagcggcgccauggacgagcuccacaacgagauccuggagcuggacgagaagguggacgaccuccgcgcggauaccaucuccagccagaucgagcuggccguccugcucuccaacgagggcaucaucaacucggaggacgagcaccuccuggcccuggagcggaagcugaagaagaugcuggggcccuccgccguggacaucggcaaugggugcuucgagacgaagcacaagugcaaccagaccugccucgaccgcaucgcggccggcaccuuuaacgccggggaguucagccugcccaccuucgacucccugaacaucaccgccgccagccucaaugacgacggccuggacaaccacacgauccugcuguacuacuccaccgcggccaguucccucgccgugacccugaugcuggccaucuucaucgucuacauggugagccgggacaacguguccugcagcaucugccucuga

SEQ ID NO: 15357 - RNA, 1755 nt, Artificial Sequence; identical to SEQ ID NO: 14166
  derived and/or modified CDS sequence (AUadapt) from InfluenzaB__AGX22852__HA

SEQ ID NO: 15358 - RNA, 1755 nt, Artificial Sequence; identical to SEQ ID NO: 14778
  derived and/or modified CDS sequence (AUadapt) from InfluenzaB__AGX22863__HA

SEQ ID NO: 15359 - RNA, 1755 nt, Artificial Sequence; identical to SEQ ID NO: 14778
  derived and/or modified CDS sequence (AUadapt) from InfluenzaB__AGX22874__HA

SEQ ID NO: 15360 - RNA, 1755 nt, Artificial Sequence; identical to SEQ ID NO: 14166
  derived and/or modified CDS sequence (AUadapt) from InfluenzaB__AGX22885__HA

SEQ ID NO: 15361 - RNA, 1755 nt, Artificial Sequence; identical to SEQ ID NO: 15339
  derived and/or modified CDS sequence (AUadapt) from InfluenzaB__AGX22896__HA

SEQ ID NO: 15362 - RNA, 1755 nt, Artificial Sequence
  derived and/or modified CDS sequence (AUadapt) from InfluenzaB__AGX22907__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaaguccuacuucgccaaccugaaggggacgcggacccgcggcaagcucugccccgacugccugaauugcaccgaccuggacguggcccucgggcggcccaugugcgugggcaccacgccguccgccaaggccagcauccugcacgagguccgccccgugaccuccggcuguuuccccaucaugcacgaccggaccaagauccgccagcuggcgaaccuccugcggggguacgagaacauccgccugagcacccagaaugugaucgacgccgagaaggcccccggcgggccguaccggcucggcacguccgggagcugccccaacgccaccuccaagagcggcuucuuugcgaccauggccugggccguccccaaggacaacaacaagaacgccaccaacccccugacgguggaggugccguacaucuguaccgagggcgaggaccagaucaccgucuggggguuccacuccgacaacaagacccagaugaagaaccuguacggcgauucgaacccccagaaguucacguccagcgccaacggggugaccacccacuacgugucccagaucggcggcuuucccgaccagaccgaggacgggggccucccccagagcgggcgcaucgucguggacuacaugaugcagaagccgggcaagacggggaccaucguguaccagcggggcguccugcugccccagaagguguggugugcguccggccgcagcaaggugaucaaggggagccucccccugaucggcgaggccgacugccugcacgagaaguacgggggccucaacaaguccaagcccuauuacaccggggagcacgccaaggccaucggcaacugcccgaucugggucaagacgccccugaagcuggccaacggcaccaaguaccggccgcccgcgaagcuccugaaggagcgcggguuuuucggcgccaucgccggguuccuggagggcgggugggagggcaugaucgccggcuggcacggguacaccagccacggcgcccacgggguggcggucgccgccgaucucaaguccacccaggaggccaucaacaagaucaccaagaaccugaacagccuguccgagcucgaggugaagaaccugcagcggcugagcggcgccauggacgagcuccauaacgagauccuggagcuggacgagaagguggacgaccuccgcgcggacacgaucuccucgcagaucgagcuggccguccugcucuccaaugagggcaucaucaacagcgaggacgagcaccuccuggcccuggagcggaagcugaagaagaugcuggggcccuccgccguggacaucggcaacgggugcuuugagaccaagcacaagugcaaccagaccugccucgaccgcaucgcggccggcaccuucaacgccggggaguuuagccugcccaccuucgacucccugaacaucacggccgccagccucaacgaugacggccuggacaaccacaccauccugcuguacuacuccaccgcggccagcucccucgccgugacccugaugcuggccaucuuuaucgucuacauggugagccgggacuccgugagcugcagcaucugccucuga

SEQ ID NO: 15363 - RNA, 1755 nt, Artificial Sequence; identical to SEQ ID NO: 14166
  derived and/or modified CDS sequence (AUadapt) from InfluenzaB__AGX22918__HA

SEQ ID NO: 15364 - RNA, 1755 nt, Artificial Sequence; identical to SEQ ID NO: 14166
  derived and/or modified CDS sequence (AUadapt) from InfluenzaB__AGX22929__HA

SEQ ID NO: 15365 - RNA, 1755 nt, Artificial Sequence; identical to SEQ ID NO: 14778
  derived and/or modified CDS sequence (AUadapt) from InfluenzaB__AGX22940__HA

SEQ ID NO: 15366 - RNA, 1755 nt, Artificial Sequence; identical to SEQ ID NO: 14166
  derived and/or modified CDS sequence (AUadapt) from InfluenzaB__AGX22951__HA

SEQ ID NO: 15367 - RNA, 1755 nt, Artificial Sequence; identical to SEQ ID NO: 14166
  derived and/or modified CDS sequence (AUadapt) from InfluenzaB__AGX22962__HA

SEQ ID NO: 15368 - RNA, 1755 nt, Artificial Sequence; identical to SEQ ID NO: 14166
  derived and/or modified CDS sequence (AUadapt) from InfluenzaB__AGX22973__HA

SEQ ID NO: 15369 - RNA, 1755 nt, Artificial Sequence; identical to SEQ ID NO: 14166
  derived and/or modified CDS sequence (AUadapt) from InfluenzaB__AGX22984__HA

SEQ ID NO: 15370 - RNA, 1755 nt, Artificial Sequence; identical to SEQ ID NO: 14166
  derived and/or modified CDS sequence (AUadapt) from InfluenzaB__AGX22995__HA

SEQ ID NO: 15371 - RNA, 1755 nt, Artificial Sequence; identical to SEQ ID NO: 14166
  derived and/or modified CDS sequence (AUadapt) from InfluenzaB__AGX23006__HA

SEQ ID NO: 15372 - RNA, 1755 nt, Artificial Sequence
  derived and/or modified CDS sequence (AUadapt) from InfluenzaB__AGX23017__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacugcaccgaucuggacguggcccucgggcggcccaugugcgugggcaccacgccguccgccaaggccagcauccugcacgagauccgccccgucaccuccggcugcuuccccaucaugcacgaucggaccaagauccgccagcuggcgaaccuccugcggggguacgagaacauccgccugucgacccagaacgugaucgacgccgagaaggcccccggcgggccguaccggcucggcacguccgggagcugucccaacgccaccuccaagagcggcuucuucgcgaccauggccugggccgugcccaaggacaacaacaagaaugccaccaacccccugacggucgaggugccguacaucugcaccgagggcgaggaccagaucaccguguggggguuccacuccgacaacaagacccagaugaagaaucuguacggcgacagcaacccccagaaguucacguccucggccaacggggucaccacccauuacgugucccagaucggcggcuuccccgaccagaccgaggacgggggccucccccagagcgggcgcaucguggucgacuacaugaugcagaagccgggcaagacggggaccaucguguaccagcggggcgugcugcugccccagaaggucuggugugcguccggccgcagcaaggugaucaaggggagccucccccugaucggcgaggccgacugccugcacgagaaguacgggggccucaacaaguccaagcccuauuacaccggggagcacgccaaggccaucggcaacugcccgaucugggugaagacgccccugaagcuggccaacggcaccaaguaccggccgcccgcgaagcuccugaaggagcgcggguucuucggcgccaucgccggguuucuggagggcgggugggagggcaugaucgccggcuggcacggguacaccagccacggcgcccacggggucgcgguggccgccgaccucaaguccacccaggaggccaucaacaagaucaccaagaaucugaacucgcuguccgagcucgaggucaagaaccugcagcggcugagcggcgccauggacgagcuccacaacgagauccuggagcuggacgagaagguggaugaccuccgcgcggacacgaucuccagccagaucgagcuggccgugcugcucuccaacgagggcaucaucaacagcgaggacgagcaucuccuggcccuggagcggaagcugaagaagaugcuggggcccuccgccgucgacaucggcaacgggugcuucgagaccaagcacaagugcaaccagaccugccucgaucgcaucgcggccggcaccuucaacgccggggaguucucgcugcccaccuucgacucccugaacaucacggccgccagucucaacgacgacggccuggacaaccacaccauccugcuguacuacuccaccgcggccaguucccucgccgugacccugaugcuggccaucuucaucguguacauggucagccgggacaacguguccugcagcaucugccucuga

SEQ ID NO: 15373 - RNA, 1755 nt, Artificial Sequence
  derived and/or modified CDS sequence (AUadapt) from InfluenzaB__AGX23028__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaaguccuacuuugccaaccugaaggggacgaagacccggggcaagcucugccccgacugccugaacugcaccgaccuggacguggcccucgggcgccccaugugcgugggcaccacgccguccgccaaggccaguauccugcacgagguccggcccgugaccuccggcugcuuccccaucaugcacgaccgcaccaagauccggcagcuggcgaaccuccugcgcggguacgagaacauccggcugagcacccagaacgugaucgaugccgagaaggcccccggcgggccguacaagcucggcacguccgggucgugccccaacgccaccuccaagagcggcuucuucgcgaccauggccugggccguccccaaggacaacaauaagaacgccaccaacccccugacgguggaggugccguacaucugcaccgagggcgaggaccagaucaccgucuggggguuccacuccgacaacaagacccagaugaagaaucuguacggcgacagcaacccccagaaguucacguccucggccaacggggugaccacccacuacgugucccagaucggcggcuuccccgaucagaccgaggacgggggccucccccagagcgggcgcaucgucguggacuacaugaugcagaagccgggcaagacggggaccaucguguaccagcggggcguccugcugccccagaagguguggugcgcguccggccgcagcaaggugaucaaggggucgcucccccugaucggcgaggccgacugucugcacgagaaguacgggggccucaacaaguccaagcccuacuacaccggggagcacgccaaggccaucggcaacugcccgaucugggucaagacgccccugaagcuggccaacggcaccaaguaucggccgcccgcgaagcuccugaaggagcgcggguucuucggcgccaucgccggguuccuggagggcgggugggagggcaugaucgccggcuggcacggguacaccagccacggcgcccacgggguggcggucgccgccgaccucaaguccacccaggaggccaucaacaagaucaccaagaaucugaacucgcuguccgagcucgaggugaagaaccugcagcggcugagcggcgccauggacgagcuccacaacgagauccuggagcuggacgagaagguggacgaucuccgcgcggacacgaucuccagccagaucgagcuggccguccugcucuccaacgagggcaucaucaacucggaggacgagcaccuccuggcccuggagcggaagcugaagaagaugcuggggcccuccgccguggacaucggcaacggguguuucgagaccaagcacaagugcaaccagaccugccucgaccgcaucgcggccggcaccuucaacgccggggaguucagccugcccaccuuugacucccugaacaucacggccgccagccucaacgacgacggccuggacaaccacaccauccugcuguauuacuccaccgcggccucgucccucgccgugacccugaugcuggccaucuucaucgucuacauggugagccgggacaacguguccugcagcaucugccucuga

SEQ ID NO: 15374 - RNA, 1755 nt, Artificial Sequence; identical to SEQ ID NO: 14166
  derived and/or modified CDS sequence (AUadapt) from InfluenzaB__AGX23039__HA

SEQ ID NO: 15375 - RNA, 1755 nt, Artificial Sequence
  derived and/or modified CDS sequence (AUadapt) from InfluenzaB__AGX23050__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaaguccuacuucgccaaccugaaggggacgcggacccgcggcaagcucugccccgacugccugaauugcaccgaccuggacguggcccucgggcggcccaugugcgugggcaccacgccguccgccaaggccagcauccugcacgaggucucccccgugaccagcggcuguuuccccaucaugcacgaccgcaccaagauccggcagcuggcgaaccuccugcgcggguacgagaacauccggcuguccacccagaaugugaucgacgccgagaaggcccccggcgggccguaccgccucggcacgagcggguccugccccaacgccaccagcaaguccggcuucuuugcgaccauggccugggccguccccaaggacaacaacaagaacgccaccaacccccugacgguggaggugccguacaucugcaccgagggcgaggaucagaucaccgucuggggguuccacucggacaacaagacccagaugaagaaccuguauggcgacuccaacccccagaaguucacgagcuccgccaacggggugaccacccacuacgugagucagaucggcggcuuccccgaccagaccgaggacgggggccucccccaguccgggcggaucgucguggacuacaugaugcagaagccgggcaagacggggaccaucguguaccagcgcggcguccugcugccccagaagguguggugcgcgaguggccggagcaaggugaucaaggggucccucccccugaucggcgaggccgacugccugcacgagaaguacgggggccucaacaagaguaagcccuacuacaccggggagcacgccaaggccaucggcaacugcccgaucugggucaagacgccccugcgccuggccaacggcaccaaguaccggccgcccgcgaagcuccugaaggagcgcggguuuuucggcgccaucgccggguuccuggagggcgggugggagggcaugaucgccggcuggcacggguacaccucccacggcgcccacgggguggcggucgccgccgaccucaagaguacccaggaggccaucaacaagaucaccaagaaccugaacucccugagcgagcucgaggugaagaaccugcagcggcuguccggcgccauggacgagcuccauaacgagauccuggagcuggacgagaagguggacgaccuccgcgcggacacgaucucgucccagaucgagcuggccguccugcucagcaaugagggcaucaucaacuccgaggacgagcaccuccuggcccuggagcggaagcugaagaagaugcuggggcccagcgccguggacaucggcaacgggugcuuugagaccaagcacaagugcaaccagaccugccucgaccgcaucgcggccggcaccuucaaugccggggaguucucccugcccaccuucgacagccugaacaucacggccgccucccucaacgacgauggccuggacaaccacaccauccugcuguacuacagcaccgcggccuccagccucgccgugacccugaugcuggccaucuuuaucgucuacauggugucccgggacaacgugagcugcagcaucugccucuga

SEQ ID NO: 15376 - RNA, 1755 nt, Artificial Sequence
  derived and/or modified CDS sequence (AUadapt) from InfluenzaB__AGX23061__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaaguccuacuucgccaaccugaaggggacgcggacccgcggcaagcucugccccgacugucugaacugcaccgaccuggacguggcccucgggcggcccaugugcgugggcaccacgccguccgccaaggccagcauccugcaugagguccgccccgugaccuccggcugcuuccccaucaugcacgaccggaccaagauccgccagcuggcgaaccuccugcggggguacgagaacauccgccugaguacccagaacgugaucgacgccgagaaggcccccggcgggccguaccggcucggcacguccgggagcugccccaacgccaccuccaagaguggcuucuucgcgaccauggccugggccguccccaaggacaacaacaagaacgccaccaauccccugacgguggaggugccguacaucugcaccgagggcgaggaccagaucaccgucuggggguuccacuccgacaauaagacccagaugaagaaccuguacggcgacagcaacccccagaaguucacguccagcgccaauggggugaccacccacuacgugucccagaucggcggcuuccccgaccagaccgaggacgggggccucccccagagcgggcgcaucgucguggauuacaugaugcagaagccgggcaagacggggaccaucguguaccagcggggcguccugcugccccagaagguguggugcgcguccggccgcagcaaggugaucaaggggucgcucccccugaucggcgaggccgacugucugcacgagaaguacgggggccucaacaaguccaagcccuacuacaccggggagcacgccaaggccaucggcaauugcccgaucugggucaagacgccccugcggcuggccaacggcaccaaguaccgcccgcccgcgaagcuccugaaggagcggggguucuucggcgccaucgccggguuccuggagggcgggugggagggcaugaucgccggcuggcacggguauaccagccacggcgcccacgggguggcggucgccgccgaccucaaguccacccaggaggccaucaacaagaucaccaagaaccugaauagccuguccgagcucgaggugaagaaccugcagcgccugagcggcgccauggacgagcuccacaacgagauccuggagcuggaugagaagguggacgaccuccgggcggacacgaucuccagccagaucgagcuggccguccugcucuccaacgagggcaucaucaacagugaggacgagcaccuccuggcccuggagcgcaagcugaagaagaugcuggggcccuccgccguggacaucggcaacgggugcuucgagaccaagcacaaguguaaccagaccugccucgaccggaucgcggccggcaccuucaacgccggggaguucagucugcccaccuucgacucccugaacaucacggccgccagccucaacgacgauggccuggacaaccacaccauccugcuguacuacuccaccgcggccagcucccucgccgugacccugaugcuggccaucuuuaucgucuacauggugagccgcgacaacguguccugcagcaucugccucuga

SEQ ID NO: 15377 - RNA, 1755 nt, Artificial Sequence; identical to SEQ ID NO: 14166
  derived and/or modified CDS sequence (AUadapt) from InfluenzaB__AGX23072__HA

SEQ ID NO: 15378 - RNA, 1755 nt, Artificial Sequence; identical to SEQ ID NO: 14778
  derived and/or modified CDS sequence (AUadapt) from InfluenzaB__AGX23083__HA

SEQ ID NO: 15379 - RNA, 1755 nt, Artificial Sequence; identical to SEQ ID NO: 14166
  derived and/or modified CDS sequence (AUadapt) from InfluenzaB__AGX23094__HA

SEQ ID NO: 15380 - RNA, 1755 nt, Artificial Sequence; identical to SEQ ID NO: 14166
  derived and/or modified CDS sequence (AUadapt) from InfluenzaB__AGX23105__HA

SEQ ID NO: 15381 - RNA, 1755 nt, Artificial Sequence; identical to SEQ ID NO: 14778
  derived and/or modified CDS sequence (AUadapt) from InfluenzaB__AGX23116__HA

SEQ ID NO: 15382 - RNA, 1755 nt, Artificial Sequence; identical to SEQ ID NO: 14166
  derived and/or modified CDS sequence (AUadapt) from InfluenzaB__AGX23127__HA

SEQ ID NO: 15383 - RNA, 1755 nt, Artificial Sequence; identical to SEQ ID NO: 14166
  derived and/or modified CDS sequence (AUadapt) from InfluenzaB__AGX23138__HA

SEQ ID NO: 15384 - RNA, 1755 nt, Artificial Sequence
  derived and/or modified CDS sequence (AUadapt) from InfluenzaB__AGX23149__HA
augaaggccaucaucgugcugcucauggucgugaccaguaacgccgaccgcaucugcaccggcaucacguccagcgacagcccccauguggucaagaccgcgacccagggggaggugaacgugaccggcgucaucccgcugacgaccacccccaccaaguccuacuucgccaaccugaaggggacgcggacccgcggcaagcucugccccgacugccugaauugcaccgaccuggacguggcccucgggcggcccaugugcgugggcaccacgccguccgccaaggccagcauccugcacgagguccgccccgugaccuccggcuguuuccccaucaugcacgaccggaccaagauccgccagcuggcgaaccuccugcggggguacgagaacauccgccugagcacccagaaugugaucgacgccgagaaggcccccggcgggccguaccggcucggcacguccgggagcugccccaacgccaccuccaagagcggcuucuuugcgaccauggccugggccguccccaaggacaacaacaagaacgccaccaacccccugacgguggaggugccguacaucuguaccgagggcgaggaccagaucaccgucuggggguuccacuccgacaacaagacccagaugaagaaccuguacggcgauucgaacccccagaaguucacguccagcgccaacggggugaccacccacuacgugucccagaucggcggcuuucccgaccagaccgaggacgggggccucccccagagcgggcgcaucgucguggacuacaugaugcagaagccgggcaagacggggaccaucguguaccagcggggcguccugcugccccagaagguguggugugcguccggccgcagcaaggugaucaaggggagccucccccugaucggcgaggccgacugccugcacgagaaguacgggggccucaacaaguccaagcccuauuacaccggggagcacgccaaggccaucggcaacugcccgaucugggucaagacgccccugaagcuggccaacggcaccaaguaccggccgcccgcgaagcuccugaaggagcgcggguuuuucggcgccaucgccggguuccuggagggcgggugggagggcaugaucgccggcuggcacggguacaccagccacggcgcccacgggguggcggucgccgccgaucucaaguccacccaggaggccaucaacaagaucaccaagaaccugaacagccuguccgagcucgaggugaagaaccugcagcggcugucgggcgccauggacgagcuccauaacgagauccuggagcuggacgagaagguggacgaccuccgcgcggacacgaucuccagccagaucgagcuggccguccugcucuccaaugagggcaucaucaacagcgaggacgagcaccuccuggcccuggagcggaagcugaagaagaugcuggggcccuccgccguggacaucggcaacgggugcuuugagaccaagcacaagugcaaccagaccugccucgaccgcaucgcggccggcaccuucaacgccggggaguuuagccugcccaccuucgacucccugaacaucacggccgccagccucaacgaugacggccuggacaaccacaccauccugcuguacuacuccaccgcggccagcucccucgccgugacccugaugcuggccaucuuuaucgucuacauggugagccgggacaacguguccugcagcaucugccucuga

SEQ ID NO: 15385 - RNA, 1755 nt, Artificial Sequence
  derived and/or modified CDS sequence (AUadapt) from InfluenzaB__AGX23160__HA
augaaggccaucaucgugcugcucauggucgugaccaguaacgccgaccgcaucugcaccggcaucacguccagcaacaguccccacguggucaagaccgcgacccagggggaggugaacgugaccggcgucaucccgcugacgaccacccccaccaaguccuacuucgccaaccugaaggggacgcggacccgcggcaagcucugccccgauugccugaacugcaccgaccuggacguggcccucgggcggcccaugugcgugggcaucaccccguccgccaaggccaguauccugcacgagguccgccccgugacguccggcugcuuccccaucaugcacgaccggaccaagauccgccagcuggcgaaccuccugcggggguaugagaacauccgccugagcacccagaacgugaucgacgccgagaaggcccccggcgggccguaccggcucggcaccuccgggagcugucccaacgccacguccaagagcggcuucuucgcgaccauggccugggccguccccaaggacaacaauaagaacgccaccaacccccugaccguggaggugccguacaucugcacggagggcgaggaccagaucaccgucuggggguuccauuccgacaacaagacccagaugaagaaccuguacggcgacagcaauccccagcgcuucaccuccagcgccaacggggugacgacccacuacgugucccagaucggcggcuuccccgaucagaccgaggacgggggccucccccagagcgggcggaucgucguggacuacaugaugcagaagccgggcaagaccgggacgaucguguaccagcgcggcguccugcugccccagaagguguggugcgcguccggccggaguaaggugaucaaggggagccucccccugaucggcgaggccgacugccugcacgagaaguacgggggccucaauaaguccaagcccuacuacaccggggagcacgccaaggccaucggcaacugcccgaucugggucaagacgccccugcgccuggccaacggcaccaaguaucggccgcccgcgaagcuccugaaggagcgcggguucuucggcgccaucgccggguuccuggagggcgggugggagggcaugaucgccggcuggcacggguacaccagccauggcgcccacgggguggcggucgccgccgaccucaaguccacccaggaggccaucaacaagaucaccaagaaccugaacagccuguccgagcucgaggugaagaaucugcagcggcugagcggcgccauggacgagcuccacaacgagauccuggagcuggacgagaagguggacgaucuccgcgcggacaccaucuccagccagaucgagcuggccguccugcucuccaacgagggcaucaucaacagcgaggacgagcaucuccuggcccuggagcggaagcugaagaagaugcuggggcccuccgccguggacaucggcaacgggugcuucgagacgaagcacaagugcaaucagaccugccucgaccgcaucgcggccggcaccuucaacgccggggaguucagccugcccaccuuugacucccugaacaucaccgccgccagccucaacgacgacggccuggauaaccacacgauccugcuguacuacuccaccgcggccagcucccucgccgugacccugaugcuggccaucuucaucgucuauauggugagccgggacaacguguccugcagcaucugccucuga

SEQ ID NO: 15386 - RNA, 1755 nt, Artificial Sequence
  derived and/or modified CDS sequence (AUadapt) from InfluenzaB__AGX23171__HA
augaaggccaucaucgugcugcucauggucgugaccaguaacgccgaccgcaucugcaccggcaucacguccagcaacaguccccacguggucaagaccgcgacccagggggaggugaacgugaccggcgucaucccgcugacgaccacccccaccaaguccuacuucgccaaccugaaggggacgcggacccgcggcaagcucugccccgauugccugaacugcaccgaccuggacguggcccucgggcggcccaugugugugggcaccacgccguccgccaaggccagcauccugcacgagguccgccccgugaccuccggcugcuuccccaucaugcacgaccggaccaagauccgccagcuggcgaaucuccugcggggguacgagaacauccgccugagcacccagaacgugaucgacgccgagaaggcccccggcgggccguaucggcucggcacguccgggagcugccccaacgccaccuccaagagcggcuucuucgcgaccauggccugggccguccccaaggauaacaacaagaacgccaccaacccccugacgguggaggugccguacaucugcaccgagggcgaggaucagaucaccgucuggggguuccacuccgacaacaagacccagaugaagaaccuguauggcgacagcaacccccagcgcuucacguccagcgccaacggggugaccacccauuacgugucccagaucggcggcuuccccgaccagaccgaggacgggggccucccccagagcgggcggaucgucguggauuacaugaugcagaagccgggcaagacggggaccaucguguaccagcgcggcguccugcugccccagaagguguggugcgcguccggccggagcaaggugaucaaggggagccucccccugaucggcgaggccgacugucugcacgagaaguacgggggccucaacaaguccaagcccuacuacaccggggagcacgccaaggccaucggcaauugcccgaucugggucaagacgccccugcgccuggccaacggcaccaaguaccggccgcccgcgaagcuccugaaggagcgcggguucuucggcgccaucgccggguuucuggagggcgggugggagggcaugaucgccggcuggcacggguacaccagccacggcgcccacgggguggcggucgccgccgaccucaaguccacccaggaggccaucaauaagaucaccaagaaccugaacagccuguccgagcucgaggugaagaaccugcagcggcugagcggcgccauggaugagcuccacaacgagauccuggagcuggacgagaagguggacgaccuccgcgcggacacgaucuccagucagaucgagcuggccguccugcucuccaacgagggcaucaucaacagcgaggacgagcaccuccuggcccuggagcggaagcugaagaagaugcuggggcccuccgccguggacaucggcaaugggugcuucgagaccaagcacaagugcaaccagaccugucucgaccgcaucgcggccggcaccuucaacgccggggaguucagccugcccaccuucgauucccugaacaucacggccgccagccucaacgacgacggccuggauaaccacaccauccugcuguacuacuccaccgcggccagcucccucgccgugacccugaugcuggccaucuucaucgucuauauggugagccgggacaacguguccugcagcaucugccucuga

SEQ ID NO: 15387 - RNA, 1755 nt, Artificial Sequence; identical to SEQ ID NO: 14166
  derived and/or modified CDS sequence (AUadapt) from InfluenzaB__AGX23182__HA

SEQ ID NO: 15388 - RNA, 1755 nt, Artificial Sequence; identical to SEQ ID NO: 14166
  derived and/or modified CDS sequence (AUadapt) from InfluenzaB__AGX23193__HA

SEQ ID NO: 15389 - RNA, 1755 nt, Artificial Sequence; identical to SEQ ID NO: 14778
  derived and/or modified CDS sequence (AUadapt) from InfluenzaB__AGX23204__HA

SEQ ID NO: 15390 - RNA, 1755 nt, Artificial Sequence; identical to SEQ ID NO: 14166
  derived and/or modified CDS sequence (AUadapt) from InfluenzaB__AGX23215__HA

SEQ ID NO: 15391 - RNA, 1755 nt, Artificial Sequence
  derived and/or modified CDS sequence (AUadapt) from InfluenzaB__AGX23226__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacuguaccgaccuggacguggcccucgggcggcccaugugcgugggcaccacgccguccgccaaggccagcauccugcacgagguccgccccgugaccuccggcugcuuccccaucaugcaugaccggaccaagauccgccagcuggcgaaccuccugcggggguacgagaacauccgccugagcacccagaacgugaucgacgccgagaaggcccccggcgggccguaucggcucggcacguccgggucgugccccaacgccaccuccaagagcggcuucuucgcgaccauggccugggccguccccaaggacaauaacaagaacgccaccaacccccugacgguggaggugccguacaucugcaaggagggcgaggaccagaucaccgucuggggguuccauuccgacaacaagacccagaugaagaaccuguacggcgacagcaacccccagaaguuuaccuccagcgccuccggggugacgacccacuacgugagccagaucggcggcuuccccgaccagaccgaggacgggggccucccccaguccgggcgcaucgucguggauuacaugauccagaagccgggcaagaccgggacgaucguguaccagcggggcguccugcugccccagaagguguggugcgcgagcggccgcucgaaggugaucaaggggucccucccccugaucggcgaggccgacugccugcaugagaaguacgggggccucaacaagagcaagcccuacuacaccggggagcacgccaaggccaucggcaacuguccgaucugggucaagacgccccugaagcuggccaacggcaccaaguaccggccgcccgcgaagcuccugaaggagcgcggguucuucggcgccaucgccggguuccuggagggcgggugggagggcaugaucgccggcuggcacggguacaccucccauggcgcccacgggguggcggucgccgccgaccucaagagcacccaggaggccaucaacaagaucaccaagaaccugaacucccugagcgagcucgaggugaagaaucugcagcggcuguccggcgccauggacgagcuccacaacgagauccuggagcuggacgagaagguggacgaccuccgcgcggacaccaucaguucccagaucgagcuggccguccugcucagcaacgagggcaucaucaacuccgaggacgagcaccuccuggcccuggagcggaagcugaagaagaugcuggggcccucggccguggacaucggcaaugggugcuucgagacgaagcacaagugcaaccagaccugccucgaccgcaucgcggccggcaccuuuaacgccggggaguucucccugcccaccuucgacagccugaacaucaccgccgccucccucaacgaugacggccuggacaaccacacgauccugcuguacuacagcaccgcggccuccagucucgccgugacccugaugcuggccaucuucaucgucuacauggugucccgggacaacgugagcugcagcaucugccucuga

SEQ ID NO: 15392 - RNA, 1755 nt, Artificial Sequence; identical to SEQ ID NO: 15339
  derived and/or modified CDS sequence (AUadapt) from InfluenzaB__AGX23237__HA

SEQ ID NO: 15393 - RNA, 1755 nt, Artificial Sequence
  derived and/or modified CDS sequence (AUadapt) from InfluenzaB__AGX23248__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacugcaccgaucuggacguggcccucgggcggcccaugugcgugggcaccacgccguccgccaaggccagcauccugcacgagguccgccccgugaccuccggcugcuuccccaucaugcacgaucggaccaagauccgccagcuggcgaaccuccugcggggguacgagaacauccgccugucgacccagaacgugaucgacgccgagaaggcccccggcgggccguaccggcucggcacguccgggagcugucccaacgccaccuccaagagcggcuucuucgcgaccauggccugggccguccccaaggacaacaacaagaaugccaccaacccccugacgguggaggugccguacaucugcaaggagggcgaggaccagaucaccgucuggggguuccacuccgacaacaagacccagaugaagaaucuguacggcgacagcaacccccagaaguucaccuccagcgccuccggggugacgacccacuaugugucgcagaucggcggcuuccccgaccagaccgaggacgggggccucccccaguccgggcgcaucgucguggacuacaugauccagaagccgggcaagaccgggacgaucguguaccagcggggcguccugcugccccagaagguguggugcgcgaguggccgcagcaaggugaucaaggggucccucccccugaucggcgaggccgacugccugcacgagaaguacgggggccucaacaagagcaagcccuauuacaccggggagcacgccaaggccaucggcaacugcccgaucugggucaagacgccccugaagcuggccaacggcaccaaguaccggccgcccgcgaagcuccugaaggagcgcggguucuucggcgccaucgccggguuucuggagggcgggugggagggcaugaucgccggcuggcacggguacaccucccacggcgcccacgggguggcggucgccgccgaccucaagucgacccaggaggccaucaacaagaucaccaagaaucugaacucccugagcgagcucgaggugaagaaccugcagcggcuguccggcgccauggacgagcuccacaacgagauccuggagcuggacgagaagguggacgaucuccgcgcggacaccaucagcucccagaucgagcuggccguccugcucagcaacgagggcaucaucaacuccgaggacgagcaccuccuggcccuggagcggaagcugaagaagaugcuggggcccagugccguggacaucggcaacgggugcuucgagacgaagcacaagugcaaccagaccugccucaaucgcaucgcggccggcaccuucaacgccggggaguucucccugcccaccuucgacucgcugaacaucaccgccgccucccucaaugacgacggccuggacaaccacacgauccugcuguacuacagcaccgcggccuccagucucgccgugacccugaugcuggccaucuucaucgucuacauggugucccgggacaacgugagcugcagcaucugccucuga

SEQ ID NO: 15394 - RNA, 1755 nt, Artificial Sequence; identical to SEQ ID NO: 14166
  derived and/or modified CDS sequence (AUadapt) from InfluenzaB__AGX23259__HA

SEQ ID NO: 15395 - RNA, 1755 nt, Artificial Sequence; identical to SEQ ID NO: 14166
  derived and/or modified CDS sequence (AUadapt) from InfluenzaB__AGX23270__HA

SEQ ID NO: 15396 - RNA, 1755 nt, Artificial Sequence
  derived and/or modified CDS sequence (AUadapt) from InfluenzaB__AGX23281__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaaguccuacuucgccaaccugaaggggacgcggacccgcggcaagcucugccccgacugucugaacugcaccgaccuggacguggcccucgggcggcccaugugcgugggcaccacgccguccgccaaggccagcauccugcaugagguccgccccgugaccuccggcugcuuccccaucaugcacgaccggaccaagauccgccagcuggcgaaccuccugcggggguacgagaacauccgccugaguacccagaacgugaucgacgccgagaaggcccccggcgggccguaccggcucggcacguccgggagcugccccaacgccgcguccaagaguggcuucuucgccaccauggccugggccguccccaaggacaacaacaagaacgccaccaauccccugaccguggaggugccguacaucugcacggagggcgaggaccagaucaccgucuggggguuccacuccgacaauaagacccagaugaagaaccuguacggcgacagcaacccccagaaguucaccuccagcgcgaauggggugacgacccacuacgugucccagaucggcggcuuccccgaccagaccgaggacgggggccucccccagagcgggcgcaucgucguggauuacaugaugcagaagccgggcaagaccgggacgaucguguaccagcggggcguccugcugccccagaagguguggugcgccuccggccgcagcaaggugaucaaggggucgcucccccugaucggcgaggccgacugucugcacgagaaguacgggggccucaacaaguccaagcccuacuacaccggggagcacgccaaggccaucggcaauugcccgaucugggucaagacgccccugaagcuggcgaacggcaccaaguaccggccgcccgccaagcuccugaaggagcgcggguucuucggcgccaucgccggguuccuggagggcgggugggagggcaugaucgccggcuggcacggguauaccagccacggcgcgcacgggguggccgucgccgccgaccucaaguccacccaggaggccaucaacaagaucaccaagaaccugaauagccuguccgagcucgaggugaagaaccugcagcggcugagcggcgcgauggacgagcuccacuccgagauccuggagcuggacgagaagguggaugaccuccgcgccgacaccaucagcucccagaucgagcuggccguccugcucagcaacgagggcaucaucaacuccgaggaugagcaccuccuggcccuggagcggaagcugaagaagaugcuggggcccagcgcgguggacaucggcaacgggugcuucgagacgaagcacaaguguaaccagaccugccucgaccgcaucgccgccggcaccuucaacgccggggaguucucccugcccaccuuugacagccugaacaucaccgccgcgucccucaacgacgacggccuggauaaccacacgauccugcuguacuacagcaccgccgccuccagccucgccgugacccugaugcuggccaucuuuaucgucuacauggugucccgggacaacgugagcugcagcaucugccucuga

SEQ ID NO: 15397 - RNA, 1755 nt, Artificial Sequence
  derived and/or modified CDS sequence (AUadapt) from InfluenzaB__AGX23292__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacugcaccgaucuggacguggcccucgggcggcccaugugcgugggcaccacgccguccgccaaggccagcauccugcacgagguccgccccgugaccuccggcugcuuccccaucaugcacgaucggaccaagauccgccagcuggcgaaccuccugcggggguacgagaacauccgccugucgacccagaacgugaucgacgccgagaaggcccccggcgggccguaccggcucggcacguccgggagcugucccaacgccaacuccaagagcggcuucuucgcgaccauggccugggccguccccaaggacaacaauaagaacgccaccaacccccugaccguggaggugccguacaucugcacggagggcgaggaccagaucaccgucuggggguuccacuccgacaauaagacccagaugaagaaccuguacggcgacagcaacccccagaaguucaccuccucggccaacggggugacgacccauuacgugucccagaucggcggcuuccccgaccagaccgaggacgggggccucccccagagcgggcgcaucgucguggacuacaugaugcagaagccgggcaagaccgggacgaucguguaucagcggggcguccugcugccccagaagguguggugcgcguccggccgcagcaaggugaucaaggggagccucccccugaucggcgaggccgacugccugcacgagaaguacgggggccucaacaaguccaagcccuauuacaccggggagcacgccaaggccaucggcaacugcccgaucugggucaagacgccccugaagcuggccaacggcaccaaguaccggccgcccgcgaagcuccugaaggagcgcggguucuuuggcgccaucgccggguuccuggagggcgggugggagggcaugaucgccggcuggcacggguacaccagccacggcgcccacgggguggcggucgccgccgaccucaaguccacccaggaggccaucaacaagaucaccaagaaucugaacucgcuguccgagcucgaggugaagaaccugcagcggcugagcggcgccauggacgagcuccacaacgagauccuggagcuggacgagaagguggaugaccuccgcgcggacaccaucuccagccagaucgagcuggccguccugcucuccaacgagggcaucaucaacagcgaggacgagcaucuccuggcccuggagcggaagcugaagaagaugcuggggcccuccgccguggacaucggcaacgggugcuucgagacgaagcacaagugcaaccagaccugccucgaucgcaucgcggccggcaccuucaacgccggggaguucucgcugcccaccuucgacucccugaacaucaccgccgccagucucaacgacgacggccuggacaaccacacgauccugcuguacuacuccaccgcggccaguucccucgccgugacccugaugcuggccaucuucaucgucuacauggugagccgggacaacguguccugcagcaucugccucuga

SEQ ID NO: 15398 - RNA, 1755 nt, Artificial Sequence
  derived and/or modified CDS sequence (AUadapt) from InfluenzaB__AGX23314__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaaguccuacuucgccaaccugaaggggacgcggacccgcggcaagcucugccccgacugucugaacugcaccgaccuggacguggcccucgggcggcccaugugcgugggcaccacgccguccgccaaggccagcauccugcaugagguccgccccgugaccuccggcugcuuccccaucaugcacgaccggaccaagauccgccagcuggcgaaccuccugcggggguacgagaacauccgccugaguacccagaacgugaucgacgccgagcgggcccccggcgggccguaccgccucggcacguccgggagcugccccaacgccaccuccaagaguggcuucuucgcgaccauggccugggccguccccaaggacaacaacaagaacgccaccaauccccugacgguggaggugccguacaucugcaccgagggcgaggaccagaucaccgucuggggguuccacuccgacaauaagacccagaugaagaaccuguacggcgacagcaacccccagaaguucacguccagcgccaauggggugaccacccacuacgugucccagaucggcggcuuccccgaccagaccgaggacgggggccucccccagagcgggcggaucgucguggauuacaugaugcagaagccgggcaagacggggaccaucguguaccagcgcggcguccugcugccccagaagguguggugcgcguccggccggagcaaggugaucaaggggucgcucccccugaucggcgaggccgacugucugcacgagaaguacgggggccucaacaaguccaagcccuacuacaccggggagcacgccaaggccaucggcaauugcccgaucugggucaagacgccccugaagcuggccaacggcaccaaguaccgcccgcccgcgaagcuccugaaggagcggggguucuucggcgccaucgccggguuccuggagggcgggugggagggcaugaucgccggcuggcacggguauaccagccacggcgcccacgggguggcggucgccgccgaccucaaguccacccaggaggccaucaacaagaucaccaagaaccugaauagccuguccgagcucgaggugaagaaccugcagcgccugagcggcgccauggacgagcuccacaacgagauccuggagcuggaugagaagguggacgaccuccgggcggacacgaucuccagccagaucgagcuggccguccugcucuccaacgagggcaucaucaacagugaggacgagcaccuccuggcccuggagcgcaagcugaagaagaugcuggggcccuccgccguggacaucggcaacgggugcuucgagaccaagcacaaguguaaccagaccugccucgaccggaucgcggccggcaccuucaacgccggggaguucagucugcccaccuucgacucccugaacaucacggccgccagccucaacgacgauggccuggacaaccacaccauccugcuguacuacuccaccgcggccagcucccucgccgugacccugaugcuggccaucuuuaucgucuacauggugagccgcgacaacguguccugcagcaucugccucuga

SEQ ID NO: 15399 - RNA, 1755 nt, Artificial Sequence; identical to SEQ ID NO: 15398
  derived and/or modified CDS sequence (AUadapt) from InfluenzaB__AGX23325__HA

SEQ ID NO: 15400 - RNA, 1755 nt, Artificial Sequence; identical to SEQ ID NO: 15398
  derived and/or modified CDS sequence (AUadapt) from InfluenzaB__AGX23336__HA

SEQ ID NO: 15401 - RNA, 1755 nt, Artificial Sequence; identical to SEQ ID NO: 15398
  derived and/or modified CDS sequence (AUadapt) from InfluenzaB__AGX23347__HA

SEQ ID NO: 15402 - RNA, 1755 nt, Artificial Sequence; identical to SEQ ID NO: 15398
  derived and/or modified CDS sequence (AUadapt) from InfluenzaB__AGX23358__HA

SEQ ID NO: 15403 - RNA, 1755 nt, Artificial Sequence; identical to SEQ ID NO: 15398
  derived and/or modified CDS sequence (AUadapt) from InfluenzaB__AGX23369__HA

SEQ ID NO: 15404 - RNA, 1755 nt, Artificial Sequence; identical to SEQ ID NO: 15398
  derived and/or modified CDS sequence (AUadapt) from InfluenzaB__AGX23380__HA

SEQ ID NO: 15405 - RNA, 1755 nt, Artificial Sequence; identical to SEQ ID NO: 14166
  derived and/or modified CDS sequence (AUadapt) from InfluenzaB__AGX23391__HA

SEQ ID NO: 15406 - RNA, 1755 nt, Artificial Sequence
  derived and/or modified CDS sequence (AUadapt) from InfluenzaB__AGX23413__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaaguccuacuucgccaaccugaaggggacgcggacccgcggcaagcucugccccgacugccugaauugcaccgaccuggacguggcccucgggcggcccaugugcgugggcaccacgccguccgccaaggccagcauccugcacgagguccgccccgugaccuccggcugcuuucccaucaugcacgaccggaccaagauccgccagcuggcgaaccuccugcggggguacgagaacauccgccugagcaaucagaacgugaucgacgccgagcgggcccccggcgggccguaccgccucggcaccuccgggagcugccccaacgccacguccaagagcggcuuuuucgcgaccauggccugggccguccccaaggacaacaacaagaacgccaccaacccccugaccguggaggugccguacaucuguacggagggcgaggaccagaucaccgucuggggguuccacuccgacaacaagacccagaugaagaaccuguauggcgacucgaacccccagaaguucaccuccagcgccaacggggugacgacccacuaugugucccagaucggcggcuuccccgaccagaccgaggacgggggccucccccagagcgggcggaucgucguggacuacaugaugcagaagccgggcaagaccgggacgaucguguaccagcgcggcguccugcugccccagaagguguggugugcguccggccggagcaaggugaucaaggggagccucccccugaucggcgaggccgacugccugcacgagaaguacgggggccucaauaaguccaagcccuacuacaccggggagcacgccaaggccaucggcaacugcccgaucugggucaagacgccccugaagcuggccaacggcaccaaguaccgcccgcccgcgaagcuccugaaggagcggggguuuuucggcgccaucgccggguuccuggagggcgggugggagggcaugaucgccggcuggcacggguacaccagccacggcgcccacgggguggcggucgccgccgaucucaaguccacccaggaggccaucaacaagaucaccaagaaccugaacagccuguccgagcucgaggugaagaaccugcagcgccugucgggcgccauggaugagcuccacaacgagauccuggagcuggacgagaagguggacgaccuccgggcggacaccaucuccagccagaucgagcuggccguccugcucuccaaugagggcaucaucaacagcgaggacgagcaccuccuggcccuggagcgcaagcugaagaagaugcuggggcccuccgccguggacaucggcaacgggugcuuugagacgaagcacaagugcaaccagaccugccucgaccggaucgcggccggcaccuucaaugccggggaguucagccugcccaccuucgacucccugaacaucaccgccgccagccucaacgaugacggccuggacaaccacacgauccugcuguacuacuccaccgcggccagcucccucgccgugacccugaugcuggccaucuuuaucgucuacauggugagccgcgacaacguguccugcagcaucugccucuga

SEQ ID NO: 15407 - RNA, 1755 nt, Artificial Sequence; identical to SEQ ID NO: 15406
  derived and/or modified CDS sequence (AUadapt) from InfluenzaB__AGX23424__HA

SEQ ID NO: 15408 - RNA, 1755 nt, Artificial Sequence; identical to SEQ ID NO: 14117
  derived and/or modified CDS sequence (AUadapt) from InfluenzaB__AGX23435__HA

SEQ ID NO: 15409 - RNA, 1755 nt, Artificial Sequence; identical to SEQ ID NO: 14471
  derived and/or modified CDS sequence (AUadapt) from InfluenzaB__AGX23446__HA

SEQ ID NO: 15410 - RNA, 1755 nt, Artificial Sequence; identical to SEQ ID NO: 14117
  derived and/or modified CDS sequence (AUadapt) from InfluenzaB__AGX23457__HA

SEQ ID NO: 15411 - RNA, 1755 nt, Artificial Sequence; identical to SEQ ID NO: 14471
  derived and/or modified CDS sequence (AUadapt) from InfluenzaB__AGX23468__HA

SEQ ID NO: 15412 - RNA, 1755 nt, Artificial Sequence; identical to SEQ ID NO: 14166
  derived and/or modified CDS sequence (AUadapt) from InfluenzaB__AGX23479__HA

SEQ ID NO: 15413 - RNA, 1755 nt, Artificial Sequence; identical to SEQ ID NO: 14166
  derived and/or modified CDS sequence (AUadapt) from InfluenzaB__AGX23490__HA

SEQ ID NO: 15414 - RNA, 1755 nt, Artificial Sequence; identical to SEQ ID NO: 14787
  derived and/or modified CDS sequence (AUadapt) from InfluenzaB__AGX23501__HA

SEQ ID NO: 15415 - RNA, 1755 nt, Artificial Sequence
  derived and/or modified CDS sequence (AUadapt) from InfluenzaB__AGX23512__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgaagacccggggcaagcucugccccgacugccugaacuguaccgaccuggacguggcccucgggcgccccaugugcgugggcaccacgccguccgccaaggccagcauccugcacgagguccggcccgugaccuccggcugcuuccccaucaugcacgaucgcaccaagauccggcagcuggcgaaccuccugcgcggguacgagaacauccggcugucgacccagaacgugaucgacgccgagaaggcccccggcgggccguaccgccucggcacguccgggaguugccccaacgccaccuccaagagcggcuucuucgcgaccauggccugggccguccccaaggacaacaacaagaaugccaccaacccccugacgguggaggugccguacaucugcaccgagggcgaggaccagaucaccgucuggggguuccacuccgacaauaagacccagaugaagacgcuguacggcgacagcaacccccagaaguucaccuccucggccaacggggugaccacccacuaugugucccagaucggcggcuuccccgaccagacggaggacgggggccucccccagagcgggcggaucgucguggacuacaugaugcagaagccgggcaagaccgggaccaucguguaccagcgcggcguccugcugccccagaagguguggugugcguccggccggagcaaggugaucaaggggagccucccccugaucggcgaggccgacugccugcacgagaaguacgggggccucaacaaguccaagcccuacuauaccggggagcacgccaaggccaucggcaacugcccgaucugggucaagacgccccugaagcuggccaacggcaccaaguaccgcccgcccgcgaagcuccugaaggagcggggguucuucggcgccaucgccggguuucuggagggcgggugggagggcaugaucgccggcuggcacggguacaccagccacggcgcccacgggguggcggucgccgccgaccucaaguccacccaggaggccaucaacaagaucacgaagaaccugaauucgcuguccgagcucgaggugaagaaccugcagcgccugagcggcgccauggacgagcuccacaacgagauccuggagcuggacgagaagguggaugaccuccgggcggacaccaucuccagccagaucgagcuggccguccugcucuccaacgagggcaucaucaacagcgaggacgagcaccuccuggcccuggagcgcaagcugaagaagaugcuggggcccuccgccguggauaucggcaacgggugcuucgagaccaagcacaagugcaaccagaccugccucgaucggaucgcggccggcaccuucaacgccggggaguucucgcugcccacguucgacucccugaacaucaccgccgccagccucaaugacgacggccuggacaaccacaccauccugcuguacuacuccaccgcggccaguucccucgccgugacgcugaugcuggccaucuucaucgucuacauggugagccgcgacaacguguccugcagcaucugccucuga

SEQ ID NO: 15416 - RNA, 1755 nt, Artificial Sequence; identical to SEQ ID NO: 14166
  derived and/or modified CDS sequence (AUadapt) from InfluenzaB__AGX23523__HA

SEQ ID NO: 15417 - RNA, 1755 nt, Artificial Sequence; identical to SEQ ID NO: 14471
  derived and/or modified CDS sequence (AUadapt) from InfluenzaB__AGX23534__HA

SEQ ID NO: 15418 - RNA, 1755 nt, Artificial Sequence; identical to SEQ ID NO: 14471
  derived and/or modified CDS sequence (AUadapt) from InfluenzaB__AGX23545__HA

SEQ ID NO: 15419 - RNA, 1755 nt, Artificial Sequence; identical to SEQ ID NO: 14166
  derived and/or modified CDS sequence (AUadapt) from InfluenzaB__AGX23556__HA

SEQ ID NO: 15420 - RNA, 1755 nt, Artificial Sequence; identical to SEQ ID NO: 14166
  derived and/or modified CDS sequence (AUadapt) from InfluenzaB__AGX23567__HA

SEQ ID NO: 15421 - RNA, 1755 nt, Artificial Sequence; identical to SEQ ID NO: 14166
  derived and/or modified CDS sequence (AUadapt) from InfluenzaB__AGX23578__HA

SEQ ID NO: 15422 - RNA, 1755 nt, Artificial Sequence; identical to SEQ ID NO: 14166
  derived and/or modified CDS sequence (AUadapt) from InfluenzaB__AGX23600__HA

SEQ ID NO: 15423 - RNA, 1755 nt, Artificial Sequence
  derived and/or modified CDS sequence (AUadapt) from InfluenzaB__AGX23611__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacugcaccgaucuggacguggcccucgggcggcccaugugcgugggcaccacgccguccgccaaggccagcauccugcacgagguccgccccgugaccuccggcugcuuccccaucaugcacgaucggaccaagauccgccagcuggcgaaccuccugcggggguacgagaacauccgccugucgacccagaacgugaucgacgccgagaaggcccccggcgggccguaccggcucggcacguccgggagcugucccaacgccaccuccaagagcggcuucuucgcgaccauggccugggccguccccaaggacaacaacaagaaugccaccaacccccugacgguggaggugccguacaucugcaccgagggcgaggaccagaucaccgucuggggguuccacuccgacaacaagacccagaugaagaaucuguacggcgacagcaacccccagaaguucacguccucggccaacggggugaccacccauuacgugucccagaucggcggcuuccccgaccagaccgaggacgggggccucccccagagcgggcgcaucgucguggacuacaugaugcagaagccgggcaagacggggaccaucguguaccagcggggcguccugcugccccagaagguguggugugcguccggccgcagcaaggugaucaaggggagccucccccugaucggcgaggccgacugccugcacgagaaguacgggggccucaacaaguccaagcccuauuacaccggggagcacgccaaggccaucggcaacugcccgaucugggucaagacgccccugaagcuggccaacggcaccaaguaccggccgcccgcgaagcuccugaaggagcgcggguucuucggcgccaucgccggguuucuggagggcgggugggagggcaugaucgccggcuggcacggguacaccagccacggcgcccacgggguggcggucgccgccgaccucaaguccacccaggaggccaucaacaagaucaccaagaaucugaacucgcuguccgagcucgagaucaagaaccugcagcggcugagcggcgccauggacgagcuccacaacgagauccuggagcuggacgagaagguggaugaccuccgcgcggacacgaucuccagccagaucgagcuggccgugcugcucuccaacgagggcaucaucaacagcgaggacgagcaucuccuggcccuggagcggaagcugaagaagaugcuggggcccuccgccgucgacaucggcaacgggugcuucgagaccaagcacaagugcaaccagaccugccucgaucgcaucgcggccggcaccuucaacgccggggaguucucgcugcccaccuucgacucccugaacaucacggccgccagucucaacgacgacggccuggacaaccacaccauccugcuguacuacuccaccgcggccaguucccucgccgugacccugaugcuggccaucuucaucguguacauggucagccgggacaacguguccugcagcaucugccucuga

SEQ ID NO: 15424 - RNA, 1755 nt, Artificial Sequence; identical to SEQ ID NO: 14166
  derived and/or modified CDS sequence (AUadapt) from InfluenzaB__AGX23622__HA

SEQ ID NO: 15425 - RNA, 1755 nt, Artificial Sequence; identical to SEQ ID NO: 14471
  derived and/or modified CDS sequence (AUadapt) from InfluenzaB__AGX23633__HA

SEQ ID NO: 15426 - RNA, 1755 nt, Artificial Sequence; identical to SEQ ID NO: 14471
  derived and/or modified CDS sequence (AUadapt) from InfluenzaB__AGX23644__HA

SEQ ID NO: 15427 - RNA, 1755 nt, Artificial Sequence; identical to SEQ ID NO: 14166
  derived and/or modified CDS sequence (AUadapt) from InfluenzaB__AGX23655__HA

SEQ ID NO: 15428 - RNA, 1755 nt, Artificial Sequence; identical to SEQ ID NO: 14471
  derived and/or modified CDS sequence (AUadapt) from InfluenzaB__AGX23666__HA

SEQ ID NO: 15429 - RNA, 1755 nt, Artificial Sequence
  derived and/or modified CDS sequence (AUadapt) from InfluenzaB__AGX23677__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuauuucgccaaccugaaggggacgaagacccggggcaagcucugccccgacugccugaacugcaccgaccuggacguggcccucgggcgccccaugugugugggcaccacgccguccgccaaggccucgauccugcacgagguccggcccgugaccuccggcugcuuccccaucaugcacgaccgcaccaagauccggcagcuggcgaaccuccugcgcggguacgagaagauccggcugaguacccagaacgugaucgacgccgagaaggcccccggcgggccguaccgccucggcacguccgggagcugccccaacgccaccuccaagagcggcuucuucgcgaccauggccugggccguccccaaggauaacaacaagaacgccaccaacccccugacgguggaggugccguacaucugcaucgagggcgaggaccagaucaccgucuggggguuccacuccgauaacaagacccagaugaagaaccuguacggcgacucgaacccccagaaguucaccuccagcgccaauggggugacgacccacuacgugucccagaucggcggcuuccccgaccagaccgaggacgggggccucccccagagcgggcggaucgucguggacuacaugaugcagaagccgggcaagaccgggacgaucguguaccagcgcggcguccugcugccccagaagguguggugugcguccggccggagcaaggugaucaaggggucgcucccccugaucggcgaggccgacugccugcacgagaaguacgggggccucaacaaguccaagcccuacuauaccggggagcacgccaaggccaucggcaacugcccgaucugggucaagacgccccugaagcuggccaacggcaccaaguaccgcccgcccgcgaagcuccugaaggagcggggguucuucggcgccaucgccggguuccuggagggcgggugggagggcaugaucgccggcuggcacggguauaccagccacggcgcccacgggguggcggucgccgccgaccucaaguccacccaggaggccaucaacaagaucaccaagaaccugaacagccuguccgagcucgaggugaagaaccugcagcgccugaguggcgccauggacgagcuccacaacgagauccuggagcuggacgagaagguggacgaccuccgggcggacaccaucuccagccagaucgagcuggccguccugcucuccaaugagggcaucaucaacagcgaggacgagcaccuccuggcccuggagcgcaagcugaagaagaugcuggggcccuccgccguggacaucggcaacgggugcuucgagacgaagcacaaguguaaccagaccugccucgaccggaucgcggccggcaccuucaacgccggggaguucagccugcccaccuucgauucccugaacaucaccgccgccucgcucaacgacgacggccuggacaaccacacgauccugcuguacuauuccaccgcggccagcucccucgccgugacccugaugcuggccaucuucaucgucuacauggugagccgcgacaacguguccugcagcaucugccucuga

SEQ ID NO: 15430 - RNA, 1755 nt, Artificial Sequence; identical to SEQ ID NO: 14471
  derived and/or modified CDS sequence (AUadapt) from InfluenzaB__AGX23688__HA

SEQ ID NO: 15431 - RNA, 1755 nt, Artificial Sequence; identical to SEQ ID NO: 14471
  derived and/or modified CDS sequence (AUadapt) from InfluenzaB__AGX23699__HA

SEQ ID NO: 15432 - RNA, 1755 nt, Artificial Sequence; identical to SEQ ID NO: 14166
  derived and/or modified CDS sequence (AUadapt) from InfluenzaB__AGX23710__HA

SEQ ID NO: 15433 - RNA, 1755 nt, Artificial Sequence; identical to SEQ ID NO: 14471
  derived and/or modified CDS sequence (AUadapt) from InfluenzaB__AGX23721__HA

SEQ ID NO: 15434 - RNA, 1755 nt, Artificial Sequence; identical to SEQ ID NO: 14166
  derived and/or modified CDS sequence (AUadapt) from InfluenzaB__AGX23732__HA

SEQ ID NO: 15435 - RNA, 1755 nt, Artificial Sequence; identical to SEQ ID NO: 14471
  derived and/or modified CDS sequence (AUadapt) from InfluenzaB__AGX23743__HA

SEQ ID NO: 15436 - RNA, 1755 nt, Artificial Sequence; identical to SEQ ID NO: 14471
  derived and/or modified CDS sequence (AUadapt) from InfluenzaB__AGX23754__HA

SEQ ID NO: 15437 - RNA, 1755 nt, Artificial Sequence; identical to SEQ ID NO: 14166
  derived and/or modified CDS sequence (AUadapt) from InfluenzaB__AGX23765__HA

SEQ ID NO: 15438 - RNA, 1755 nt, Artificial Sequence; identical to SEQ ID NO: 14471
  derived and/or modified CDS sequence (AUadapt) from InfluenzaB__AGX23776__HA

SEQ ID NO: 15439 - RNA, 1755 nt, Artificial Sequence; identical to SEQ ID NO: 14471
  derived and/or modified CDS sequence (AUadapt) from InfluenzaB__AGX23787__HA

SEQ ID NO: 15440 - RNA, 1755 nt, Artificial Sequence; identical to SEQ ID NO: 14166
  derived and/or modified CDS sequence (AUadapt) from InfluenzaB__AGX23798__HA

SEQ ID NO: 15441 - RNA, 1755 nt, Artificial Sequence; identical to SEQ ID NO: 14166
  derived and/or modified CDS sequence (AUadapt) from InfluenzaB__AGX23809__HA

SEQ ID NO: 15442 - RNA, 1755 nt, Artificial Sequence; identical to SEQ ID NO: 14166
  derived and/or modified CDS sequence (AUadapt) from InfluenzaB__AGX23820__HA

SEQ ID NO: 15443 - RNA, 1755 nt, Artificial Sequence; identical to SEQ ID NO: 14471
  derived and/or modified CDS sequence (AUadapt) from InfluenzaB__AGX23831__HA

SEQ ID NO: 15444 - RNA, 1755 nt, Artificial Sequence; identical to SEQ ID NO: 14166
  derived and/or modified CDS sequence (AUadapt) from InfluenzaB__AGX23842__HA

SEQ ID NO: 15445 - RNA, 1755 nt, Artificial Sequence
  derived and/or modified CDS sequence (AUadapt) from InfluenzaB__AGX23853__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuauuucgccaaccugaaggggacgcggacccgcggcaagcucugccccgacugccugaacugcaccgaccuggauguggcccucgggcggcccaugugcgugggcaccacgccguccgccaaggccagcauccugcacgagguccgccccgugaccuccggcugcuuccccaucaugcacgaccggaccaagauccgccagcuggcgaaccuccugcggggguaugagaacauccgccugucgauccagaacgugaucgacgccgagaaggcccccggcgggccguaccggcucggcaccuccgggagcugccccaacgccacguccaagaguggcuucuucgcgaccauggccugggccguccccaaggacaacaacaagaacgccaccaacccccugaccguggaggugccguacaucuguacggagggcgaggaccagaucaccgucuggggguuccacuccgacaacaagacccagaugaagaaccuguacggcgacaguaacccccagaaguucaccuccagcgccaacggggugacgacccacuacgugucccagaucggcggcuuccccgaccagaccgaggaugggggccucccccagucggggcgcaucgucguggacuacaugaugcagaaguccggcaagaccgggacgaucguguaccagcggggcguccugcugccgcagaagguguggugcgcgagcggccgcagcaaggugaucaaggggucccucccccugaucggcgaggccgacugccugcaugagaaguacgggggccucaacaagagcaagcccuacuacaccggggagcacgccaaggccaucggcaacugccccaucugggucaagaccccgcugaagcuggccaauggcaccaaguaccggccgcccgcgaagcuccugaaggagcgcggguucuucggcgccaucgccggguuccuggagggcgggugggagggcaugaucgccggcuggcacggguacacgucccacggcgcccacgggguggcggucgccgccgaucucaagucgacccaggaggccaucaacaagaucaccaagaaccugaacucccugagcgagcucgaggugaagaaccugcagcggcuguccggcgccauggacgagcuccacaaugagauccuggagcuggacgagaagguggacgaccuccgcgcggacaccaucagcucccagaucgagcuggccguccugcucagcaacgagggcaucaucaacuccgaggaugagcaccuccuggcccuggagcggaagcugaagaagaugcuggggcccagcgccguggacaucggcaacgggugcuucgagacgaagcacaagugcaaucagaccugccucgaccgcaucgcggccggcaccuucaacgccggggaguucucccugcccaccuucgacucgcugaauaucaccgccgccucccucaacgacgacggccuggacaaccacacgauccugcuguacuacaguaccgcggccuccagccucgccgugacccugaugcuggccaucuucaucgucuacauggugucccgggacaacgugagcugcagcaucugccucuga

SEQ ID NO: 15446 - RNA, 1755 nt, Artificial Sequence; identical to SEQ ID NO: 14166
  derived and/or modified CDS sequence (AUadapt) from InfluenzaB__AGX23864__HA

SEQ ID NO: 15447 - RNA, 1755 nt, Artificial Sequence; identical to SEQ ID NO: 14471
  derived and/or modified CDS sequence (AUadapt) from InfluenzaB__AGX23875__HA

SEQ ID NO: 15448 - RNA, 1755 nt, Artificial Sequence; identical to SEQ ID NO: 14166
  derived and/or modified CDS sequence (AUadapt) from InfluenzaB__AGX23886__HA

SEQ ID NO: 15449 - RNA, 1755 nt, Artificial Sequence
  derived and/or modified CDS sequence (AUadapt) from InfluenzaB__AGX23897__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacugcaccgaucuggacguggcccucgggcggcccaugugcgugggcaccacgccguccgccaaggccagcauccugcacgagguccgccccgugaccuccggcugcuuccccaucaugcacgaucggaccaagauccgccagcuggcgaaccuccugcggggguacgagaacauccgccugucgacccagaacgugaucgacgccgagaaggcccccggcgggccguaccggcucggcacguccgggagcugucccaacgccaccuccaagagcggcuucuucgcgaccauggccugggccguccccaaggacaacaacaagaaugccaccaacccccugacgguggaggugccguacaucugcaccgagggcgaggaccagaucaccgucuggggguuccacuccgacaacaagacccagaugaagaaucuguacggcgacagcaacccccagaaguucacguccagcgccaacggggugaccacccacuaugugucccagaucggcggcuuccccgaccagaccgaggacgggggccucccccagucggggcgcaucgucguggacuacaugaugcagaaguccggcaagacggggaccaucguguaccagcggggcguccugcugccgcagaagguguggugugcgagcggccgcagcaaggugaucaaggggucccucccccugaucggcgaggccgacugccugcacgagaaguacgggggccucaacaagagcaagcccuauuacaccggggagcacgccaaggccaucggcaacugccccaucugggucaagaccccgcugaagcuggccaacggcacgaaguaccggccgcccgcgaagcuccugaaggagcgcggguucuuuggcgccaucgccggguuccuggagggcgggugggagggcaugaucgccggcuggcacggguacaccucccacggcgcccacgggguggcggucgccgccgaccucaagucgacccaggaggccaucaacaagaucaccaagaaucugaacucccugagcgagcucgaggugaagaaccugcagcggcuguccggcgccauggacgagcuccacaacgagauccuggagcuggacgagaagguggacgaucuccgcgcggacacgaucagcucccagaucgagcuggccguccugcucagcaacgagggcaucaucaacuccgaggacgagcaccuccuggcccuggagcggaagcugaagaagaugcuggggcccagugccguggacaucggcaacgggugcuucgagaccaagcacaagugcaaccagaccugccucgaucgcaucgcggccggcaccuucaacgccggggaguucucccugcccaccuucgacucgcugaacaucacggccgccucccucaaugacgacggccuggacaaccacaccauccugcuguacuacagcaccgcggccuccagucucgccgugacccugaugcuggccaucuucaucgucuacauggugucccgggacaacgugagcugcagcaucugccucuga

SEQ ID NO: 15450 - RNA, 1755 nt, Artificial Sequence
  derived and/or modified CDS sequence (AUadapt) from InfluenzaB__AGX23908__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacugcaccgaucuggacguggcccucgggcggcccaugugcgugggcaccacgccguccgccaaggccagcauccugcacgagguccgccccgugaccuccggcugcuuccccaucaugcacgaucggaccaagauccgccagcuggcgaaccuccugcggggguacgagaacauccgccugagcacccagaacgugaucgacgccgagaaggcccccggcgggccguaccggcucggcacguccgggucgugucccaacgccaccuccaagagcggcuucuucgucaccauggcgugggccgugcccaaggacaacaacaagaaugccaccaacccccugacgguggaggucccguacaucugcaccgagggcgaggaccagaucaccguguggggguuccacuccgacaacaagacccagaugaagaaucuguacggcgacagcaacccccagaaguucacguccagcgccaacggggugaccacccauuacgucucccagaucggcggcuuccccgaccagaccgaggacgggggccucccccagagcgggcgcaucgugguggacuacaugaugcagaagccgggcaagacggggaccaucgucuaccagcggggcgugcugcugccccagaagguguggugugccuccggccgcagcaaggucaucaaggggucgcucccccugaucggcgaggcggacugccugcacgagaaguacgggggccucaacaaguccaagcccuauuacaccggggagcacgccaaggccaucggcaacugcccgaucugggugaagacgccccugaagcuggccaacggcaccaaguaccggccgcccgccaagcuccugaaggagcgcggguucuucggcgcgaucgccggguuucuggagggcgggugggagggcaugaucgccggcuggcacggguacaccagccacggcgcccacggggucgccguggcggccgaccucaaguccacccaggaggccaucaacaagaucaccaagaaucugaacagccuguccgagcucgaggugaagaaccugcagcggcugagcggcgccauggacgagcuccacaacgagauccuggagcuggacgagaaggucgaugaccuccgcgccgacacgaucuccagccagaucgagcuggcggugcugcucuccaacgagggcaucaucaacucggaggacgagcaucuccuggcccuggagcggaagcugaagaagaugcuggggcccuccgccguggacaucggcaacgggugcuucgagaccaagcacaagugcaaccagaccugccucgaucgcaucgccgcgggcaccuucaacgccggggaguucagccugcccaccuucgacucccugaacaucacggccgccagucucaacgacgacggccuggacaaccacaccauccugcuguacuacuccaccgccgcgaguucccucgccgucacccugaugcuggccaucuucaucguguacauggugagccgggacaacgucuccugcagcaucugccucuga

SEQ ID NO: 15451 - RNA, 1755 nt, Artificial Sequence; identical to SEQ ID NO: 14307
  derived and/or modified CDS sequence (AUadapt) from InfluenzaB__AGX23919__HA

SEQ ID NO: 15452 - RNA, 1755 nt, Artificial Sequence; identical to SEQ ID NO: 14787
  derived and/or modified CDS sequence (AUadapt) from InfluenzaB__AGX23930__HA

SEQ ID NO: 15453 - RNA, 1755 nt, Artificial Sequence; identical to SEQ ID NO: 14166
  derived and/or modified CDS sequence (AUadapt) from InfluenzaB__AGX23941__HA

SEQ ID NO: 15454 - RNA, 1755 nt, Artificial Sequence; identical to SEQ ID NO: 14471
  derived and/or modified CDS sequence (AUadapt) from InfluenzaB__AGX23952__HA

SEQ ID NO: 15455 - RNA, 1755 nt, Artificial Sequence; identical to SEQ ID NO: 14471
  derived and/or modified CDS sequence (AUadapt) from InfluenzaB__AGX23963__HA

SEQ ID NO: 15456 - RNA, 1755 nt, Artificial Sequence; identical to SEQ ID NO: 14787
  derived and/or modified CDS sequence (AUadapt) from InfluenzaB__AGX23974__HA

SEQ ID NO: 15457 - RNA, 1755 nt, Artificial Sequence; identical to SEQ ID NO: 14307
  derived and/or modified CDS sequence (AUadapt) from InfluenzaB__AGX23985__HA

SEQ ID NO: 15458 - RNA, 1755 nt, Artificial Sequence
  derived and/or modified CDS sequence (AUadapt) from InfluenzaB__AGX23996__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacugcaccgaucuggacguggcccucgggcggcccaugugcgugggcaccacgccguccgccaaggccagcauccugcacgagguccgccccaucaccuccggcugcuuccccaucaugcacgaucggaccaagauccgccagcuggcgaaccuccugcggggguacgagaacauccgccugucgacccagaacgugaucgacgccgagaaggcccccggcgggccguaccggcucggcacguccgggagcugucccaacgccaccuccaagagcggcuucuucgcgaccauggccugggccgugcccaaggacaacaacaagaaugccaccaacccccugacggucgaggugccguacaucugcaccgagggcgaggaccagaucaccguguggggguuccacuccgacaacaagacccagaugaagaaucuguacggcgacagcaacccccagaaguucacguccucggccaacggggucaccacccauuacgugucccagaucggcggcuuccccgaccagaccgaggacgggggccucccccagagcgggcgcaucguggucgacuacaugaugcagaagccgggcaagacggggaccaucguguaccagcggggcgugcugcugccccagaaggucuggugugcguccggccgcagcaaggugaucaaggggagccucccccugaucggcgaggccgacugccugcacgagaaguacgggggccucaacaaguccaagcccuauuacaccggggagcacgccaaggccaucggcaacugcccgaucugggugaagacgccccugaagcuggccaacggcaccaaguaccggccgcccgcgaagcuccugaaggagcgcggguucuucggcgccaucgccggguuucuggagggcgggugggagggcaugaucgccggcuggcacggguacaccagccacggcgcccacggggucgcgguggccgccgaccucaaguccacccaggaggccaucaacaagaucaccaagaaucugaacucgcuguccgagcucgaggucaagaaccugcagcggcugagcggcgccauggacgagcuccacaacgagauccuggagcuggacgagaagguggaugaccuccgcgcggacacgaucuccagccagaucgagcuggccgugcugcucuccaacgagggcaucaucaacagcgaggacgagcaucuccuggcccuggagcggaagcugaagaagaugcuggggcccuccgccgucgacaucggcaacgggugcuucgagaccaagcacaagugcaaccagaccugccucgaucgcaucgcggccggcaccuucaacgccggggaguucucgcugcccaccuucgacucccugaacaucacggccgccagucucaacgacgacggccuggacaaccacaccauccugcuguacuacuccaccgcggccaguucccucgccgugacccugaugcuggccaucuucaucguguacauggucagccgggacaacguguccugcagcaucugccucuga

SEQ ID NO: 15459 - RNA, 1755 nt, Artificial Sequence; identical to SEQ ID NO: 14787
  derived and/or modified CDS sequence (AUadapt) from InfluenzaB__AGX24007__HA

SEQ ID NO: 15460 - RNA, 1755 nt, Artificial Sequence; identical to SEQ ID NO: 14787
  derived and/or modified CDS sequence (AUadapt) from InfluenzaB__AGX24018__HA

SEQ ID NO: 15461 - RNA, 1755 nt, Artificial Sequence
  derived and/or modified CDS sequence (AUadapt) from InfluenzaB__AGX24029__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuauuucgccaaccugaaggggacgcggacccgcggcaagcucugccccgacugccugaacugcaccgaccuggacguggcccucgggcggcccaugugugugggcaccacgccguccgccaaggccucgauccugcacgagguccgccccgugaccuccggcugcuuccccaucaugcacgaccggaccaagauccgccagcugcccaaccuccugcggggguacgagaacauccgccugaguacccagaacgugaucgacgcggagaaggccccgggcgggcccuaccggcucggcacguccgggagcugccccaacgccaccuccaagucgggcuucuuugccaccauggcgugggccguccccaaggacaacaacaagaacgccaccaacccgcugacgguggaggugcccuacaucugcaaggagggcgaggaccagaucaccgucuggggguuccauuccgacaacaagacccagaugaagaaccuguacggcgacagcaacccccagaaguucaccuccagcgccaauggggugacgacccacuacgugucccagaucggcucguuccccgaccagaccgaggacggcgggcucccgcaguccggccgcaucgucguggacuacaugaugcagaagcccgggaagaccggcacgaucguguaucagcgcgggguccugcugccccagaagguguggugcgccagcggccggagcaaggugaucaagggcucccucccccugaucggggaggcggacugccugcacgagaaguacggcgggcucaacaagagcaagccguauuacaccggcgagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcauggcuacaccucccacggggcccacggcguggccgucgcggccgaccucaagucgacccaggaggccaucaacaagaucaccaagaaccugaacucccugagugagcucgaggugaagaaccugcagcggcuguccggggccauggacgagcuccacaacgagauccuggagcuggacgagaagguggacgaccuccgcgccgacaccaucagcucccagaucgagcuggcgguccugcucaguaacgagggcaucaucaacuccgaggacgagcaccuccuggcccuggagcggaagcugaagaagaugcugggccccagcgccguggagaucgggaacggcugcuucgagacgaagcacaaguguaaccagaccugccucaaccgcaucgccgcggggaccuucaacgccggcgaguucucccugcccaccuucgacagucugaacaucaccgccgccucccucaacgacgacgggcuggacaaccacacgauccugcuguacuacaguaccgccgcguccagccucgccgugacccugaugcuggccaucuucaucgucuacauggugucccgggacaacgugagcugcagcaucugccucuga

SEQ ID NO: 15462 - RNA, 1755 nt, Artificial Sequence; identical to SEQ ID NO: 14787
  derived and/or modified CDS sequence (AUadapt) from InfluenzaB__AGX24040__HA

SEQ ID NO: 15463 - RNA, 1755 nt, Artificial Sequence; identical to SEQ ID NO: 14471
  derived and/or modified CDS sequence (AUadapt) from InfluenzaB__AGX24051__HA

SEQ ID NO: 15464 - RNA, 1755 nt, Artificial Sequence; identical to SEQ ID NO: 14117
  derived and/or modified CDS sequence (AUadapt) from InfluenzaB__AGX24062__HA

SEQ ID NO: 15465 - RNA, 1755 nt, Artificial Sequence; identical to SEQ ID NO: 14307
  derived and/or modified CDS sequence (AUadapt) from InfluenzaB__AGX24073__HA

SEQ ID NO: 15466 - RNA, 1755 nt, Artificial Sequence
  derived and/or modified CDS sequence (AUadapt) from InfluenzaB__AGX24084__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacugcaccgaucuggacguggcccucgggcggcccaugugcgugggcaccacgccguccgccaaggccagcaucauccacgagguccgccccgugaccuccggcugcuuccccaucaugcacgaucggaccaagauccgccagcuggcgaaccugcuccggggguacgagaacauccgccugucgacccagaacgugaucgacgccgagaaggcccccggcgggccguaccggcugggcacguccgggagcugucccaacgccaccuccaagagcggcuucuucgcgaccauggccugggccguccccaaggacaacaacaagaaugccaccaacccccucacgguggaggugccguacaucugcaccgagggcgaggaccagaucaccgucuggggguuccacuccgacaacaagacccagaugaagaaucuguacggcgacagcaacccccagaaguucacguccucggccaacggggugaccacccauuacgugucccagaucggcggcuuccccgaccagaccgaggacgggggccugccccagagcgggcgcaucgucguggacuacaugaugcagaagccgggcaagacggggaccaucguguaccagcggggcguccuccugccccagaagguguggugugcguccggccgcagcaaggugaucaaggggagccugccccucaucggcgaggccgacugccugcacgagaaguacgggggccugaacaaguccaagcccuauuacaccggggagcacgccaaggccaucggcaacugcccgaucugggucaagacgccccucaagcuggccaacggcaccaaguaccggccgcccgcgaagcugcucaaggagcgcggguucuucggcgccaucgccggguuucuggagggcgggugggagggcaugaucgccggcuggcacggguacaccagccacggcgcccacgggguggcggucgccgccgaccugaaguccacccaggaggccaucaacaagaucaccaagaaucucaacucgcuguccgagcuggaggugaagaaccuccagcggcugagcggcgccauggacgagcugcacaacgagauccucgagcuggacgagaagguggaugaccugcgcgcggacacgaucuccagccagaucgagcucgccguccugcuguccaacgagggcaucaucaacagcgaggacgagcaucuccuggcccuggagcggaagcucaagaagaugcuggggcccuccgccguggacaucggcaacgggugcuucgagaccaagcacaagugcaaccagaccugccuggaucgcaucgcggccggcaccuucaacgccggggaguucucgcuccccaccuucgacucccugaacaucacggccgccagucugaacgacgacggccucgacaaccacaccauccugcuguacuacuccaccgcggccaguucccuggccgugacccucaugcuggccaucuucaucgucuacauggugagccgggacaacguguccugcagcaucugccuguga

SEQ ID NO: 15467 - RNA, 1755 nt, Artificial Sequence; identical to SEQ ID NO: 14787
  derived and/or modified CDS sequence (AUadapt) from InfluenzaB__AGX24095__HA

SEQ ID NO: 15468 - RNA, 1755 nt, Artificial Sequence
  derived and/or modified CDS sequence (AUadapt) from InfluenzaB__AGX24106__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacugcaccgaucuggacguggcccucgggcggcccaugugcgugggcaccacgccguccgccaaggccagcauccugcacgagguccgccccgugaccuccggcugcuuccccaucaugcacgaucggaccaagauccgccagcuggcgaaccuccugcggggguacgagaacauccgccugucgacccagaacgugaucgacgccgagaaggcccccggcgggccguaccggcucggcacguccgggagcugucccaacaccaccuccaagagcggcuucuucgccaccauggcgugggccguccccaaggacaacaacaagaaugccacgaacccccugaccguggaggugccguacaucugcaccgagggcgaggaccagaucaccgucuggggguuccacuccgacaacaagacgcagaugaagaaucuguacggcgacagcaacccccagaaguucaccuccucggccaacggggugaccacccauuacgugucccagaucggcggcuuccccgaccagacggaggacgggggccucccccagagcgggcgcaucgucguggacuacaugaugcagaagccgggcaagaccgggaccaucguguaccagcggggcguccugcugccccagaagguguggugugccuccggccgcagcaaggugaucaaggggagccucccccugaucggcgaggcggacugccugcacgagaaguacgggggccucaacaaguccaagcccuauuacaccggggagcacgccaaggccaucggcaacugcccgaucugggucaagacgccccugaagcuggccaacggcaccaaguaccggccgcccgccaagcuccugaaggagcgcggguucuucggcgcgaucgccggguuucuggagggcgggugggagggcaugaucgccggcuggcacggguacaccagccacggcgcccacgggguggccgucgcggccgaccucaaguccacccaggaggccaucaacaagaucacgaagaaucugaacucgcuguccgagcucgaggugaagaaccugcagcggcugagcggcgccauggacgagcuccacaacgagauccuggagcuggacgagaagguggaugaccuccgcgccgacaccaucuccagccagaucgagcuggcgguccugcucuccaacgagggcaucaucaacagcgaggacgagcaucuccuggcccuggagcggaagcugaagaagaugcuggggcccuccgccguggacaucggcaacgggugcuucgagaccaagcacaagugcaaccagaccugccucgaucgcaucgccgcgggcaccuucaacgccggggaguucucgcugcccacguucgacucccugaacaucaccgccgccagucucaacgacgacggccuggacaaccacaccauccugcuguacuacuccaccgccgcgaguucccucgccgugacgcugaugcuggccaucuucaucgucuacauggugagccgggacaacguguccugcagcaucugccucuga

SEQ ID NO: 15469 - RNA, 1755 nt, Artificial Sequence
  derived and/or modified CDS sequence (AUadapt) from InfluenzaB__AGX24117__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuauuucgccaaccugaaggggacgcggacccgcggcaagcucugccccgacugccugaacugcaccgaccuggacguggcccucgggcggcccaugugugugggcaccacgccguccgccaaggccucgauccugcacgagguccgccccgugaccuccggcugcuuccccaucaugcacgaccggaccaagauccgccagcugcccaaccuccugcggggguacgagaacauccgccugaguacccagaacgugaucgacgcggagaaggccccgggcgggcccuaccggcucggcacguccgggagcugccccaacaccaccuccaagucgggcuucuuugccaccauggccugggcgguccccaaggacaacaacaagaacgccacgaacccgcugaccguggaggugcccuacaucugcaccgagggcgaggaccagaucaccgucuggggguuccauuccgacaacaagacgcagaugaagaaccuguacggcgacagcaacccccagaaguucaccuccagcgccaauggggugaccacccacuacgugucccagaucggcucguuccccgaccagacggaggacggcgggcucccgcaguccggccgcaucgucguggacuacaugaugcagaagcccgggaagaccggcaccaucguguaucagcgggggauccugcugccccagaaggucuggugcgccagcggccgcagcaaggugaucaagggcucccucccccugaucggggaggccgacugccugcacgagaaguacggcgggcucaacaagagcaagccguauuacaccggcgagcacgcgaaggccaucgggaacugccccaucugggugaagacgccccugaagcuggccaacggcaccaaguaccggcccccggccaagcuccugaaggagcgcggcuucuucggggccaucgcgggcuuccuggagggcgggugggaggggaugaucgccggcuggcauggcuacaccucccacggggcccacggcgucgccguggccgcggaccucaagucgacccaggaggccaucaacaagaucacgaagaaccugaacucccugagugagcucgaggucaagaaccugcagcggcuguccggggccauggacgagcuccacaacgagauccuggagcuggacgagaagguggacgaccuccgcgccgacaccaucagcucccagaucgagcuggccgugcugcucaguaacgagggcaucaucaacuccgaggacgagcaccuccuggcgcuggagcggaagcugaagaagaugcugggccccagcgccgucgagaucgggaacggcugcuucgagaccaagcacaaguguaaccagaccugccucgaccgcaucgccgccgggaccuucaacgcgggcgaguucucccugcccacguucgacagucugaacaucaccgccgccucccucaacgacgacgggcuggacaaccacaccauccugcuguacuacaguaccgccgccuccagccucgcggugacgcugaugcuggccaucuucaucguguacauggucucccgggacaacgugagcugcagcaucugccucuga

SEQ ID NO: 15470 - RNA, 1755 nt, Artificial Sequence
  derived and/or modified CDS sequence (AUadapt) from InfluenzaB__AGX24128__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaagaguuacuucgccaaccugaaggggacgcggacccgcggcaagcucugccccgacugccugaacugcaccgaccuggauguggcccucgggcggcccaugugcgugggcaccacgccguccgccaaggccucgauccugcacgagguccgccccgugaccuccggcugcuuccccaucaugcacgaccggaccaagauccgccagcugcccaaccuccugcggggguacgagaauauccgccugagcacccagaacgugaucgacgcggagaaggccccgggcgggcccuaccggcucggcacguccgggagcugccccaacgccaccuccaagaucggcuucuuugccaccauggcgugggccguccccaaggacaacuacaagaacgccaccaacccgcugacgguggaggugcccuacaucugcaccgagggcgaggaccagaucaccgucuggggguuccauagcgacaacaagacccagaugaagaaccuguacggcgacuccaacccccagaaguucacgucguccgccaauggggugaccacccacuacgugagccagaucggcgacuuccccgaccagaccgaggacggcgggcucccgcaguccggccgcaucgucguggacuauaugaugcagaagcccgggaagacgggcaccaucguguaccagcgcgggguccugcugccccagaagguguggugcgccagcggccgguccaaggugaucaagggcagccucccccugaucggggaggcggacugcauccacgagaaguacggcgggcugaacaagaguaagccguacuacaccggcgagcacgccaaggccaucgggaacugccccaucugggucaagacgccccucaagcuggccaacggcaccaaguaccggcccccggccaagcugcucaaggagcgcggcuucuucggggcgaucgccggcuuucuggagggcgggugggaggggaugaucgccggcuggcacggcuacaccucccacggggcccacggcguggccgucgcggccgaccugaaguccacccaggaggccaucaacaagaucaccaagaaccucaacucccugagugagcuggaggugaagaaccuccagcggcuguccggggccauggacgagcugcacaacgagauccucgagcuggacgagaagguggacgaccugcgcgccgacacgaucagcucccagaucgagcucgcgguccugcugaguaacgagggcaucaucaacuccgaggacgagcaccuccuggcccuggagcggaagcucaagaagaugcugggccccucggccguggacaucgggaacggcugcuucgagaccaagcauaagugcaaccagaccugccuggaccgcaucgccgcggggaccuucaacgccggcgaguucucccuccccaccuucgauagccugaacaucacggccgccucccugaacgacgacgggcucgacaaccacaccauccugcuguacuauagcaccgccgcguccagccuggccgugacccucaugcuggccaucuucaucgucuacauggugucccgggacaacgugagcugcuccaucugccuguga

SEQ ID NO: 15471 - RNA, 1755 nt, Artificial Sequence; identical to SEQ ID NO: 14166
  derived and/or modified CDS sequence (AUadapt) from InfluenzaB__AGX24139__HA

SEQ ID NO: 15472 - RNA, 1755 nt, Artificial Sequence
  derived and/or modified CDS sequence (AUadapt) from InfluenzaB__AGX24150__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuauuucgccaaccugaaggggacgcggacccgcggcaagcucugccccuacugccugaacugcaccgaccuggacguggcccucgggcggcccaugugugugggcaccacgccguccgccaaggccucgauccugcacgagguccgccccgugaccuccggcugcuuccccaucaugcacgaccggaccaagauccgccagcugcccaaccuccugcggggguacgagaacauccgccugaguacccagaacgugaucgacgcggagaaggccccgggcgggcccuaccggcucggcacguccgggagcugccccaacgccaccuccaagagcggcuucuuugccaccauggcgugggccguccccaaggacaacaacaagaacgccaccaacccgcugacgguggaggugcccuacaucugcaccgagggcgaggaccagaucaccgucuggggguuccauuccgacaacaagacccagaugaagaaccuguacggcgacucgaacccccagaaguucacguccagcgccaauggggugaccacccacuacgugucccagaucggcagcuuccccgaccagaccgaggacggcgggcucccgcaguccggccgcaucgucguggacuacaugaugcagaagcccgggaagacgggcaccaucguguaucagcgggggauccugcugccccagaaggucuggugcgccagcggccgcucgaaggugaucaagggcucccucccccugaucggggaggcggacugccugcacgagaaguacggcgggcucaacaagagcaagccguauuacaccggcgagcacgccaaggccaucgggaacugccccaucugggugaagacgccccugaagcuggccaacggcaccaaguaccggcccccggccaagcuccugaaggagcgcggcuucuucggggcgaucgccggcuuccuggagggcgggugggaggggaugaucgccggcuggcauggcuacaccucccacggggcccacggcgucgccguggcggccgaccucaagagcacccaggaggccaucaacaagaucaccaagaaccugaacucccugagugagcucgaggucaagaaccugcagcggcuguccggggccauggacgagcuccacaacgagauccuggagcuggacgagaagguggacgaccuccgcgccgacacgaucucgucccagaucgagcuggcggugcugcucaguaacgagggcaucaucaacuccgaggacgagcaccuccuggcccuggagcggaagcugaagaagaugcugggccccagcgccgucgagaucgggaacggcugcuucgagaccaagcacaaguguaaccagaccugccucgaccgcaucgccgcggggaccuucaacgccggcgaguucucccugcccaccuucgacagucugaacaucacggccgccucccucaacgacgacgggcuggacaaccacaccauccugcuguacuacaguaccgccgcguccagccucgccgugacccugaugcuggccaucuucaucguguacauggucucccgggacaacgugagcugcagcaucugccucuga

SEQ ID NO: 15473 - RNA, 1755 nt, Artificial Sequence; identical to SEQ ID NO: 14787
  derived and/or modified CDS sequence (AUadapt) from InfluenzaB__AGX24161__HA

SEQ ID NO: 15474 - RNA, 1755 nt, Artificial Sequence; identical to SEQ ID NO: 14117
  derived and/or modified CDS sequence (AUadapt) from InfluenzaB__AGX24172__HA

SEQ ID NO: 15475 - RNA, 1755 nt, Artificial Sequence; identical to SEQ ID NO: 14117
  derived and/or modified CDS sequence (AUadapt) from InfluenzaB__AGX24183__HA

SEQ ID NO: 15476 - RNA, 1755 nt, Artificial Sequence; identical to SEQ ID NO: 14117
  derived and/or modified CDS sequence (AUadapt) from InfluenzaB__AGX24194__HA

SEQ ID NO: 15477 - RNA, 1755 nt, Artificial Sequence; identical to SEQ ID NO: 14307
  derived and/or modified CDS sequence (AUadapt) from InfluenzaB__AGX24205__HA

SEQ ID NO: 15478 - RNA, 1755 nt, Artificial Sequence; identical to SEQ ID NO: 14471
  derived and/or modified CDS sequence (AUadapt) from InfluenzaB__AGX24227__HA

SEQ ID NO: 15479 - RNA, 1755 nt, Artificial Sequence; identical to SEQ ID NO: 14117
  derived and/or modified CDS sequence (AUadapt) from InfluenzaB__AGX24238__HA

SEQ ID NO: 15480 - RNA, 1755 nt, Artificial Sequence
  derived and/or modified CDS sequence (AUadapt) from InfluenzaB__AGX24249__HA
augaaggccaucaucgugcugcucauggucgugaccaguaacgccgaccgcaucugcaccggcaucacguccagcaagagcccccacguggucaagaccgcgacccagggggaggugaacgugaccggcgucaucccgcugacgaccacccccaccaaguccuacuuugccaaccugaaggggacgcggacccgcggcaagcucugccccgacugccugaacugcaccgaccuggacguggcccucgggcggcccaugugugugggcaccacgccguccgccaaggccagcauccugcacgagguccgccccgugaccuccggcugcuuccccaucaugcacgaccggaccaagauccgccagcugcccaaccuccugcggggguacgagaauauccgccugagcacccagaacgugaucgacgcggagaaggccccgggcgggcccuaccggcucggcacguccgggucgugccccaacgccaccuccaagaucggcuucuuugccaccauggcgugggccguccccaaggacaacuacaagaacgccaccaacccgcugacgguggaggugcccuacaucugcaccgagggcgaggaccagaucaccgucuggggguuucacagcgacaacaagacccagaugaagaaccuguacggcgacuccaacccccagaaguuuacgagcuccgccaacggggugaccacccacuacgugagccagaucggcgacuuccccgaccagaccgaggauggcgggcucccgcaguccggccgcaucgucguggacuacaugaugcagaagcccgggaagacgggcaccaucguguaccagcgcgggguccugcugccccagaagguguggugcgccagcggccgguccaaggugaucaagggcucgcucccccugaucggggaggcggacugccugcaugagaaguacggcgggcucaacaagagcaagccguacuacaccggcgagcacgccaaggccaucgggaacugccccaucugggucaagacgccccugaagcuggccaauggcaccaaguaccggcccccggccaagcuccugaaggagcgcggcuucuucggggcgaucgccggcuuccuggagggcgggugggaggggaugaucgccggcuggcacggcuacaccucccacggggcccacggcguggccgucgcggccgaucucaagagcacccaggaggccaucaacaagaucaccaagaaccugaacucccugagcgagcucgaggugaagaaccugcagcggcuguccggggccauggacgagcuccacaaugagauccuggagcuggacgagaagguggacgaccuccgcgccgacacgaucagcucccagaucgagcuggcgguccugcucucgaacgagggcaucaucaacuccgaggaugagcaccuccuggcccuggagcggaagcugaagaagaugcugggccccagcgccguggacaucgggaacggcugcuucgagaccaagcacaagugcaaucagaccugccucgaccgcaucgccgcggggaccuucaacgccggcgaguucucccugcccaccuucgacagccugaauaucacggccgccucccucaacgacgacgggcuggacaaccacaccauccugcuguacuacaguaccgccgcguccagccucgccgugacccugaugcuggccaucuucaucgucuacauggugucccgggacaacgugagcugcuccaucugccucuga

SEQ ID NO: 15481 - RNA, 1755 nt, Artificial Sequence; identical to SEQ ID NO: 14307
  derived and/or modified CDS sequence (AUadapt) from InfluenzaB__AGX24260__HA

SEQ ID NO: 15482 - RNA, 1755 nt, Artificial Sequence; identical to SEQ ID NO: 14796
  derived and/or modified CDS sequence (AUadapt) from InfluenzaB__AGX24271__HA

SEQ ID NO: 15483 - RNA, 1755 nt, Artificial Sequence
  derived and/or modified CDS sequence (AUadapt) from InfluenzaB__AGX24282__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacuguaccgaccuggacguggcccucgggcggcccaugugcgugggcaccacgccguccgccaaggccagcauccugcacgagguccgccccgugaccuccggcugcuuccccaucaugcaugaccggaccaagauccgccagcugcccaaccuccugcggggguacgagaacauccgccugagcacccagaacgugaucgacgcggagaaggccccgggcgggcccuaucggcucggcacguccgggucgugccccaacgccaccuccaagagcggcuucuucgccaccauggcgugggccguccccaaggacaauaacaagaacgccaccaacccgcugacgguggaggugcccuacaucugcaccaagggcgaggaccagaucaccgucuggggguuccauuccgacaacaagacccagaugaagaaccuguacggcgacagcaacccccagaaguuuacguccagcgccaacggggugaccacccacuacgugucccagaucggcagcuuccccgaccagaccgaggauggcgggcucccgcaguccggccgcaucgucguggacuacaugaugcagaagcccgggaagacgggcaccaucguguaccagcgcgggguccugcugccccagcgcguguggugcgccagcggccggucgaaggugaucaagggcucccucccccugaucggggaggcggacugucugcacgagaaguacggcgggcucaacaagagcaagccguacuacaccggcgagcacgccaaggccaucgggaauugccccaucugggucaagacgccccugaagcuggccaacggcaccaaguaccggcccccggccaagcuccugaaggagcggggcuucuucggggcgaucgccggcuuccuggagggcgggugggaggggaugaucgccggcuggcacggcuauaccucccacggggcccacggcguggccgucgcggccgaccucaagagcacccaggaggccaucaacaagaucaccaagaaccugaacucccugagugagcucgaggugaagaaccugcagcgccuguccggggccauggacgagcuccacaacgagauccuggagcuggacgagaagguggacgaccuccgggccgauacgaucagcucccagaucgagcuggcgguccugcucagcaacgagggcaucaucaacuccgaggacgagcaccuccuggcccuggagcgcaagcugaagaagaugcugggccccucggccguggagaucgggaauggcugcuucgagaccaagcacaagugcaaccagaccugccucgaccggaucgccgcggggaccuuuaacgccggcgaguucucccugcccaccuucgacagccugaacaucacggccgccucccucaacgaugacgggcuggacaaccacaccauccugcuguacuacagcaccgccgcguccagucucgccgugacccugaugcuggccaucuucaucgucuacauggugucccgcgacaacgugagcugcagcaucugccucuga

SEQ ID NO: 15484 - RNA, 1755 nt, Artificial Sequence; identical to SEQ ID NO: 14307
  derived and/or modified CDS sequence (AUadapt) from InfluenzaB__AGX24293__HA

SEQ ID NO: 15485 - RNA, 1755 nt, Artificial Sequence; identical to SEQ ID NO: 14307
  derived and/or modified CDS sequence (AUadapt) from InfluenzaB__AGX24304__HA

SEQ ID NO: 15486 - RNA, 1755 nt, Artificial Sequence; identical to SEQ ID NO: 14796
  derived and/or modified CDS sequence (AUadapt) from InfluenzaB__AGX24315__HA

SEQ ID NO: 15487 - RNA, 1755 nt, Artificial Sequence
  derived and/or modified CDS sequence (AUadapt) from InfluenzaB__AGX24326__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacugcaccgaucuggacguggcccucgggcggccgaccugcgugggcacgacccccuccgccaaggccucgauccugcacgagguccgccccgugaccuccggcugcuuccccaucaugcacgaucggaccaagauccgccagcugcccaaccuccugcggggguacgagaacauccgccugagcacgcagaacgugaucgacgcggagaaggccccgggcgggcccuaccggcucggcaccuccgggagcugucccaacgccaccuccaagagcggcuucuucgccaccauggcgugggccguccccaaggacaacaacaagaaugccacgaacccgcugaccguggaggugcccuacaucugcaccgagggcgaggaccagaucaccgucuggggguuccacuccgacaacaagacgcagaugaagaaucuguacggcgacucgaacccccagaaguucaccuccagcgccaacggggugaccacccauuacgugucccagaucggcagcuuccccgaccagacggaggacggcgggcucccgcaguccggccgcaucgucguggacuacaugaugcagaagcccgggaagaccggcaccaucguguaccagcgggggauccugcugccccagaaggucuggugugccagcggccgcucgaaggugaucaagggcucccucccccugaucggggaggcggacugccugcacgagaaguacggcgggcucaacaagaguaagccguacuacaccggcgagcacgccaaggccaucgggaacugccccaucugggugaagacgccccugaagcuggccaacggcaccaaguaccggcccccggccaagcuccugaaggagcgcggcuucuuuggggcgaucgccggcuuccuggagggcgggugggaggggaugaucgccggcuggcacggcuacaccucccacggggcccacggcgucgccguggcggccgaccucaagagcacccaggaggccaucaauaagaucacgaagaaccugaacucccugagcgagcucgaggucaagaaccugcagcggcuguccggggccauggacgagcuccacaacgagauccuggagcuggacgagaagguggaugaccuccgcgccgacaccaucucgucccagaucgagcuggcggugcugcucagcaacgagggcaucaucaacuccgaggacgagcaucuccuggcccuggagcggaagcugaagaagaugcugggccccagcgccgucgagaucgggaacggcugcuucgagaccaagcacaagugcaaccagaccugccucgaucgcaucgccgcggggaccuucaacgccggcgaguucucccugcccacguucgacagccugaacaucaccgccgccucccucaaugacgacgggcuggacaaccacaccauccugcuguacuacucgaccgccgcguccagucucgccgugacgcugaugcuggccaucuucaucguguacauggucucccgggacaacgugagcugcagcaucugccucuga

SEQ ID NO: 15488 - RNA, 1755 nt, Artificial Sequence
  derived and/or modified CDS sequence (AUadapt) from InfluenzaB__AGX24337__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuacuuugccaaccugaaggggacgcggacccgcggcaagcucugccccgacugccugaacugcaccgaccuggacguggcccucgggaugcccaugugcgugggcaccacgccguccgccaaggccaguauccugcacgagguccggcccgugaccuccggcugcuuccccaucaugcacgaccgcaccaagauccggcagcugcccaaccuccugcgcggguacgagaacauccggcugucgacccagaacgugaucgaugcggagaaggccccgggcgggcccuaccgccucggcacguccgggagcugccccaacgccaccuccaagaucggcuucuucgccaccauggcgugggccguccccaaggacaacuacaagaaugccaccaacccgcugacgguggaggugcccuacaucugcaccgagggcgaggaccagaucaccgucuggggguuccacagcgacaacaagacccagaugaagaaucuguacggcgacuccaacccccagaaguucacgagcuccgccaacggggugaccacccacuacgugucgcagaucggcgacuuucccgaccagaccgaggacggcgggcucccgcaguccggccggaucgucguggacuacaugaugcagaagcccgggaagacgggcaccaucguguaccagcgcgggguccugcugccccagaagguguggugcgccagcggccgguccaaggugaucaagggcagccucccccugaucggggaggcggacugucugcacgagaaguacggcgggcucaacaagagcaagccguacuacaccggcgagcacgccaaggccaucgggaacugccccaucugggucaagacgccccugaagcuggccaauggcaccaaguaccggcccccggccaagcuccugaaggagcgcggcuucuucggggcgaucgccggcuuccuggagggcgggugggaggggaugaucgccggcuggcacggcuacaccucccacggggcccacggcguggccgucgcggccgaccucaagucgacccaggaggccaucaauaagaucaccaagaaccugaacucccugagcgagcucgaggugaagaaccugcagcgccuguccggggccauggacgagcuccacaacgagauccuggagcuggacgagaagguggacgaucuccgggccgacacgaucagcucccagaucgagcuggcgguccugcucagcaacgagggcaucaucaacuccgaggacgagcaccuccuggcccuggagcgcaagcugaagaagaugcugggccccucggccguggacaucgggaauggcugcuucgagaccaagcacaagugcaaccagaccugccucgaccggaucgccgcggggaccuucaacgccggcgaguucucccugcccaccuuugacagccugaacaucacggccgccucccucaacgacgacgggcuggacaaccacaccauccugcuguauuacagcaccgccgcguccagccucgccgugacccugaugcuggccaucuucaucgucuacauggugucccgcgacaacgugagcugcuccaucugccucuga

SEQ ID NO: 15489 - RNA, 1755 nt, Artificial Sequence; identical to SEQ ID NO: 14117
  derived and/or modified CDS sequence (AUadapt) from InfluenzaB__AGX24348__HA

SEQ ID NO: 15490 - RNA, 1755 nt, Artificial Sequence; identical to SEQ ID NO: 14307
  derived and/or modified CDS sequence (AUadapt) from InfluenzaB__AGX24359__HA

SEQ ID NO: 15491 - RNA, 1755 nt, Artificial Sequence; identical to SEQ ID NO: 14117
  derived and/or modified CDS sequence (AUadapt) from InfluenzaB__AGX24381__HA

SEQ ID NO: 15492 - RNA, 1755 nt, Artificial Sequence
  derived and/or modified CDS sequence (AUadapt) from InfluenzaB__AGX24392__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuauuucgccaaccugaaggggacgcggacccgcggcaagcucugccccgacugccugaacugcaccgaccuggauguggcccucgggcggcccaugugcgugggcaccacgccguccgccaaggccucgauccugcacgagguccgccccgugaccuccggcugcuuccccaucaugcacgaccggaccaagauccgccagcugcccaaccuccugcggggguaugagaacauccgccugagcacccagaacgugaucgacgcggagaaggccccgggcgggcccuaccggcucggcacguccgggagcugccccaacgccaccuccaagaguggcuucuucgccaccauggcgugggccguccccaaggacaacaacaagaacgccaccaacccgcugacgguggagauccccuacaucuguaccgagggcgaggaccagaucaccguguggggguuccacuccgacaacaagacccagaugaagaaccuguacggcgacaguaacccccagaaguucacguccagcgccaacggggucaccacccacuacgugucccagaucggcagcuuccccgaucagaccgaggacggcgggcucccgcaguccggccgcaucguggucgacuacaugaugcagaagcccgggaagacgggcaccaucguguaccagcgcggggugcugcugccccagaaggucuggugcgccagcggccggucgaaggugaucaagggcucccucccccugaucggggaggcggacugucugcacgagaaguacggcgggcucaacaagagcaagccguacuacaccggcgagcacgccaaggccaucgggaacugucccaucugggugaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccucccacggggcccauggcgucgccguggcggccgaccucaagagcacccaggaggccaucaacaagaucaccaagaaccugaacucccugagcgagcucgaggucaagaaccugcagcggcuguccggggccauggacgagcuccauaacgagauccuggagcuggacgagaagguggacgaccuccgcgccgacacgaucucgucccagaucgagcuggcggugcugcucagcaacgagggcaucaucaauuccgaggacgagcaccuccuggcccuggagcggaagcugaagaagaugcugggccccagcgccgucgagaucgggaacggcugcuucgagaccaagcacaagugcaaucagaccugccucgaccgcaucgccgcggggaccuucaacgccggcgaguucucccugcccaccuucgacagccugaauaucacggccgccucccucaacgacgacgggcuggacaaccacaccauccugcuguacuacaguaccgccgcguccagccucgccgugacccugaugcuggccaucuucaucguguacauggucucccgggacaacgugagcugcagcaucugccucuga

SEQ ID NO: 15493 - RNA, 1755 nt, Artificial Sequence; identical to SEQ ID NO: 14307
  derived and/or modified CDS sequence (AUadapt) from InfluenzaB__AGX24403__HA

SEQ ID NO: 15494 - RNA, 1755 nt, Artificial Sequence; identical to SEQ ID NO: 14117
  derived and/or modified CDS sequence (AUadapt) from InfluenzaB__AGX24414__HA

SEQ ID NO: 15495 - RNA, 1755 nt, Artificial Sequence; identical to SEQ ID NO: 14307
  derived and/or modified CDS sequence (AUadapt) from InfluenzaB__AGX24425__HA

SEQ ID NO: 15496 - RNA, 1755 nt, Artificial Sequence; identical to SEQ ID NO: 14307
  derived and/or modified CDS sequence (AUadapt) from InfluenzaB__AGX24436__HA

SEQ ID NO: 15497 - RNA, 1755 nt, Artificial Sequence; identical to SEQ ID NO: 14796
  derived and/or modified CDS sequence (AUadapt) from InfluenzaB__AGX24447__HA

SEQ ID NO: 15498 - RNA, 1755 nt, Artificial Sequence; identical to SEQ ID NO: 15487
  derived and/or modified CDS sequence (AUadapt) from InfluenzaB__AGX24458__HA

SEQ ID NO: 15499 - RNA, 1755 nt, Artificial Sequence
  derived and/or modified CDS sequence (AUadapt) from InfluenzaB__AGX24469__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacuguaccgaccuggacguggcccucgggcggccgaccugcgugggcacgacccccuccgccaaggccagcauccugcacgagguccgccccgugaccuccggcugcuuccccaucaugcaugaccggaccaagauccgccagcugcccaaccuccugcggggguacgagaacauccgccugucgacgcagaacgugaucgacgcggagaaggccccgggcgggcccuaucggcucggcaccuccgggagcugccccaacgccaccuccaagagcggcuucuucgccaccauggcgugggccguccccaaggacaauaacaagaacgccacgaacccgcugaccguggaggugcccuacaucugcaccgagggcgaggaccagaucaccgucuggggguuccauuccgacaacaagacgcagaugaagaaccuguacggcgacagcaacccccagaaguuuaccuccagcgccaacggggugaccacccacuacgugucccagaucggcucguuccccgaccagacggaggauggcgggcucccgcaguccggccgcaucgucguggacuacaugaugcagaagcccgggaagaccggcaccaucguguaccagcgggggauccugcugccccagaaggucuggugcgccagcggccgcagcaaggugaucaagggcucccucccccugaucggggaggcggacugucugcacgagaaguacggcgggcucaacaagagcaagccguacuacaccggcgagcacgccaaggccaucgggaauugccccaucugggugaagacgccccugaagcuggccaacggcaccaaguaccggcccccggccaagcuccugaaggagcgcggcuucuucggggcgaucgccggcuuccuggagggcgggugggaggggauggucgccggcuggcacggcuauaccucccacggggcccacggcguggccgucgcggccgaccucaagucgacccaggaggccaucaacaagaucacgaagaaccugaacucccugagugagcucgaggugaagaaccugcagcggcuguccggggccauggacgagcuccacaacgagauccuggagcuggacgagaagguggacgaccuccgcgccgauaccaucagcucccagaucgagcuggcgguccugcucagcaacgagggcaucaucaacuccgaggacgagcaccuccuggcccuggagcggaagcugaagaagaugcugggccccagcgccguggagaucgggaauggcugcuucgagaccaagcacaagugcaaccagaccugccucgaccgcaucgccgcggggaccuuuaacgccggcgaguucucccugcccacguucgacucgcugaacaucaccgccgccucccucaacgaugacgggcuggacaaccacaccauccugcuguacuacagcaccgccgcguccagucucgccgugacgcugaugcuggccaucuucaucgucuacauggugucccgggacaacgugagcugcagcaucugccucuga

SEQ ID NO: 15500 - RNA, 1755 nt, Artificial Sequence; identical to SEQ ID NO: 14796
  derived and/or modified CDS sequence (AUadapt) from InfluenzaB__AGX24480__HA

SEQ ID NO: 15501 - RNA, 1755 nt, Artificial Sequence; identical to SEQ ID NO: 14796
  derived and/or modified CDS sequence (AUadapt) from InfluenzaB__AGX24491__HA

SEQ ID NO: 15502 - RNA, 1755 nt, Artificial Sequence
  derived and/or modified CDS sequence (AUadapt) from InfluenzaB__AGX24502__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacuguaccgaccuggacguggcccucgggcggcccaugugcgugggcaccacgccguccgccaaggccagcauccugcacgagguccgccccgugaccuccggcugcuuccccaucaugcaugaccggaccaagauccgccagcugcccaaccuccugcggggguacgagaacauccgccugagcacccagaacgugaucgacgcggagaaggccccgggcgggcccuaucggcucggcacguccgggucgugccccaacgccaccuccaagagcggcuucuucgccaccauggcgugggccguccagaaggacaauaacaagaacgccaccaacccccugacgguggaggugccguacaucugcaccgagggcgaggaccagaucaccgucuggggguuccauuccgacaacaagacccagaugaagaaccuguacggcgacagcaacccccagaaguuuacguccagcgccaacggggugaccacccacuacgugucccagaucggcagcuuccccgaccagaccgaggauggcgggcucccccaguccggccgcaucgucguggacuacaugaugcagaagccggggaagacgggcaccaucguguaccagcgcgggguccugcugccccagcggguguggugcgccagcggccggucgaaggugaucaagggcucccucccccugaucggggaggcggacugucugcacgagaaguacggcgggcucaacaagagcaagcccuacuacaccggcgagcacgccaaggccaucgggaauugcccgaucugggucaagacgccccugaagcuggccaacggcaccaaguaccgcccgcccgccaagcuccugaaggagcggggcuucuucggggcgaucgccggcuuccuggagggcgggugggaggggaugaucgccggcuggcacggcuauaccucccacggggcccacggcguggccgucgcggccgaccucaagagcacccaggaggccaucaacaagaucaccaagaaccugaacucccugagugagcucgaggugaagaaccugcagcgccuguccggggccauggacgagcuccacaacgagauccuggagcuggacgagaagguggacgaccuccgggccgauacgaucagcucccagaucgagcuggcgguccugcucagcaacgagggcaucaucaacuccgaggacgagcaccuccuggcccuggagcgcaagcugaagaagaugcugggccccucggccguggagaucgggaauggcugcuucgagaccaagcacaagugcaaccagaccugccucgaccggaucgccgcggggaccuuuaacgccggcgaguucucccugcccaccuucgacagccugaacaucacggccgccucccucaacgaugacgggcuggacaaccacaccauccugcuguacuacagcaccgccgcguccagucucgccgugacccugaugcuggccaucuucaucgucuacauggugucccgcgacaacgugagcugcagcaucugccucuga

SEQ ID NO: 15503 - RNA, 1755 nt, Artificial Sequence; identical to SEQ ID NO: 14471
  derived and/or modified CDS sequence (AUadapt) from InfluenzaB__AGX24513__HA

SEQ ID NO: 15504 - RNA, 1755 nt, Artificial Sequence; identical to SEQ ID NO: 14796
  derived and/or modified CDS sequence (AUadapt) from InfluenzaB__AGX24524__HA

SEQ ID NO: 15505 - RNA, 1755 nt, Artificial Sequence
  derived and/or modified CDS sequence (AUadapt) from InfluenzaB__AGX24535__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacugcaccgaucuggacguggcccucgggcggcccaugugcgugggcaccacgccguccgccaaggccagcauccugcacgagguccgccccgugaccuccggcugcuuccccaucaugcacgaucggaccaagauccgccagcugcccaaccuccugcggggguacgagaacauccgccugagcacccagaacgugaucgacgcggagaaggccccgggcgggcccuaccggcucggcacguccgggucgugucccaacgccaccuccaagaucggcuucuucgccaccauggcgugggccguccccaaggacaacuacaagaacgccaccaauccgcugacgguggaggugcccuacaucugcaccgagggcgaggaccagaucaccgucuggggguuccacagcgacaacaagacccagaugaagaaucuguacggcgacuccaacccccagaaguucacgagcuccgccaacggggugaccacccacuaugugagccagaucggcgacuuccccgaccagaccgaggacggcgggcucccgcaguccggccgcaucgucguggacuacaugaugcagaagcccgggaagacgggcaccaucguguaccagcgcgggguccugcugccccagaagguguggugugccagcggccgguccaaggugaucaagggcucgcucccccugaucggggaggcggacugccugcacgagaaguacggcgggcucaacaagaguaagccguacuacaccggcgagcacgccaaggccaucgggaacugccccaucugggucaagacgccccugaagcuggccaacggcaccaaguaccggcccccggccaagcuccugaaggagcgcggcuucuuuggggcgaucgccggcuuccuggagggcgggugggaggggaugaucgccggcuggcacggcuacaccucccacggggcccacggcguggccgucgcggccgaccucaagagcacccaggaggccaucaauaagaucaccaagaaccugaacucccugagcgagcucgaggugaagaaccugcagcggcuguccggggccauggacgagcuccacaacgagauccuggagcuggacgagaagguggaugaccuccgcgccgacacgaucagcgcgcagaucgagcuggccguccugcucuccaacgagggcaucaucaacucggaggacgagcaucuccuggcccuggagcggaagcugaagaagaugcugggccccuccgccguggacaucgggaacggcugcuucgagaccaagcacaagugcaaccagaccugccucgaucgcaucgcggccgggaccuucaacgccggcgaguucagccugcccaccuucgacucccugaacaucacggccgccagucucaacgacgacgggcuggacaaccacaccauccugcuguacuacuccaccgcggccaguucccucgccgugacccugaugcuggccaucuucaucgucuacauggugagccgggacaacguguccugcagcaucugccucuga

SEQ ID NO: 15506 - RNA, 1755 nt, Artificial Sequence; identical to SEQ ID NO: 14307
  derived and/or modified CDS sequence (AUadapt) from InfluenzaB__AGX24546__HA

SEQ ID NO: 15507 - RNA, 1755 nt, Artificial Sequence
  derived and/or modified CDS sequence (AUadapt) from InfluenzaB__AGX24557__HA
augaagaccaucaucgugcugcucauggucgugaccaguaacgccgaccgcaucugcacgggcaucaccuccagcaacagcccccacguggucaagaccgccacccagggggaggugaacgugacgggcgucaucccgcugaccaccacccccaccaaguccuauuucgcgaaccugaaggggacccggacccgcggcaagcucugccccgacugccugaacugcaccgaccuggauguggcccucgggcggcccacgugcgugggcaccaccccguccgccaaggccucgauccugcacgagguccgccccgugaccuccggcugcuuccccaucaugcacgaccggacgaagauccgccagcugcccaaccuccugcggggguaugagaacauccgccugagcacccagaacgugaucgacgccgagaaggcgccgggcgggcccuaccggcucggcaccuccgggagcugccccaacgccaccuccaagaguggcuucuucgccacgauggccugggcgguccccaaggacaacaacaagaacgccaccaacccgcugaccguggaggugcccuacaucuguaccgagggcgaggaccagaucacggucuggggguuccacuccgacaacaagacccagaugaagaaccuguacggcgacaguaacccccagaaguucaccuccagcgccaacggggugaccacgcacuacgugucccagaucggcucguuccccgaucagaccgaggacggcgggcucccgcaguccggccgcaucgucguggacuacaugaugcagaagcccgggaagaccggcaccaucguguaccagcgggggauccugcugccccagaaggucuggugcgccagcggccgcagcaaggugaucaagggcucccucccccugaucggggaggccgacugucugcacgagaaguacggcgggcucaacaagagcaagccguacuacacgggcgagcacgcgaaggccaucgggaacugucccaucugggugaagacgccccugaagcuggccaacggcaccaaguaccggcccccggccaagcuccugaaggagcgcggcuucuucggggccaucgcgggcuuccuggagggcgggugggaggggaugaucgccggcuggcacggcuacaccucccacggggcccauggcgucgccguggccgcggaccucaagucgacgcaggaggccaucaacaagaucaccaagaaccugaacucccugagcgagcucgaggucaagaaccugcagcggcuguccggggccauggacgagcuccauaacgagauccuggagcuggacgagaagguggacgaccuccgcgccgacaccaucagcucccagaucgagcuggccgugcugcucucgaacgagggcaucaucaauuccgaggacgagcaccuccuggcgcuggagcggaagcugaagaagaugcugggccccagcgccgucgagaucgggaacggcugcuucgagaccaagcacaagugcaaucagaccugccucgaccgcaucgccgccgggacguucaacgcgggcgaguucucccugcccaccuucgacagccugaauaucaccgccgccucccucaacgacgacgggcuggacaaccacaccauccugcuguacuacaguacggccgccuccagccucgcggugacccugaugcuggccaucuucaucguguacauggucucccgggacaacgugagcugcagcaucugccucuga

SEQ ID NO: 15508 - RNA, 1755 nt, Artificial Sequence; identical to SEQ ID NO: 14796
  derived and/or modified CDS sequence (AUadapt) from InfluenzaB__AGX24579__HA

SEQ ID NO: 15509 - RNA, 1755 nt, Artificial Sequence; identical to SEQ ID NO: 14796
  derived and/or modified CDS sequence (AUadapt) from InfluenzaB__AGX24590__HA

SEQ ID NO: 15510 - RNA, 1755 nt, Artificial Sequence; identical to SEQ ID NO: 14796
  derived and/or modified CDS sequence (AUadapt) from InfluenzaB__AGX24601__HA

SEQ ID NO: 15511 - RNA, 1755 nt, Artificial Sequence; identical to SEQ ID NO: 14796
  derived and/or modified CDS sequence (AUadapt) from InfluenzaB__AGX24612__HA

SEQ ID NO: 15512 - RNA, 1755 nt, Artificial Sequence; identical to SEQ ID NO: 14307
  derived and/or modified CDS sequence (AUadapt) from InfluenzaB__AGX24623__HA

SEQ ID NO: 15513 - RNA, 1755 nt, Artificial Sequence; identical to SEQ ID NO: 14796
  derived and/or modified CDS sequence (AUadapt) from InfluenzaB__AGX24634__HA

SEQ ID NO: 15514 - RNA, 1755 nt, Artificial Sequence; identical to SEQ ID NO: 15505
  derived and/or modified CDS sequence (AUadapt) from InfluenzaB__AGX24656__HA

SEQ ID NO: 15515 - RNA, 1755 nt, Artificial Sequence; identical to SEQ ID NO: 14307
  derived and/or modified CDS sequence (AUadapt) from InfluenzaB__AGX24667__HA

SEQ ID NO: 15516 - RNA, 1755 nt, Artificial Sequence; identical to SEQ ID NO: 14117
  derived and/or modified CDS sequence (AUadapt) from InfluenzaB__AGX24678__HA

SEQ ID NO: 15517 - RNA, 1755 nt, Artificial Sequence; identical to SEQ ID NO: 14796
  derived and/or modified CDS sequence (AUadapt) from InfluenzaB__AGX24689__HA

SEQ ID NO: 15518 - RNA, 1755 nt, Artificial Sequence; identical to SEQ ID NO: 14796
  derived and/or modified CDS sequence (AUadapt) from InfluenzaB__AGX24700__HA

SEQ ID NO: 15519 - RNA, 1755 nt, Artificial Sequence; identical to SEQ ID NO: 14796
  derived and/or modified CDS sequence (AUadapt) from InfluenzaB__AGX24711__HA

SEQ ID NO: 15520 - RNA, 1755 nt, Artificial Sequence; identical to SEQ ID NO: 14307
  derived and/or modified CDS sequence (AUadapt) from InfluenzaB__AGX24722__HA

SEQ ID NO: 15521 - RNA, 1755 nt, Artificial Sequence; identical to SEQ ID NO: 14307
  derived and/or modified CDS sequence (AUadapt) from InfluenzaB__AGX24733__HA

SEQ ID NO: 15522 - RNA, 1755 nt, Artificial Sequence; identical to SEQ ID NO: 14307
  derived and/or modified CDS sequence (AUadapt) from InfluenzaB__AGX24744__HA

SEQ ID NO: 15523 - RNA, 1755 nt, Artificial Sequence; identical to SEQ ID NO: 14307
  derived and/or modified CDS sequence (AUadapt) from InfluenzaB__AGX24755__HA

SEQ ID NO: 15524 - RNA, 1755 nt, Artificial Sequence; identical to SEQ ID NO: 14796
  derived and/or modified CDS sequence (AUadapt) from InfluenzaB__AGX24766__HA

SEQ ID NO: 15525 - RNA, 1755 nt, Artificial Sequence; identical to SEQ ID NO: 14307
  derived and/or modified CDS sequence (AUadapt) from InfluenzaB__AGX24777__HA

SEQ ID NO: 15526 - RNA, 1755 nt, Artificial Sequence; identical to SEQ ID NO: 14307
  derived and/or modified CDS sequence (AUadapt) from InfluenzaB__AGX24788__HA

SEQ ID NO: 15527 - RNA, 1755 nt, Artificial Sequence; identical to SEQ ID NO: 14307
  derived and/or modified CDS sequence (AUadapt) from InfluenzaB__AGX24799__HA

SEQ ID NO: 15528 - RNA, 1755 nt, Artificial Sequence; identical to SEQ ID NO: 14796
  derived and/or modified CDS sequence (AUadapt) from InfluenzaB__AGX24810__HA

SEQ ID NO: 15529 - RNA, 1755 nt, Artificial Sequence; identical to SEQ ID NO: 14796
  derived and/or modified CDS sequence (AUadapt) from InfluenzaB__AGX24821__HA

SEQ ID NO: 15530 - RNA, 1755 nt, Artificial Sequence
  derived and/or modified CDS sequence (AUadapt) from InfluenzaB__AGX24832__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacuguaccgaccuggacguggcccucgggcggcccaugugcgugggcaccacgccguccgccaaggccagcauccugcacgagguccgccccgugaccuccggcugcuuccccaucaugcaugaccggaccaagauccgccagcugcccaaccuccugcggggguacgagaacauccgccugagcacccagaacgugaucgacgcggagaaggccccgggcgggcccuaucggcucggcacguccgggucgugccccaacgccaccuccaagagcggcuucuucgccaccauggcgugggccguccccaaggacaauaacaagaacgccaccaacccgcugacgguggaggugcccuacaucugcaccgagggcgaggaccagaucaccgucuggggguuccauuccgacaacaagacccagaugaagaaccuguacggcgacagcaacccccagaaguuuacguccagcgccaacggggugaccacccacuacgugucccagaucggcagcuuccccgaccagaccgaggauggcgggcucccgcaguccggccgcaucgucguggacuacaugaugcagaagcccgggaagacgggcaccaucguguaccagcgggggauccugcugccccagcgcgucuggugcgccagcggccggucgaaggugaucaagggcucccucccccugaucggggaggcggacugucugcacgagaaguacggcgggcucaacaagagcaagccguacuacaccggcgagcacgccaaggccaucgggaauugccccaucugggugaagacgccccugaagcuggccaacggcaccaaguaccggcccccggccaagcuccugaaggagcgcggcuucuucggggcgaucgccggcuuccuggagggcgggugggaggggaugaucgccggcuggcacggcuauaccucccacggggcccacggcgucgccguggcggccgaccucaagagcacccaggaggccaucaacaagaucaccaagaaccugaacucccugagugagcucgaggucaagaaccugcagcgccuguccggggccauggacgagcuccacaacgagauccuggagcuggacgagaagguggacgaccuccgggccgauacgaucagcucccagaucgagcuggcggugcugcucagcaacgagggcaucaucaacuccgaggacgagcaccuccuggcccuggagcgcaagcugaagaagaugcugggccccucggccgucgagaucgggaauggcugcuucgagaccaagcacaagugcaaccagaccugccucgaccggaucgccgcggggaccuuuaacgccggcgaguucucccugcccaccuucgacagccugaacaucacggccgccucccucaacgaugacgggcuggacaaccacaccauccugcuguacuacagcaccgccgcguccagucucgccgugacccugaugcuggccaucuucaucguguacauggucucccgcgacaacgugagcugcagcaucugccucuga

SEQ ID NO: 15531 - RNA, 1755 nt, Artificial Sequence
  derived and/or modified CDS sequence (AUadapt) from InfluenzaB__AGX24843__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacuguaccgaccuggacguggcccucgggcggcccaugugcgugggcaccacgccguccgccaaggccagcauccugcacgagguccgccccgugaccuccggcugcuuccccaucaugcaugaccggaccaagauccgccagcugcccaaccuccugcggggguacgagaacauccgccugagcacccagaacgugaucgacgcggagaaggccccgggcgggcccuaucggcucggcacguccgggagcugccccaacgccaccuccaagaucggcuucuucgccaccauggcgugggccguccccaaggacaacuauaagaacgccaccaacccgcugacgguggaggugcccuacaucugcaccgagggcgaggaccagaucaccgucuggggguuccacagugacaacaagacccagaugaagaaccuguacggcgacuccaacccccagaaguucacgaguuccgccaacggggugaccacccacuacgugagccagaucggcgacuuccccgaccagaccgaggauggcgggcucccgcaguccggccgcaucgucguggacuacauggugcagaagcccgggaagacgggcaccaucgucuaccagcgcggggugcugcugccccagcgcguguggugcaccagcggccgguccaaggucaucaagggcucgcucccccugaucggggaggccgacugucugcacgagaaguacggcgggcucaacaagagcaagccguacuacaccggcgagcacgcgaaggccaucgggaauugccccaucugggugaagacgccccugaagcuggccaacggcaccaaguaccggcccccggccaagcuccugaaggagcggggcuucuucggggccaucgcgggcuuccuggagggcgggugggaggggaugaucgccggcuggcacggcuauaccucccacggggcccacggcgucgccguggccgcggaccucaagagcacccaggaggccaucaacaagaucacgaagaaccugaacucccugagugagcucgaggugaagaaccugcagcgccuguccggggccauggacgagcuccacaacgagauccuggagcuggacgagaaggucgacgaccuccgggccgauaccaucagcucccagaucgagcuggccgugcugcucagcaacgagggcaucaucaacuccgaggacgagcaccuccuggcgcuggagcgcaagcugaagaagaugcugggccccagcgccguggauaucgggaacggcugcuucgagaccaagcacaagugcaaccagaccugccucgaucggaucgccgccgggaccuucaacgcgggcgaguucucccugcccacguucgacagccugaacaucaccgccgccucccucaaugacgacgggcuggacaaccacaccauccugcuguacuacaguaccgccgccuccagccucgcggucacgcugaugcuggccaucuucaucguguacauggugucccgcgacaacgucagcugcuccaucugccucuga

SEQ ID NO: 15532 - RNA, 1755 nt, Artificial Sequence
  derived and/or modified CDS sequence (AUadapt) from InfluenzaB__AGX24854__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaaguccuacuucgccaaccugaaggggacgcggacccgcggcaagcucugccccgagugccugaauugcaccgaccuggacguggcccucgggcggcccaugugcgugggcaccacgccguccgccaaggccagcauccugcacgagguccgccccgugaccuccggcuguuuccccaucaugcacgaccggaccaagauccgccagcugcccaaccuccugcggggguacgagaacauccgccugaguacccagaacgugaucgacgcggagaaggccccgggcgggcccuaccggcucggcacguccgggagcugccccaacgccaccuccaagaucggcuucuuugccaccauggcgugggccguccccaaggacaacuacaagaacgccaccaacccgcugacgguggaggugcccuacaucugugccgagggcgaggaccagaucaccgucuggggguuccacagcgacaacaagacccagaugaagaaucuguacggcgacuccaacccccagaaguucaccagcuccgccaacggggugacgacccauuacgugagccagaucggcgacuuccccgaccagaccgaggacggcgggcucccgcaguccggccgcaucgucguggauuacauggugcagcggcccgggaagaccggcacgaucgucuaccagcgcggggugcugcugccccagaagguguggugcgcgagcggccgguccaaggucaucaagggcagccucccccugaucggggaggccgacugccugcaugagaaguacggcgggcucaacaagagcaagccguacuacaccggcgagcacgccaaggccaucgggaauugccccaucugggugaagacgccccugaagcuggccaacggcaccaaguaccggcccccggcgaagcuccugaaggagcgcggcuucuucggggccaucgccggcuuccuggagggcgggugggaggggaugaucgccggcuggcauggcuacaccucccacggggcccacggcgucgcgguggccgccgaccucaagagcacccaggaggccaucaacaagaucaccaagaaucugaacucccugagcgagcucgaggugaagaaccugcagcgccuguccggggccauggacgagcuccacaacgagauccuggagcuggaugagaaggucgacgaccuccgggcggacaccaucagcucccagaucgagcuggccgugcugcucagcaacgagggcaucaucaacuccgaggaugagcaccuccuggcccuggagcgcaagcugaagaagaugcugggccccagcgccguggacaucgggaacggcugcuucgagacgaagcauaagugcaaccagaccugccucgaccggaucgcggccgggaccuucaacgccggcgaguuuucccugcccaccuucgacagccugaacaucaccgccgccucccucaacgacgaugggcuggacaaccacacgauccugcuguacuacagcaccgcggccuccagucucgccgucacccugaugcuggccaucuucaucguguacauggugucccgcgacaacgucagcugcuccaucugccucuga

SEQ ID NO: 15533 - RNA, 1755 nt, Artificial Sequence
  derived and/or modified CDS sequence (AUadapt) from InfluenzaB__AGX24865__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaaguccuacuucgccaaccugaaggggacgcggacccgcggcaagcucugccccgacugucugaacugcaccgaccuggacguggcccucgggcggcccaugugcgugggcaccacgccguccgccaaggccagcauccugcaugagguccgccccgugaccuccggcugcuuccccaucaugcacgaccggaccaagauccgccagcugcccaaccuccugcggggguacgagaacauccgccugaguacccagaacgugaucgacgcggagaaggccccgggcgggcccuaccggcucggcacguccgggagcugccccaacgccaccuccaagaucggcuuuuucgccaccauggcgugggccguccccaaggacaacuacaagaacgccaccaacccgcugacgguggaggugcccuauaucugcgccgagggcgaggaccagaucaccgucuggggguuccacagcgacaauaagacccagaugaagaaccuguacggcgacuccaacccccagaaguucaccagcuccgccaacggggugacgacccauuacgugagccagaucggcgacuuccccgaccagaccgaggacggcgggcucccgcaguccggccgcaucgucguggauuacauggugcagcggcccgggaagaccggcacgaucgucuaccagcgcggggugcugcugccccagaagguguggugcgcgagcggccgguccaaggucaucaagggcagccucccccugaucggggaggccgacugucugcacgagaaguacggcgggcucaacaagagcaagccguacuacaccggcgagcaugccaaggccaucgggaacugccccaucugggugaagacgccccugaagcuggccaacggcaccaaguaccggcccccggcgaagcuccugaaggagcgcggcuucuucggggccaucgccggcuuccuggagggcgggugggaggggaugaucgccggcuggcauggcuacaccucccacggggcccacggcgucgcgguggccgccgaccucaagagcacccaggaggccaucaacaagaucaccaagaaucugaacucccugagcgagcucgaggugaagaaccugcagcgccuguccggggccauggacgagcuccacaacgagauccuggagcuggaugagaaggucgacgaccuccgggcggacaccaucagcucccagaucgagcuggccgugcugcucagcaacgagggcaucaucaauuccgaggacgagcaccuccuggcccuggagcgcaagcugaagaagaugcugggccccagcgccguggacaucgggaacggcugcuucgagacgaagcauaagugcaaccagaccugccucgaccggaucgcggccgggaccuucaacgccggcgaguuuucccugcccaccuucgacagccugaacaucaccgccgccucccucaacgacgaugggcuggacaaccacacgauccugcuguacuacagcaccgcggccuccagucucgccgucacccugaugcuggccaucuucaucguguacauggugucccgcgacaacgucagcugcuccaucugccucuga

SEQ ID NO: 15534 - RNA, 1755 nt, Artificial Sequence
  derived and/or modified CDS sequence (AUadapt) from InfluenzaB__AGX24876__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacuguaccgaccuggacguggcccucgggcggcccaugugcgugggcaccacgccguccgccaaggccagcauccugcacgagguccgccccgugaccuccggcugcuuccccaucaugcaugaccggaccaagauccgccagcugcccaaccuccugcggggguacgagaacauccgccugagcacccagaacgugaucgacgcggagaaggccccgggcgggcccuaucggcucggcacguccgggagcugccccaacgccaccuccaagaucggcuucuucgccaccauggcgugggccguccccaaggacaacuauaagaacgccaccaacagccugacgguggaggugccguacaucugcaaggagggcgaggaccagaucaccgucuggggguuccauuccgacaacaagccccagaugaagaaccuguacggcgacagcaacccccagaaguuuaccuccagcgccaacggggugaccacgcacuacgugucccaggucggcgacuuccccgaccagaccgaggauggcgggcucccgcagagcggccgcaucgugguggacuacaugaugcagaagcccgggcggaccggcaccaucgucuaccagcgcggggugcugcugccccagaagguguggugcgccuccggccggagcaaggucaucaagggcucgcucccccugaucggggaggcggacugucugcacgagaaguacggcgggcucaacaaguccaagccguacuacacgggcgagcacgccaaggccaucgggaacugucccaucugggugaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccagucacggggcccacggcgucgccguggcggccgaccucaaguccacccaggaggccaucaacaagaucaccaagaaccugaacagccuguccgagcucgaggugaagaaucugcagcgccugagcggggccauggacgagcuccacaacgagauccuggagcuggacgagaaggucgacgaccuccgggccgauaccaucuccagccagaucgagcuggcggugcugcucuccaacgagggcaucaucaacagcgaggacgagcaccuccuggcccuggagcgcaagcugaagaagaugcugggccccuccgccguggacaucgggaauggcugcuucgagaccaagcacaagugcaaccagacgugccucgaccggaucgccgcggggaccuuuaacgccggcgaguucagccugcccaccuucgacucccugaacaucaccgccgccagccucaaugacgacgggcuggacaaccacaccauccugcuguacuacuccacggccgcgaguucccucgccgucacccugaugcuggccaucuucaucguguacauggugagccgcgacaacgucuccugcagcaucugccucuga

SEQ ID NO: 15535 - RNA, 1755 nt, Artificial Sequence
  derived and/or modified CDS sequence (AUadapt) from InfluenzaB__AGX24887__HA
augaaggccaucaucgugcugcucauggucgugaccaguaacgccgaccgcaucugcaccggcaucacguccagcaacagcccccacguggucaagaccgcgacccagggggaggugaaugugaccggcgccaucccgcugacgaccacccccaccaagagcuacuucgccaaccugaaggggacgcggacccgcggcaagcucugccccgacugccugaauugcaccgaccuggacgucgcccucgggcggcccaugugcgugggcaccacgccguccgccaaggcgagcauccugcacgaggugcgccccgucaccuccggcugcuuucccaucaugcacgaccggaccaagauccgccagcugcccaaccuccugcggggguacgagaacauccgccugucgacccagaacgugaucgaugccgagaaggccccgggcgggcccuaccggcucggcacguccgggagcugccccaacgccaccuccaagaucggcuucuucgcgaccauggccugggccgugcccaaggacaauuacaagaacgccaccaacccgcagacggucgaggugcccuacaucugcaccgagggcgaggaccagaucaccguguggggguuccauagcgacaacaagacccagaugaagaaccuguacggcgacuccaacccccagaaguuuacgagcuccgccaacggggucaccacccacuacgugagccagaucggcgacuuccccgaucagaccgaggacggcgggcugccgcaguccggccgcaucguggucgacuacauggugcagaagcccgggaagacgggcaccaucguguaccagcgcgggguccuccugccccagaagguguggugcgcgucgggccgguccaaggugaucaagggcagccugccccucaucggggaggccgauugccugcacgagaaguacggcgggcugaacaagagcaagccguacuacaccggcgagcaugccaaggccaucgggaacugccccaucugggucaagacgccccucaagcuggccaacggcaccaaguaccggcccccggcgaagcugcucaaggagcgcggcuucuucggggccaucgccggcuuccuggagggcgggugggaggggaugaucgccggcuggcauggcuacaccucccacggggcccacggcguggcggucgccgccgaccugaaguccacccaggaggccaucaacaagaucaccaagaaccucaacucccugagugagcuggaggugaagaaccuccagcggcuguccggggccauggacgagcugcacaacgagauccucgagcuggacgagaagguggacgaccugcgcgcggauacgaugagcucccagaucgagcucgccguccugcugucgaacgagggcaucaucaacuccgaggacgagcaccuccuggcccuggagcggaagcucaagaagaugcugggccccagcgccguggauaucgggaacggcugcuucgagaccaagcacaagugcaaccagaccugccuggaucgcaucgcggccgggaccuucaacgccggcgaguucucccuccccaccuucgacagccugaacaucacggccgccucccugaaugacgacgggcucgacaaccacaccauccugcuguacuacaguaccgcggccuccagccuggccgugacccucaugcuggccaucuucaucgucuacauggugucccgggacaacgugagcugcuccaucugccuguga

SEQ ID NO: 15536 - RNA, 1755 nt, Artificial Sequence
  derived and/or modified CDS sequence (AUadapt) from InfluenzaB__AGX24898__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacuguaccgaccuggacguggcccucgggcggcccaugugcgugggcaccacgccguccgccaaggccagcauccugcacgagguccgccccgugaccuccggcugcuuccccaucaugcaugaccggaccaagauccgccagcugcccaaccuccugcggggguacgagaagauccgccugagcacccagaacgugaucgacgcggagaaggccccgggcgggcccuaccggcucggcacguccgggaguugccccaacgccaccuccaagaucggcuucuucgccaccauggcgugggccguccccaaggacaacuacaagaaugccaccaacccgcugacgguggaggugcccuacaucugcaccggcggggaggaccagaucaccgucuggggcuuccacagcgauaacaagacccagaugaagucccuguacggggacagcaacccccagaaguucacguccagcgccaauggcgugaccacccacuacgugucccagaucggcgacuuccccgaccagaccgaggacgggggccucccgcagagcgggcgcaucgucguggauuacaugaugcagaagcccggcaagacggggaccaucguguaccagcggggcguccugcugccccagaagguguggugcgccuccggccgcagcaaggugaucaaggggucgcucccccugaucggcgaggcggacugccugcaugagaaguacgggggccucaacaaguccaagccguacuacaccggggagcacgccaaggccaucggcaacugccccaucugggucaagacgccccugaagcuggccaauggcaccaaguaccggcccccggccaagcuccugaaggagcgcggguucuucggcgcgaucgccggguuccuggagggcgggugggagggcaugaucgccggcuggcacggguacaccagccauggcgcccacgggguggccgucgcggccgaccucaaguccacccaggaggccaucaacaagaucaccaagaaccugaacagccuguccgagcucgaggugaagaaccugcagcggcugaguggcgccauggacgagcuccacaacgagauccuggagcuggacgagaagguggacgaccuccgcgccgacacgaucuccagucagaucgagcuggcgguccugcucuccaacgagggcaucaucaacagcgaggacgagcaccuccuggcccuggagcggaagcugaagaagaugcuggggcccuccgccguggacaucggcaacggguguuucgagaccaagcacaagugcaaccagaccugccucgaccgcaucgccgcgggcaccuucaaugccggggaguucagccugcccaccuucgacucccugaacaucacggccgccagccucaacgaugacggccuggacaaccacaccauccugcuguacuacuccaccgccgcgagcucccucgccgugacccugaugcuggccaucuuuaucgucuacauggugagccgggacaacguguccugcagcaucugccucuga

SEQ ID NO: 15537 - RNA, 1758 nt, Artificial Sequence; identical to SEQ ID NO: 14423
  derived and/or modified CDS sequence (AUadapt) from InfluenzaB__AGX84854__HA

SEQ ID NO: 15538 - RNA, 1758 nt, Artificial Sequence
  derived and/or modified CDS sequence (AUadapt) from InfluenzaB__AGX84865__HA
augaaggccaucaucgugcugcucauggucgugaccaguaacgccgaccgcaucugcaccggcaucacguccucgaacagcccccacaucgugaagaccgcgacccagggggaggucaacgugaccggcgugaucccgcugacgaccacccccaccaagucgcacuuugccaaccugaaggggacggagacccggggcaagcucugccccaagugccccaacugcaccgaccuggacgucgcccuggggcgcccgaagugcaccggcaagauccccuccgcccgggugagcauccuccacgaggugcgccccgucacguccggcugcuuucccaucaugcacgaccggaccaagauccgccagcugccgaaccugcuccggggguacgagcacauccgccugucgacccacaacgugaucaacgccgagaacgcgcccggcgggcccuacaagaucggcaccuccgggaguugccccaacgugacgaacggcaacggcuucuucgccaccauggccugggccgucccgaagaacgacaagaacaagaccgcgaccaacccccugacgaucgaggugcccuacaucuguaccgagggggaggaccagaucaccguguggggcuuccacuccgacaacgagacccagauggccaagcucuacggggacucgaagccccagaaguucacguccucggccaacggcgucaccacccauuacgugucccagaucggcggguucccgaaccagaccgaggacggcgggcugccccagagcggccggaucguggucgacuacauggugcagaaguccgggaagacgggcaccaucaccuaccagcgcggcauccugcucccccagaagguguggugcgccucggggcgguccaaggucaucaagggcagccugccccugaucggggaggccgauugccuccacgagaaguacggcgggcugaacaagucgaagccguacuacaccggcgagcacgcgaaggccaucggcaacugccccaucugggugaagacgccccugaagcucgccaacgggaccaaguaucggcccccggccaagcugcugaaggagcgcggcuucuucggggccaucgcgggcuuccucgagggcgggugggagggcaugaucgccggguggcacggcuacaccucccacggggcccacggcguggccgucgccgcggaccugaaguccacccaggaggccaucaacaagaucacgaagaaccugaacucccucagugagcuggaggugaagaaccugcagcgccucuccggcgccauggacgagcugcacaacgagauccuggagcucgacgagaaggucgacgaccugcgggccgacaccaucucgucccagaucgagcuggccgugcuccugucgaacgaggggaucaucaauuccgaggacgagcaccuccuggcgcuggagcgcaagcugaagaagaugcucggccccagcgccguggagaucgggaacggcugcuucgagaccaagcacaagugcaaccagaccugccuggaccggaucgccgccgggaccuuugacgcgggcgaguucucccugcccacguucgacucgcucaacaucaccgccgccucccugaacgacgacggccuggacaaccauaccauccuccuguacuacagcaccgccgccuccucgcuggcggucacgcugaugaucgccaucuucgugguguacauggucucccgcgacaacgugagcugcuccaucugccucuga

SEQ ID NO: 15539 - RNA, 1758 nt, Artificial Sequence; identical to SEQ ID NO: 15538
  derived and/or modified CDS sequence (AUadapt) from InfluenzaB__AGX84876__HA

SEQ ID NO: 15540 - RNA, 1758 nt, Artificial Sequence; identical to SEQ ID NO: 15538
  derived and/or modified CDS sequence (AUadapt) from InfluenzaB__AGX84887__HA

SEQ ID NO: 15541 - RNA, 1758 nt, Artificial Sequence; identical to SEQ ID NO: 14423
  derived and/or modified CDS sequence (AUadapt) from InfluenzaB__AGX84898__HA

SEQ ID NO: 15542 - RNA, 1758 nt, Artificial Sequence
  derived and/or modified CDS sequence (AUadapt) from InfluenzaB__AGX84920__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuuugccaaccugaaggggacggagacccggggcaagcucugccccaagugccccaacugcaccgaccuggacguggcccuggggcgcccgaagugcaccggcaagauccccuccgccggcgugagcauccuccacgagguccggcccgugacguccggguguuuccccaucaugcacgaccgcaccaagauccggcagcugccgaaccugcuccgcggcuacgagcacauccggcugucgacccacaacgugaucaacgccgagaaugcgcccgggggccccuacaagaucgggaccuccggcagcugccccaacgucacgaacggcaacggguucuucgccaccauggccugggccgugccgaagaacgacaagaauaagaccgcgaccaacccccugacgaucgaggugcccuacaucugcaccgagggcgaggaccagaucaccgucuggggguuccacuccgacaacgagacccagauggccaagcucuacggcgacaguaagccccagaaguucacguccagcgccaacggcgugaccacccacuacgugucccagaucgggggcuucccgaaccagaccgaggacgggggccugccccagucggggcgcaucgucguggacuauauggugcagaaguccggcaagacgggcaccaucaccuaccagcgggggauccugcucccccagaaggucuggugcgccagcggccgcuccaaggugaucaaggggucgcugccccugaucggcgaggccgacugccuccacgagaaguacgggggccugaacaagagcaagccguauuacaccggcgagcacgcgaaggccaucgggaacugccccaucugggugaagacgccccugaagcucgccaacggcaccaaguaccggcccccggccaagcugcugaaggagcgcggguucuucggcgccaucgcgggguuccucgagggcggcugggaggggaugaucgccggcuggcacggguauaccucccacggcgcccacggcgucgccguggccgcggaccugaaguccacccaggaggccaucaacaagaucacgaagaaccugaacucccucucggagcuggaggucaagaaccugcagcggcucuccggggccauggacgagcugcacaaugagauccuggagcucgacgagaagguggacgaccugcgcgccgacaccaucagcucccagaucgagcuggccgugcuccugucgaacgagggcaucaucaacuccgaggacgagcaccuccuggcgcuggagcggaagcugaagaagaugcucgggcccagugccgucgagaucggcaacgggugcuucgagaccaagcacaagugcaaccagaccugccuggaccgcaucgccgccggcaccuucgacgcgggcgaguuuucccugcccacguucgacucgcucaacaucaccgccgccucccugaacgacgacgggcuggacaaccacaccauccuccuguauuacagcaccgccgccuccucgcuggcggugacgcugaugaucgccaucuucguggucuacauggugucccgggacaacgugagcugcuccaucugccucuga

SEQ ID NO: 15543 - RNA, 1758 nt, Artificial Sequence
  derived and/or modified CDS sequence (AUadapt) from InfluenzaB__AGZ59821__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacgaagacccggggcaagcucugccccaagugcuucaacugcaccgaucuggacguggcccuggggcgccccaagugcaccggcaacaucccguccgccaaggugucgauccuccacgagguccggcccgugacguccggcugcuuccccaucaugcacgaccgcaccaaggugcggcagcugcccaaccugcuccgcggguacgagcacauccggcugagcacccacaacgucaucaacgccgagaaggcgccgggcgggcccuacaagaucggcaccuccgggaguugccccaacgugacgaacggcaacggcuucuucgccaccauggccugggccgugcccaagaacgacaacaacaagaccgcgaccaacucccugacgaucgaggucccguacaucugcaccgagggggaggaccagaucaccguguggggcuuccacucggauaacgagacccagauggccaagcucuacggggacuccaagccccagaaguucacgagcuccgccaacggcgugaccacccacuacgucucgcagaucggcggguuccccaaccagaccgaggacggcgggcugccccaguccggccgcaucgugguggacuacaugguccagaaguccgggaagacgggcaccaucaccuaccagcggggcauccugcucccgcagaagguguggugcgccuccgggcgcagcaaggugaucaagggcucgcugccccugaucggggaggccgauugccuccacgagaaguacggcgggcugaacaaguccaagcccuacuacaccggcgagcacgcgaaggccaucggcaacugccccaucugggucaagacgccgcugaagcucgccaacgggaccaaguaccggccgcccgccaagcugcugaaggagcgcggcuucuucggggccaucgcgggcuuccucgagggcgggugggagggcaugaucgccggguggcacggcuacaccucgcauggggcccacggcguggccgucgccgcggaccugaaguccacccaggaggccaucaacaagaucacgaagaaccugaacagccucuccgagcuggaggugaagaaccugcagcggcucucgggcgccauggacgagcugcacaacgagauccuggagcucgacgagaagguggacgaccugcgcgccgacaccaucuccucgcagaucgagcuggccguccuccuguccaacgaggggaucaucaauagcgaggacgagcaccuccuggcgcuggagcggaagcugaagaagaugcucggccccuccgccguggagaucgggaacggcugcuucgagaccaagcacaagugcaaccagaccugccuggaccgcaucgccgccgggaccuucgacgcgggcgaguucucgcugcccacguucgacucccucaauaucaccgccgccucgcugaacgacgacggccuggacaaccacaccauccuccuguacuacuccaccgccgccagcucccuggcggugacgcugaugaucgccaucuucgucguguacauggugucgcgggacaacgucuccugcagcaucugccucuga

SEQ ID NO: 15544 - RNA, 1758 nt, Artificial Sequence
  derived and/or modified CDS sequence (AUadapt) from InfluenzaB__AGZ59832__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagucgcacuucgccaaccugaaggggacgaagacccggggcaagcucugccccaagugccugaacugcaccgaccuggacguggcccucgggcgccccaagugcaccggcaacaucccguccgccaaggugagcauccugcacgagguccggcccgugacguccggcugcuuucccaucaugcacgaccgcaccaagauccggcagcugcccaaccuccugcgcggguacgagcacauccggcugucgacccacaacgugaucaacgccgagaaggcgccgggcgggcccuacaagaucggcaccuccgggucgugccccaacgucacgaacggcaacggcuucuucgccaccauggccugggccgugcccaagaacgacaacaacaagaccgcgaccaacucccucacgaucgaggugccguacaucuguaccgagggggaggaccagaucaccgucuggggcuuccacucggacaacgagacccagauggccaagcuguacggggacuccaagccccagaaguucacgagcuccgccaacggcgugaccacccacuacgugucgcagaucggcggguuccccaaccagaccgaggacggcgggcugccccaguccggccgcaucgucguggacuacauggugcagaaguccgggaagacgggcaccaucaccuaccagcggggcauccuccugccgcagaaggucuggugcgccuccggcaagucgaaggugaucaaggggucgcugccccucaucggggaggccgauugccugcacgagaaguacggcgggcugaacaaguccaagcccuacuacaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccucgcacggggcccacggcgucgccguggccgcggaccugaaguccacccaggaggccaucaacaagaucacgaagaaccucaacagucuguccgagcuggaggucaagaaccuccagcgccugucgggcgccauggacgagcugcacaacgagauccucgagcuggacgagaagguggacgaccugcgggccgacaccaucuccucgcagaucgagcucgccgugcugcuguccaacgaggggaucaucaacucggaggacgagcaccuccuggcgcuggagcgcaagcucaagaagaugcugggccccuccgccgucgagaucgggaacggcugcuucgagaccaagcacaagugcaaccagaccugccuggaccggaucgccgccgggaccuuugacgcgggcgaguucagccuccccacguucgacucccugaacaucaccgccgccucgcugaacgaggacggccucgacaaccacaccauccugcuguacuacuccaccgccgccucgucccuggcggugacgcucaugaucgccaucuucguggucuacauggugucgcgcgacaacguguccugcagcaucugccuguga

SEQ ID NO: 15545 - RNA, 1758 nt, Artificial Sequence
  derived and/or modified CDS sequence (AUadapt) from InfluenzaB__AGZ59843__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugccccaagugucugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcauauccgccugucgacccacaacgugaucaacgccgagaacgcgccgggcgggcccuacaagaucggcaccuccgggucgugccccaacgucacgaacggcaacggcuucuucgccaccauggccugggccgugcccaagaaugacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguuuacgucguccgccaacggcgugaccacccacuacgugagccagaucggcggguuccccaaccagaccgaggacggcgggcugccccaguccggccggaucgucguggacuacauggugcagaaguccgggaagacgggcaccaucaccuaccagcgcggcauccuccugccgcagaaggucuggugcgccuccgggcggucgaaggugaucaagggcucgcugccccucaucggggaggccgauugccugcacgagaaguacggcgggcugaacaaguccaagcccuacuacaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuucuggagggcgggugggagggcaugaucgccggguggcacggcuacaccagccacggggcccacggcgucgccguggccgcggaccugaaguccacccaggaggccaucaacaagaucacgaagaaccucaacucgcuguccgagcuggaggucaagaaccuccagcgccugagcggcgccauggacgagcugcacaaugagauccucgagcuggacgagaagguggacgaccugcgggccgacaccaucuccucgcagaucgagcucgccgugcugcuguccaacgaggggaucaucaacucggaggacgagcaccuccuggcgcuggagcgcaagcucaagaagaugcugggccccuccgccgucgagaucgggaacggcugcuucgagaccaagcauaagugcaaccagaccugccuggaccggaucgccgccgggaccuucgacgcgggcgaguucagccuccccacguucgacucccugaacaucaccgccgccucgcugaacgacgauggccucgacaaccacaccauccugcuguacuacuccaccgccgccagcucccuggcggugacgcucaugaucgccaucuucaucguguacauggucucgcgcgacaacguguccugcagcaucugccuguga

SEQ ID NO: 15546 - RNA, 1758 nt, Artificial Sequence; identical to SEQ ID NO: 14892
  derived and/or modified CDS sequence (AUadapt) from InfluenzaB__AGZ59854__HA

SEQ ID NO: 15547 - RNA, 1758 nt, Artificial Sequence; identical to SEQ ID NO: 14254
  derived and/or modified CDS sequence (AUadapt) from InfluenzaB__AGZ59865__HA

SEQ ID NO: 15548 - RNA, 1758 nt, Artificial Sequence
  derived and/or modified CDS sequence (AUadapt) from InfluenzaB__AGZ59876__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugccccaagugucugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcauauccgccugucgacccacaacgugaucaacgccgagaacgcgccgggcgggcccuacaagaucggcaccuccgggucgugccccaacgucacgaacggcaacggcuucuucgccaccauggccugggccgugcccaagaaugacaagaacaagaccgcgaccaacucccucacgaucgaggugccguacaucugcaccgagggggaggaccagaucaccgucuggggcuuccacagcgacaacgagacccagauggccaagcuguacggggacuccaagccccagaaguucacgaguuccgccaacggcgugaccacccacuacgugagccagaucggcggguuccccaaccagaccgaggacggcgggcugccccaguccggccggaucgucguggacuacauggugcagaaguccgggaagacgggcaccaucaccuaccagcgcggcauccuccugccgcagaaggucuggugcaccuccgggcggucgaaggugaucaagggcucgcugccccucaucggggaggccgauugccugcacgagaaguacggcgggcugaacaaguccaagcccuacuacacgggcgagcacgccaaggcgaucggcaacugccccaucugggugaagaccccgcucaagcuggccaacgggaccaaguaccgcccgcccgccaagcugcucaaggagcggggcuucuucggggccaucgccggcuuccuggagggcgggugggagggcaugaucgcgggguggcauggcuacaccagccacggggcccacggcgucgccguggccgccgaccugaaguccacgcaggaggcgaucaacaagaucaccaagaaccucaacucgcuguccgagcuggaggucaagaaccuccagcgccugagcggcgccauggacgagcugcacaaugagauccucgagcuggacgagaagguggacgaccugcgggccgacaccaucuccucgcagaucgagcucgccgugcugcuguccaacgaggggaucaucaacucggaggacgagcaccuccuggcccuggagcgcaagcucaagaagaugcugggccccuccgcggucgagaucgggaacggcugcuucgagaccaagcacaaguguaaccagaccugccuggaccggaucgccgccgggacguucgacgccggcgaguucagccuccccaccuucgacucccugaacaucaccgcggccucgcugaacgacgauggccucgacaaccacaccauccugcuguacuacuccacggccgccagcucccuggccgugacccucaugaucgcgaucuucguggucuacauggugucgcgcgacaacguguccugcagcaucugccuguga

SEQ ID NO: 15549 - RNA, 1755 nt, Artificial Sequence; identical to SEQ ID NO: 14307
  derived and/or modified CDS sequence (AUadapt) from InfluenzaB__AGZ59887__HA

SEQ ID NO: 15550 - RNA, 1758 nt, Artificial Sequence; identical to SEQ ID NO: 14085
  derived and/or modified CDS sequence (AUadapt) from InfluenzaB__AGZ59898__HA

SEQ ID NO: 15551 - RNA, 1758 nt, Artificial Sequence; identical to SEQ ID NO: 15095
  derived and/or modified CDS sequence (AUadapt) from InfluenzaB__AGZ59909__HA

SEQ ID NO: 15552 - RNA, 1758 nt, Artificial Sequence; identical to SEQ ID NO: 14085
  derived and/or modified CDS sequence (AUadapt) from InfluenzaB__AGZ59920__HA

SEQ ID NO: 15553 - RNA, 1758 nt, Artificial Sequence; identical to SEQ ID NO: 14085
  derived and/or modified CDS sequence (AUadapt) from InfluenzaB__AGZ59931__HA

SEQ ID NO: 15554 - RNA, 1758 nt, Artificial Sequence; identical to SEQ ID NO: 14085
  derived and/or modified CDS sequence (AUadapt) from InfluenzaB__AGZ59942__HA

SEQ ID NO: 15555 - RNA, 1758 nt, Artificial Sequence; identical to SEQ ID NO: 14085
  derived and/or modified CDS sequence (AUadapt) from InfluenzaB__AGZ59953__HA

SEQ ID NO: 15556 - RNA, 1758 nt, Artificial Sequence
  derived and/or modified CDS sequence (AUadapt) from InfluenzaB__AGZ59965__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugucccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaucuccugcggggguacgagcacauccgccugucgacccacaacgugaucaacgccgagaacgcgccgggcgggcccuacaagaucggcaccuccgggagcugccccaacaucacgaacggcaauggcuucuucgccaccauggccugggccguccccaagaacgacaagaacaagaccgcgaccaacccgcucacgaucgaggugcccuacaucugcaccgagggggaggaccagaucaccguguggggcuuccacuccgacaaugagacccagauggccaagcuguacggggacucgaagccccagaaguucacguccucggccaacggcgucaccacccacuacgugucccagaucggcggguuccccaaccagaccgaggacggcgggcugccgcagagcggccggguggucguggauuacaugaugcagaaguccgggaagacgggcaccaucaccuaccagcgcggcauccuccugccccagaagguguggugcgccucggggcgguccaaggucaucaagggcagccugccccucaucggggaggccgacugccugcacgagaaguacggcgggcugaacaagucgaagcccuacuauaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcguggccgucgccgcggaucugaaguccacccaggaggccaucaacaagaucacgaagaaccucaacucccugagcgagcuggaggugaagaaccuccagcgccuguccggcgccauggacgagcugcacaacgagauccucgagcuggacgagaaggucgacgaccugcgggccgacaccaucaguucccagaucgagcucgccgugcugcugucgaacgaggggaucaucaacuccgaggacgagcaccuccuggcgcuggagcgcaagcucaagaagaugcugggccccagcgccguggagaucgggaacggcugcuucgagaccaagcacaagugcaaccagaccugucuggaccggaucgccgccgggaccuucgacgcgggcgaguucucccuccccacguucgacucgcugaacaucaccgccgccucccugaacgacgacggccucgacaaucacaccauccugcuguacuacagcaccgccgccuccucgcuggcggucacgcucaugaucgccaucuucgugguguacauggucucccgcgacaacgugagcugcuccaucugccuguga

SEQ ID NO: 15557 - RNA, 1758 nt, Artificial Sequence; identical to SEQ ID NO: 14085
  derived and/or modified CDS sequence (AUadapt) from InfluenzaB__AGZ59976__HA

SEQ ID NO: 15558 - RNA, 1758 nt, Artificial Sequence; identical to SEQ ID NO: 14085
  derived and/or modified CDS sequence (AUadapt) from InfluenzaB__AGZ59987__HA

SEQ ID NO: 15559 - RNA, 1758 nt, Artificial Sequence; identical to SEQ ID NO: 14085
  derived and/or modified CDS sequence (AUadapt) from InfluenzaB__AGZ59999__HA

SEQ ID NO: 15560 - RNA, 1758 nt, Artificial Sequence; identical to SEQ ID NO: 14348
  derived and/or modified CDS sequence (AUadapt) from InfluenzaB__AGZ60010__HA

SEQ ID NO: 15561 - RNA, 1758 nt, Artificial Sequence; identical to SEQ ID NO: 14348
  derived and/or modified CDS sequence (AUadapt) from InfluenzaB__AGZ60021__HA

SEQ ID NO: 15562 - RNA, 1758 nt, Artificial Sequence; identical to SEQ ID NO: 14348
  derived and/or modified CDS sequence (AUadapt) from InfluenzaB__AGZ60033__HA

SEQ ID NO: 15563 - RNA, 1755 nt, Artificial Sequence
  derived and/or modified CDS sequence (AUadapt) from InfluenzaB__AGZ60044__HA
augaaggccaucaucgugcugcucauggucgugaccaguaacgccgaccgcaucugcaccggcaucacguccagcaacaguccccacguggucaagaccgcgacccagggggaggugaacgugaccggcgucaucccgcugacgaccacccccaccaaguccuacuucgccaaccugaaggggacgcggacccgcggcaagcucugccccgauugccugaacugcaccgaccuggacguggcccucgggcggcccaugugcgugggcaccacgccguccgccaaggccaguauccugcacgagguccgccccgugaccuccggcugcuuccccaucaugcacgaccggaccaagauccgccagcugcccaaccuccugcggggguaugagaacauccgccugagcacccagaacgugaucgacgcggagaacgccccgggcgggcccuaccggcucggcacguccgggaguugccccaacgccaccuccaagagcggcuucuucgccaccauggcgugggccguccccaaggacaauaacaagaacgccaccaacccgcugacgguggaggugcccuacgucugcaccgagggcgaggaccagaucaccguguggggguuucacuccgacaacaagacccagaugaagaaccuguacggcgacaguaacccccagaaguucacguccagcgccaacggggugaccacccacuacgucucccagaucggcggcuuucccgcccagaccgaggacgggggccucccgcagagcgggcgcaucgugguggacuacaugguccagaagccccggaagacgggcaccaucguguaccagcgcggggugcugcugccccagaaggucuggugcgcguccggccggaguaaggugaucaagggcagccucccccugaucggggaggccgacugccugcacgagaaguacggcgggcucaauaaguccaagccguacuacaccggcgagcacgccaaggccaucgggaacugccccaucugggucaagacgccccugaagcuggccaacggcaccaaguaucggcccccggcgaagcuccugaaggagcgcggcuucuucggggccaucgccggcuuccuggagggcgggugggaggggaugaucgccggcuggcacggcuacaccagccauggggcccacggcguggcgguggccgccgaccucaaguccacccaggaggccaucaacaagaucaccaagaaccugaacagccuguccgagcucgaggucaagaaucugcagcgccugagcggggccauggacgagcuccacaacgagauccuggagcuggacgagaagguggacgaucuccgggcggacacgaucuccagccagaucgagcuggccgugcugcucuccaacgagggcaucaucaacagcgaggacgagcaucuccuggcccuggagcgcaagcugaagaagaugcugggccccuccgccgucgacaucgggaacggcugcuucgagaccaagcacaagugcaaucagaccugccucgaccggaucgcggccgggaccuucaacgccggcgaguucagccugcccaccuuugacucccugaacaucacggccgccagccucaacgacgacgggcuggauaaccacaccauccugcuguacuacuccaccgcggccagcucccucgccgugacccugaugcuggccaucuucaucguguauauggucagccgcgacaacguguccugcagcaucugccucuga

SEQ ID NO: 15564 - RNA, 1755 nt, Artificial Sequence; identical to SEQ ID NO: 14766
  derived and/or modified CDS sequence (AUadapt) from InfluenzaB__AGZ60055__HA

SEQ ID NO: 15565 - RNA, 1755 nt, Artificial Sequence
  derived and/or modified CDS sequence (AUadapt) from InfluenzaB__AGZ60066__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaagucccacuucgccaaccugaaggggacgcggacccgcggcaagcucugccccgacugccugaauugcaccgaccuggacguggcccucgggcggcccaugugcgugggcaccacgccguccgccaaggccagcauccugcacgagguccgccccgugaccuccggcuguuuccccaucaugcacgaccggaccaagauccgccagcugcccaaccuccugcggggguacgagaacauccgccugagcacccagaaugugaucgacgcggagaaggcccucggcgggccguaccggcugggcacguccgggagcugccccaacgccaccuccaagagcggcuucuuugccaccauggcgugggccguccccaaggacaacaacaagaacgccaccaacccccugacgguggaggugccguacaucuguaccgagggcgaggaccagaucaccgucuggggguuccacuccgacaacaagacccagaugaagaaccucuacggcgauucgaacccccagaaguucacguccagcgccaacggggugaccacccacuacgugucccagaucggcggcuuucccgaccagaccgaggacgggggccugccccagagcgggcgcaucgucguggacuacauggugcagaagccgggcaagacggggaccaucgucuaccagcggggcgugcugcucccccagaagguguggugugccuccggccgcagcaaggucaucaaggggagccugccccugaucggcgaggcggacugccuccacgagaaguacgggggccugaacaaguccaagcccuauuacaccggggagcacgccaaggccaucggcaacugcccgaucugggugaagacgccccugaagcucgccaacggcaccaaguaccggccgcccgccaagcugcugaaggagcgcggguuuuucggcgcgaucgccggguuccucgagggcgggugggagggcaugaucgccggcuggcacggguacaccagccacggcgcccacggggucgccguggcggccgaucugaaguccacccaggaggccaucaacaagaucaccaagaaccugaacagccucuccgagcuggaggugaagaaccugcagcggcucucgggcgccauggacgagcugcauaacgagauccuggagcucgacgagaaggucgacgaccugcgcgccgacacgaucuccagccagaucgagcuggcggugcuccuguccaaugagggcaucaucaacagcgaggacgagcaccuccuggcccuggagcggaagcugaagaagaugcucgggcccuccgccguggacaucggcaacgggugcuuugagaccaagcacaagugcaaccagaccugccuggaccgcaucgccgcgggcaccuucaacgccggggaguuuagccugcccaccuucgacucccucaacaucacggccgccagccugaacgaugacggccuggacaaccacaccauccugcucuacuacuccaccgccgcgagcucccuggccgucacccugaugcucgccaucuuuaucguguacauggugagccgggacaacgucuccugcagcaucugccuguga

SEQ ID NO: 15566 - RNA, 1755 nt, Artificial Sequence
  derived and/or modified CDS sequence (AUadapt) from InfluenzaB__AGZ60077__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaagagcuacuucgccaaccugaaggggacgcggacccgcggcaagcucugccccgacugccugaacuguaccgaccuggacguggcccucgggucccccaugugcgugggcaccacgccgagcgccaaggccuccauccugcacgagguccggcccgugaccagcggcugcuuucccaucaugcacgaccgcaccaagauccggcagcuggcgaaccuccugcgcggguacgagaacauccggcuguccacccagaacgugaucgacgccgagaaggcccccggcgggccguaccgccucggcacgaguggguccugccccaacgccaccagcaaguccggcuucuucgcgaccauggccugggccguccccaaggacaacaauaagaacgccaccaacccccugacgguggaggugccguacaucugcaccgagggcgaggaccagaucaccgucuggggguuccacagcgauaacaagacccagaugaagaaccuguacggcgacuccaacccccagaaguucacgagcuccgccaacggggugaccacccauuacgugagccagaucggcggcuuccccgaccagaccgaggacgggggccucccccaguccgggcggaucgucguggacuacaugaugcagaaguccggcaagacggggaccaucguguaucagcgcggcguccugcugccgcagaagguguggugcgcgagcggccgguccaaggugaucaaggggucgcucccccugaucggcgaggccgacugccugcacgagaaguacgggggccucaacaaguccaagcccuauuacaccggggagcacgccaaggccaucggcaacugccccaucugggucaagaccccgcugaagcuggccaacggcacgaaguaccgcccgcccgcgaagcuccugaaggagcggggguucuuuggcgccaucgccggguuccuggagggcgggugggagggcaugaucgccggcuggcacggguacaccagccacggcgcccacgggguggcggucgccgccgaccucaaguccacccaggaggccaucaacaagaucaccaagaaucugaacagccuguccgagcucgaggugaagaaccugcagcgccugagcggcgccauggacgagcuccacuccgagauccuggagcuggacgagaagguggacgaucuccgggcggacacgaucagcucccagaucgagcuggccguccugcucagcaacgagggcaucaucaacuccgaggacgagcaccuccuggcccuggagcgcaagcugaagaagaugcuggggcccagugccguggacaucggcaacgggugcuucgagaccaagcacaagugcaaccagaccugccucgaucggaucgcggccggcaccuucaacgccggggaguucucccugcccaccuucgacagccugaacaucacggccgccucccucaaugacgacggccuggacaaccacaccauccugcuguacuacagcaccgcggccuccagucucgccgugacccugaugcuggccaucuucaucgucuacauggugagccgcgacaacguguccugcagcaucugccucuga

SEQ ID NO: 15567 - RNA, 1755 nt, Artificial Sequence; identical to SEQ ID NO: 14471
  derived and/or modified CDS sequence (AUadapt) from InfluenzaB__AGZ60088__HA

SEQ ID NO: 15568 - RNA, 1755 nt, Artificial Sequence; identical to SEQ ID NO: 14166
  derived and/or modified CDS sequence (AUadapt) from InfluenzaB__AGZ60099__HA

SEQ ID NO: 15569 - RNA, 1755 nt, Artificial Sequence
  derived and/or modified CDS sequence (AUadapt) from InfluenzaB__AGZ60131__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuauuucgccaaccugaaggggacgcggacccgcggcaagcucugccccgacugccugaacugcaccgaccuggauguggcccucgggcggcccaugugcgugggcaccacgccguccgccaaggccucgauccugcacgagguccgccccaucaccuccggcugcuuccccaucaugcacgaccggaccaagauccgccagcugcccaaccuccugcggggguaugagaacauccgccugagcacccagaacgugaucgacgcggagaaggccccgggcgggcccuaccggcucggcacguccgggagcugccccaacgccaccuccaagaguggcuucuucgccaccauggcgugggccgugcccaaggacaacaacaagaacgccaccaacccgcugacggucgaggugcccuacaucuguaccgagggcgaggaccagaucaccguguggggguuccacuccgacaacaagacccagaugaagaaccuguacggcgacaguaacccccagaaguucacguccagcgccaacggggucaccacccacuacgugucccagaucggcagcuuccccgaucagaccgaggacggcgggcucccgcaguccggccgcaucguggucgacuacaugaugcagaagcccgggaagacgggcaccaucguguaccagcgcggggugcugcugccccagaaggucuggugcgccagcggccggucgaaggugaucaagggcucccucccccugaucggggaggcggacugucugcacgagaaguacggcgggcucaacaagagcaagccguacuacaccggcgagcacgccaaggccaucgggaacugucccaucugggugaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccucccacggggcccauggcgucgccguggcggccgaccucaagagcacccaggaggccaucaacaagaucaccaagaaccugaacucccugagcgagcucgaggucaagaaccugcagcggcuguccggggccauggacgagcuccauaacgagauccuggagcuggacgagaagguggacgaccuccgcgccgacacgaucucgucccagaucgagcuggcggugcugcucagcaacgagggcaucaucaauuccgaggacgagcaccuccuggcccuggagcggaagcugaagaagaugcugggccccagcgccgucgagaucgggaacggcugcuucgagaccaagcacaagugcaaucagaccugccucgaccgcaucgccgcggggaccuucaacgccggcgaguucucccugcccaccuucgacagccugaauaucacggccgccucccucaacgacgacgggcuggacaaccacaccauccugcuguacuacaguaccgccgcguccagccucgccgugacccugaugcuggccaucuucaucguguacauggucucccgggacaacgugagcugcagcaucugccucuga

SEQ ID NO: 15570 - RNA, 1755 nt, Artificial Sequence; identical to SEQ ID NO: 14471
  derived and/or modified CDS sequence (AUadapt) from InfluenzaB__AGZ60142__HA

SEQ ID NO: 15571 - RNA, 1755 nt, Artificial Sequence; identical to SEQ ID NO: 14471
  derived and/or modified CDS sequence (AUadapt) from InfluenzaB__AGZ60160__HA

SEQ ID NO: 15572 - RNA, 1755 nt, Artificial Sequence; identical to SEQ ID NO: 14117
  derived and/or modified CDS sequence (AUadapt) from InfluenzaB__AGZ60172__HA

SEQ ID NO: 15573 - RNA, 1755 nt, Artificial Sequence; identical to SEQ ID NO: 14117
  derived and/or modified CDS sequence (AUadapt) from InfluenzaB__AGZ60183__HA

SEQ ID NO: 15574 - RNA, 1755 nt, Artificial Sequence
  derived and/or modified CDS sequence (AUadapt) from InfluenzaB__AGZ60194__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuauuucgccaaccugaaggggacgcggacccgcggcaagcucugccccgacugccugaacugcaccgaccuggacguggcccucgggcggcccaugugugugggcaccacgccguccgccaaggccagcauccugcacgagguccgccccgugaccuccggcugcuuccccaucaugcacgaccggaccaagauccgccagcugcccaaccuccugcggggguacgagaacauccgccugaguacccagaacgugaucgacgcggagaaggccccgggcgggcccuaccggcucggcacguccgggagcugccccaacgccaccuccaagaucggcuucuucgccaccauggcgugggccguccccaaggauaacuacaagaacgccaccaacccgcugacgguggaggugcccuacaucugcaccgagggcgaggaccagaucaccgucuggggguuccacagugacaacaagacccagaugaagaaccuguacggcgacuccaacccccagaaguucacgagcuccgccaacggggugaccacccauuacgugucgcagaucggcgacuuccccgaccagaccgaggacggcgggcucccgcaguccggccgcaucgucguggacuacaugaugcagaagacggggaagaccggcaccaucguguaucagcgcgggguccugcugccccagaagguguggugcgccagcggccgguccaaggugaucaagggcagccucccccugaucggggaggcggacugccugcacgagaaguacggcgggcucaacaagagcaagcccuauuacaccggcgagcacgccaaggccaucgggaacugcccgaucugggucaagacgccccugaagcuggccaacggcaccaaguaccggccgcccgccaagcuccugaaggagcgcggcuucuucggggcgaucgccggcuuccuggagggcgggugggaggggaugaucgccggcuggcauggcuacaccucccacggggcccacggcguggccgucgcggccgaccucaagucgacccaggaggccaucaacaagaucacgaagaaccugaacucccugagugagcucgaggugaagaaccugcagcggcuguccggggccauggacgagcuccacaacgagauccuggagcuggacgagaagguggacgaccuccgcgccgacaccaucagcucccagaucgagcuggcgguccugcucaguaacgagggcaucaucaacuccgaggacgagcaccuccuggcccuggagcggaagcugaagaagaugcugggccccucggccguggacaucgggaacggcugcuucgagaccaagcauaagugcaaccagaccugccucgaccgcaucgccgcggggaccuucaacgccggcgaguucucccugcccacguucgauagccugaacaucaccgccgccucccucaacgacgacgggcuggacaaccacaccauccugcuguacuauagcaccgccgcguccagccucgccgugacgcugaugcuggccaucuucaucgucuacauggugucccgggacaacgugagcugcuccaucugccucuga

SEQ ID NO: 15575 - RNA, 1755 nt, Artificial Sequence
  derived and/or modified CDS sequence (AUadapt) from InfluenzaB__AGZ60206__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaucaaguccuauuucgccaaccugaaggggacccggacgcgcggcaagcucugccccgacugccugaacugcaccgaccuggacguggcccucgggcggcccaugugugugggcaccaccccguccgccaaggccagcauccugcacgagguccgccccgugacguccggcugcuuccccaucaugcacgaccggaccaagauccgccagcugcccaaccuccugcggggguacgagaacauccgccugaguacccagaacgugaucgacgcggagaaggccccgggcgggcccuaccggcucggcaccuccgggucgugccccaacgccacguccaagaucggcuucuucgccaccauggcgugggccguccccaaggauaacuacaagaacgccaccaacccgcugaccguggaggugcccuacaucugcacggagggcgaggaccagaucaccgucuggggguuccacagugacaacaagacccagaugaagaaccuguacggcgacuccaacccccagaaguucaccagcuccgccaacggggugacgacccauuacgugagccagaucggcgacuuccccgaccagaccgaggacggcgggcucccgcaguccggccgcaucgucguggacuacaugaugcagaagcccgggaagaccggcacgaucguguaucagcgcgggguccugcugccccagaagguguggugcgccagcggccgguccaaggugaucaagggcucgcucccccugaucggggaggcggacugccugcacgagaaguacggcgggcucaacaagagcaagccguauuacaccggcgagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcauggcuacaccucccacggggcccacggcguggccgucgcggccgaccucaagagcacccaggaggccaucaacaagaucaccaagaaccugaacucccugagugagcucgaggugaagaaccugcagcggcuguccggggccauggacgagcuccacaacgagauccuggagcuggacgagaagguggacgaccuccgcgccgacaccaucagcucccagaucgagcuggcgguccugcucaguaacgagggcaucaucaacuccgaggacgagcaccuccuggcccuggagcggaagcugaagaagaugcugggccccagcgccguggacaucgggaacggcugcuucgagacgaagcauaagugcaaccagaccugccucgaccgcaucgccgcggggaccuucaacgccggcgaguucucccugcccaccuucgauagccugaacaucaccgccgccucccucaacgacgacgggcuggacaaccacacgauccugcuguacuauagcaccgccgcguccagccucgccgugacccugaugcuggccaucuucaucgucuacauggugucccgggacaacgugagcugcuccaucugccucuga

SEQ ID NO: 15576 - RNA, 1755 nt, Artificial Sequence; identical to SEQ ID NO: 15505
  derived and/or modified CDS sequence (AUadapt) from InfluenzaB__AGZ60217__HA

SEQ ID NO: 15577 - RNA, 1755 nt, Artificial Sequence
  derived and/or modified CDS sequence (AUadapt) from InfluenzaB__AGZ60268__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacugcaccgaucuggacguggcccucgggcggcccaugugcgugggcaccacgccguccgccaaggccagcauccugcacgagguccgccccgugaccuccggcugcuuccccaucaugcacgaucggaccaagauccgccagcuggcgaaccuccugcggggguacgagaacauccgccugucgacccagaacgugaucgacgccgagaaggcccccggcgggccguaccggcucggcacguccgggagcugucccaacgccaccuccaagagcggcuucuucgcgaccauggccugggccguccccaaggacaacaacaagaaugccaccaacccccugacgguggaggugccguacaucugcaccgagggcgaggaccagaucaccgucuggggguuccacuccgacaacaagacccagaugaagaaucuguacggcgacagcaacccccagaaguucacguccucggccaacggggugaccacccauuacgugucccagaucggcggcuuccccgaccagaccgaggacgggggccucccccagagcgggcgcaucgucguggacuacaugaugcagaagccgggcaagacggggaccaucguguaccagcggggcguccugcugccccagaagguguggugugcguccggccgcagcaaggugaucaaggggagccucccccugaucggcgaggccgacugccugcacgagaaguacgggggccucaacaaguccaagcccuauuacaccggggagcacgccaaggccaucggcaacugcccgaucugggucaagacgccccugaagcuggccaacggcaccaaguaccggccgcccgcgaagcuccugaaggagcgcggguucuucggcgccaucgccggguuucuggagggcgggugggagggcaugaucgccggcuggcacggguacaccagccacggcgcccacgggguggcggucgccgccgaccucaaguccacccaggaggccaucaacaagaucaccaagaaucugaacucgcuguccgagcucgaggugaagaaccugcagcggcugagcggcgccauggacgagcuccacaacgagauccuggagcuggacgagaagguggaugaccuccgcgcggacacgaucuccagccagaucgagcuggccguccugcucuccaacgagggcaucaucaacagcgaggacgagcaucuccuggcccuggagcggaagcugaagaagaugcuggggcccuccgccaucgacaucggcaacgggugcuucgagaccaagcacaagugcaaccagaccugccucgaucgcaucgcggccggcaccuucaacgccggggaguucucgcugcccaccuucgacucccugaacaucacggccgccagucucaacgacgacggccuggacaaccacaccauccugcuguacuacuccaccgcggccaguucccucgccgugacccugaugcuggccaucuucaucguguacauggucagccgggacaacguguccugcagcaucugccucuga

SEQ ID NO: 15578 - RNA, 1755 nt, Artificial Sequence; identical to SEQ ID NO: 14116
  derived and/or modified CDS sequence (AUadapt) from InfluenzaB__AHE37993__HA

SEQ ID NO: 15579 - RNA, 1755 nt, Artificial Sequence; identical to SEQ ID NO: 14639
  derived and/or modified CDS sequence (AUadapt) from InfluenzaB__AHE37994__HA

SEQ ID NO: 15580 - RNA, 1755 nt, Artificial Sequence; identical to SEQ ID NO: 14116
  derived and/or modified CDS sequence (AUadapt) from InfluenzaB__AHE37995__HA

SEQ ID NO: 15581 - RNA, 1755 nt, Artificial Sequence; identical to SEQ ID NO: 14116
  derived and/or modified CDS sequence (AUadapt) from InfluenzaB__AHE37996__HA

SEQ ID NO: 15582 - RNA, 1755 nt, Artificial Sequence; identical to SEQ ID NO: 14639
  derived and/or modified CDS sequence (AUadapt) from InfluenzaB__AHE37997__HA

SEQ ID NO: 15583 - RNA, 1755 nt, Artificial Sequence; identical to SEQ ID NO: 14639
  derived and/or modified CDS sequence (AUadapt) from InfluenzaB__AHE37998__HA

SEQ ID NO: 15584 - RNA, 1755 nt, Artificial Sequence; identical to SEQ ID NO: 14639
  derived and/or modified CDS sequence (AUadapt) from InfluenzaB__AHE37999__HA

SEQ ID NO: 15585 - RNA, 1755 nt, Artificial Sequence; identical to SEQ ID NO: 14116
  derived and/or modified CDS sequence (AUadapt) from InfluenzaB__AHE38000__HA

SEQ ID NO: 15586 - RNA, 1755 nt, Artificial Sequence; identical to SEQ ID NO: 14116
  derived and/or modified CDS sequence (AUadapt) from InfluenzaB__AHE38001__HA

SEQ ID NO: 15587 - RNA, 1755 nt, Artificial Sequence
  derived and/or modified CDS sequence (AUadapt) from InfluenzaB__AHE38002__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuauuucgccaaccugaaggggacgaagacccggggcaagcucugccccgacugccugaacugcaccgaccuggauguggcccucgggcgccccaugugcgugggcaccacgccguccgccaaggccucgauccugcacgagguccggcccgugaccuccggcugcuuccccaucaugcacgaccgcaccaagauccggcagcuggcgaaccuccugcgcggguaugagaacauccggcugagcacccagaacgugaucgacgccaagaaggcccccggcgggccguaccgccucggcacguccgggagcugccccaacgccaccuccaagaguggcuucuucgcgaccauggccugggccguccccaaggacaacaacaagaacgccaccaacccccugacgguggaggugccguacaucugugccgagggcgaggaccagaucaccgucuggggguuccacuccgacaacaagacccagaugaagaaccuguacggcgacaguaacccccagaaguucaccuccagcgcgaacggggugacgacccacuacgugucccagaucggcggcuuccccgaccagaccgaggaugggggccucccccagagcgggcggaucgucguggacuacaugaugcagaagccgggcaagaccgggacgaucguguaccagcgcggcguccugcugccccagaagguguggugcgccuccggccggagcaaggugaucaaggggucgcucccccugaucggcgaggccgacugucugcacgagaaguacgggggccucaacaaguccaagcccuacuacaccggggagcacgccaaggccaucggcaacugcccgaucugggucaagacgccccugaagcuggcgaauggcaccaaguaccgcccgcccgccaagcuccugaaggagcggggguucuucggcgccaucgccggguuccuggagggcgggugggagggcaugaucgccggcuggcacggguacaccagccacggcgcgcaugggguggccgucgccgccgaccucaaguccacccaggaggccaucaacaagaucaccaagaaccugaacagccuguccgagcucgaggugaagaaccugcagcgccugucgggcgcgauggacgagcuccauaacgagauccuggagcuggacgagaagguggacgaccuccgggccgacaccaucuccagccagaucgagcuggccguccugcucuccaacgagggcaucaucaacagugaggacgagcaccuccuggcccuggagcgcaagcugaagaagaugcuggggcccuccgcgguggacaucggcaacgggugcuucgagacgaagcacaagugcaaucagaccugccucgaccggaucgccgccggcaccuucaacgccggggaguucagccugcccaccuucgacucccugaauaucaccgccgcgucgcucaacgacgacggccuggacaaccacacgauccugcuguacuauuccaccgccgccagcucccucgccgugacccugaugcuggccaucuucaucgucuacauggugagccgcgacaacguguccugcagcaucugccucuga

SEQ ID NO: 15588 - RNA, 1755 nt, Artificial Sequence; identical to SEQ ID NO: 14116
  derived and/or modified CDS sequence (AUadapt) from InfluenzaB__AHE38003__HA

SEQ ID NO: 15589 - RNA, 1755 nt, Artificial Sequence; identical to SEQ ID NO: 14116
  derived and/or modified CDS sequence (AUadapt) from InfluenzaB__AHE38004__HA

SEQ ID NO: 15590 - RNA, 1755 nt, Artificial Sequence; identical to SEQ ID NO: 14116
  derived and/or modified CDS sequence (AUadapt) from InfluenzaB__AHE38005__HA

SEQ ID NO: 15591 - RNA, 1755 nt, Artificial Sequence
  derived and/or modified CDS sequence (AUadapt) from InfluenzaB__AHE38006__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaaguccuacuucgccaaccugaaggggacgaagacccggggcaagcucugccccgacugccugaauugcaccgaccuggacguggcccucgggcgccccaugugcgugggcgccaccccguccgccaaggcgagcauccugcacgagguccggcccgugacguccggcuguuuccccaucaugcacgaccgcaccaagauccggcagcuggccaaccuccugcgcggguacgagaacauccggcugagcacccagaaugugaucgacgccgagaaggcccccggcgggccguaccgccucggcaccuccgggagcugccccaacgcgacguccaagagcggcuucuuugccaccauggccugggccguccccaaggacaacaacaagaacgccaccaacccccugaccguggaggugccguacaucugugcggagggcgaggaccagaucacggucuggggguuccacuccgacaacaagacccagaugaagaaccuguacggcgauucgaacccccagaaguucaccuccagcgccaacggggugaccacgcacuacgugucccagaucggcggcuuucccgaccagaccgaggacgggggccucccccagagcgggcggaucgucguggacuacaugaugcagaagccgggcaagaccgggaccaucguguaccagcgcggcguccugcugccccagaagguguggugugccuccggccggagcaaggugaucaaggggagccucccccugaucggcgaggccgacugccugcacgagaaguacgggggccucaacaaguccaagcccuauuacacgggggagcacgccaaggcgaucggcaacugcccgaucugggucaagacgccccugaagcuggccaacggcaccaaguaccgcccgcccgccaagcuccugaaggagcggggguuuuucggcgccaucgccggguuccuggagggcgggugggagggcaugaucgcgggcuggcacggguacaccagccacggcgcccacgggguggccgucgccgccgaucucaaguccacccaggaggcgaucaacaagaucaccaagaaccugaacagccuguccgagcucgaggugaagaaccugcagcgccugucgggcgccguggacgagcuccauaacgagauccuggagcuggacgagaaggucgacgaccuccgggccgacaccaucuccagccagaucgagcuggccgugcugcucuccaaugagggcaucaucaacagcgaggacgagcaccuccuggcgcuggagcgcaagcugaagaagaugcuggggcccuccgccguggacaucggcaacgggugcuuugagaccaagcacaagugcaaccagacgugccucgaccggaucgccgccggcaccuucaacgccggggaguuuagccugcccaccuucgacucccugaacaucaccgcggccagccucaacgaugacggccuggacaaccacaccauccugcuguacuacuccacggccgccagcucccucgccgucacccugaugcuggcgaucuuuaucguguacauggugagccgcgacaacgucuccugcagcaucugccucuga

SEQ ID NO: 15592 - RNA, 1755 nt, Artificial Sequence; identical to SEQ ID NO: 14116
  derived and/or modified CDS sequence (AUadapt) from InfluenzaB__AHE38007__HA

SEQ ID NO: 15593 - RNA, 1755 nt, Artificial Sequence
  derived and/or modified CDS sequence (AUadapt) from InfluenzaB__AHE38008__HA
augaaggccaucaucgcccugcucaugguggucaccaguaacgcggaccgcaucugcaccggcaucacguccagcaacagcccccauguggugaagaccgccacccagggggaggucaacgugaccggcgugaucccgcugacgaccacccccaccaaguccuacuucgccaaccugaaggggacgaagacccggggcaagcucugccccgacugccugaauugcaccgaccuggacgucgcccucgggcgccccaugugcgugggcaccacgccguccgccaaggcgagcauccugcacgaggugcggcccgucaccuccggcuguuuccccaucaugcacgaccgcaccaagauccggcagcuggccaaccuccugcgcggguacgagaacauccggcugagcacccagaaugugaucgacgccgagaaggcccccggcgggccguaccgccucggcacguccgggucgugccccaacgcgaccuccaagagcggcuucuuugccaccauggccugggccgugcccaaggacaacaacaagaacgccaccaacccccugacggucgaggugccguacaucugugcggagggcgaggaccagaucgccguguggggguuccacuccgacaacaagacccagaugaagaaccuguacggcgauagcaacccccagaaguucaccuccagcgccaacggggucaccacgcacuacgugucccagaucggcggcuuucccgaccagaccgaggacgggggccucccccagagcgggcggaucguggucgacuacaugaugcagaagccgggcaagaccgggaccaucguguaccagcgcggcgugcugcugccccagaaggucuggugugccuccggccggagcaaggugaucaaggggucgcucccccugaucggcgaggccgacugccugcacgagaaguacgggggccucaacaaguccaagcccuauuacacgggggagcacgcgaaggccaucggcaacugcccgaucugggugaagacgccccugaagcuggccaacggcaccaaguaccgcccgcccgccaagcuccugaaggagcggggguuuuucggcgccaucgcgggguuccuggagggcgggugggagggcaugaucgccggcuggcacggguacaccagccacggcgcccacggggucgccguggccgcggaucucaaguccacccaggaggccaucaacaagaucaccaagaaccugaacagccuguccgagcucgaggucaagaaccugcagcgccugagcggcgccauggacgagcuccauaacgagauccuggagcuggacgagaagguggacgaccuccgggccgacaccaucuccagccagaucgagcuggcggugcugcucuccaaugagggcaucaucaacucggaggacgagcaccuccuggcccuggagcgcaagcugaagaagaugcuggggcccuccgccgucgacaucggcaacgggugcuuugagaccaagcacaagugcaaccagacgugccucgaccggaucgccgccggcaccuucaacgcgggggaguuuagccugcccaccuucgacucccugaacaucaccgccgccagccucaacgaugacggccuggacaaccacaccauccugcuguacuacuccacggccgccagcucccucgcggugacccugaugcuggccaucuuuaucguguacauggucagccgcgacaacguguccugcagcaucugccucuga

SEQ ID NO: 15594 - RNA, 1755 nt, Artificial Sequence; identical to SEQ ID NO: 14639
  derived and/or modified CDS sequence (AUadapt) from InfluenzaB__AHE38009__HA

SEQ ID NO: 15595 - RNA, 1755 nt, Artificial Sequence; identical to SEQ ID NO: 14639
  derived and/or modified CDS sequence (AUadapt) from InfluenzaB__AHE38010__HA

SEQ ID NO: 15596 - RNA, 1755 nt, Artificial Sequence; identical to SEQ ID NO: 14116
  derived and/or modified CDS sequence (AUadapt) from InfluenzaB__AHE38012__HA

SEQ ID NO: 15597 - RNA, 1755 nt, Artificial Sequence
  derived and/or modified CDS sequence (AUadapt) from InfluenzaB__AHE38013__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuauuucgccaaccugaaggggacgaagacccggggcaagcucugccccgacugccugaacugcaccgaccuggacguggcccucgggcgccccaugugugugggcaccacgccguccgccaaggccucgauccugcacgagguccggcccgugaccuccggcugcuuccccaucaugcacgaccgcaccaagauccggcagcuggcgaaccuccugcgcggguacgagaacauccggcugaguacccagaacgugaucgacgccgagaaggcccccggcgggccguaccgccucggcacguccgggagcugccccaacgccaccuccaagagcggcuucuuugcgaccauggccugggccguccccaaggacaacaacaagaacgccaccaacccccugacgguggaggugccguacaucugcgccgagggcgaggaccagaucaccgucuggggguuccauuccgacaacaagacccagaugaagaaccuguacggcgacucgaacccccagaaguucaccuccagcgcgaauggggugacgacccacuacgugucccagaucggcggcuuccccgaccagaccgaggacgggggccucccccagagcgggcggaucgucguggacuacaugaugcagaagccgggcaagaccgggacgaucguguaucagcgcggcguccugcugccccagaagguguggugcguguccggccggagcaaggucaucaaggggucgcucccccugaucggcgaggccgacugccugcacgagaaguacgggggccucaacaaguccaagcccuacuauaccggggagcacgccaaggccaucggcaacugcccgaucugggugaagacgccccugaagcuggccaacggcaccaaguaccgcccgcccgcgaagcuccugaaggagcggggguucuucggcgccaucgccggguuccuggagggcgggugggagggcaugaucgccggcuggcacggguauaccagccacggcgcccacgggauggcggucgccgccgaccucaaguccacccaggaggccaucaacaagaucaccaagaaccugaacagccuguccgagcucgaggugaagaaucugcagcgccugucgggcgccauggacgagcuccacaacgagauccuggagcuggacgagaagguggacgaccuccgggcggacaccaucuccagccagaucgagcuggccguccugcucuccaaugagggcaucaucaacagcgaggacgagcaccuccuggcccuggagcgcaagcugaagaagaugcuggggcccuccgccguggacaucggcaacgggugcuucgagacgaagcacaaguguaaccagaccugccucgaccggaucgcggccggcaccuucaacgccggggaguucagccugcccaccuucgauucccugaacaucaccgccgccucgcucaacgacgacggccuggacaaccacacgauccugcuguacuauuccaccgcggccagcucccucgccgugacccugaugcuggccaucuucaucgucuacauggugagccgcgacaacguguccugcagcaucugccucuga

SEQ ID NO: 15598 - RNA, 1755 nt, Artificial Sequence; identical to SEQ ID NO: 14116
  derived and/or modified CDS sequence (AUadapt) from InfluenzaB__AHE38014__HA

SEQ ID NO: 15599 - RNA, 1758 nt, Artificial Sequence; identical to SEQ ID NO: 14118
  derived and/or modified CDS sequence (AUadapt) from InfluenzaB__AHE38015__HA

SEQ ID NO: 15600 - RNA, 1758 nt, Artificial Sequence
  derived and/or modified CDS sequence (AUadapt) from InfluenzaB__AHE38016__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugccccaagugccugaauugcaccgaccuggacguggcccucgggcgccccaagugcaccggcaagaucccguccgcccgggugucgauccugcacgagguccgccccgugacguccggcugcuuccccaucaugcacgaccggaccaagauccgccagcugcccaaccuccugcggggguacgagcacauccgccugagcacccacaaugugaucaacgccgagaacgcgccgggcgggcccuacaagaucggcaccuccgggucgugccccaacgucacgaacggcaacggcuucuucgccaccauggccugggccgugcccaagaacgacaagaacaagaccgcgaccaacccgcucacgaucgaggugcccuacaucuguaccgagggggaggaccagaucaccgucuggggcuuccacuccgacaacgagacccagauggccaagcuguacggggacagcaagccccagaaguucacguccucggccaacggcgugaccacccacuacgugucccagaucggcggguuccccaaccagaccgaggauggcgggcugccgcagucgggccggaucgucguggacuacauggugcagaaguccgggaagacgggcaccaucaccuaccagcgcggcauccuccugccccagaaggucuggugcgccagcgggaaguccaaggugaucaagggcucgcugccccucaucggggaggccgacugccugcacgagaaguacggcgggcugaacaagucgaagcccuacuacaccggcgagcaugcgaaggccaucggcaacugcccgaucugggugaagacgccccucaagcuggccaacgggaccaaguaccggccgcccgccaagcugcucaaggagcgcggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagugagcuggaggucaagaaccuccagcggcuguccggcgccauggacgagcugcacaacgagauccucgagcuggacgagaagguggacgaccugcgcgccgacaccaucucgucccagaucgagcucgccgugcugcugagcaacgaggggaucaucaacuccgaggacgagcaccuccuggcgcuggagcggaagcucaagaagaugcugggccccucggccgucgagaucgggaauggcugcuucgagaccaagcacaagugcaaccagaccugccuggaccgcaucgccgccgggaccuucgacgcgggcgaguucucccuccccacguucgacucgcugaacaucaccgccgccucccugaacgaugacggccucgacaaccacaucauccugcuguacuacagcaccgccgccuccucgcuggcggugacccucaugaucgccaucuucguggucuacauggugucccgggacaacgugagcugcuccaucugccuguga

SEQ ID NO: 15601 - RNA, 1758 nt, Artificial Sequence; identical to SEQ ID NO: 14704
  derived and/or modified CDS sequence (AUadapt) from InfluenzaB__AHE38017__HA

SEQ ID NO: 15602 - RNA, 1758 nt, Artificial Sequence; identical to SEQ ID NO: 14124
  derived and/or modified CDS sequence (AUadapt) from InfluenzaB__AHE38018__HA

SEQ ID NO: 15603 - RNA, 1758 nt, Artificial Sequence; identical to SEQ ID NO: 14612
  derived and/or modified CDS sequence (AUadapt) from InfluenzaB__AHE38019__HA

SEQ ID NO: 15604 - RNA, 1758 nt, Artificial Sequence
  derived and/or modified CDS sequence (AUadapt) from InfluenzaB__AHE38020__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaucacccccaccaagagccacuuugccaaccugaaggggaccgagacgcggggcaagcucugccccaagugccugaacugcaccgaccuggacguggcccucgggcgccccaagugcaccggcaagaucccguccgcccgggugucgauccugcacgagguccgccccgugaccuccggcugcuuucccaucaugcacgaccggacgaagauccgccagcugcccaaccuccugcggggguacgagcacauccgccugagcacccacaacgugaucaacgccgaggacgcgccgggcgggcccuacaagaucggcaccuccgggaguugccccaacgucaccaacggcaacggcuucuucgccacgauggccugggccgugcccaagaacgacaagaacaagaccgcgaccaacccgcucaccaucgaggugcccuacaucuguacggagggggaggaccagaucaccgucuggggcuuccacuccgacaacgagacccagauggccaagcuguacggggacagcaagccccagaaguucaccuccucggccaacggcgugacgacccauuacgugucccagaucggcggguuccccaaccagaccgaggacggcgggcugccgcagagcggccggaucgucguggacuacauggugcagaaguccgggaagaccggcacgaucaccuaccagcgcggcauccuccugccccagaaggucuggugcgccucggggcgguccaaggugaucaagggcagccugccccucaucggggaggccgauugccugcacgagaaguacggcgggcugaacaagucgaagcccuacuacaccggcgagcacgcgaaggccaucggcaacugcccgaucugggugaagacgccccucaagcuggccaacgggaccaaguaucgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucaccaagaaccucaacucccugagugagcuggaggucaagaaccuccagcgccuguccggcgccauggacgagcugcacaacgagauccucgagcuggacgagaagguggacgaccugcgggccgacacgaucucgucccagaucgagcucgccgugcugcugagcaacgaggggaucaucaauuccgaggacgagcaccuccuggcgcuggagcgcaagcucaagaagaugcugggccccucggccgucgagaucgggaacggcugcuucgagaccaagcacaagugcaaccagaccugccuggaccggaucgccgccgggaccuuugacgcgggcgaguucucccuccccaccuucgacagccugaacaucacggccgccucccugaacgacgacggccucgacaaccauaccauccugcuguacuacucgaccgccgccuccagccuggcggugacccucaugaucgccaucuucguggucuacauggugucccgcgacaacgugagcugcuccaucugccuguga

SEQ ID NO: 15605 - RNA, 1758 nt, Artificial Sequence
  derived and/or modified CDS sequence (AUadapt) from InfluenzaB__AHE38021__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaucugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcaugaccggaccaagauccgccagcugcccaaccuccugcggggguacgagcacauccgccugucgacccacaacgugaucaacgccgagaacgcgccgggcgggcccuacaagaucggcaccuccgggagcugucccaacgucacgaacggcaacggcuucuucgccaccauggccugggccgugcccaagaacgacaagaacaagaccgcgaccaacccgcucacgaucgaggugcccuacaucugcaccgagggggaggaucagaucaccgucuggggcuuccacuccgacaacgagacccagauggccaagcuguacggggacucgaacccccagaaguucacguccagcgccaacggcgugaccacccauuacgugucccagaucggcggguuccccaaccagaccgaggacggcgggcugccgcagucgggccggaucgucguggacuacauggugcagaaguccgggaagacgggcaccaucaccuaccagcgcggcauccuccugccccagaaggucuggugcgccagcgggcgguccaaggugaucaagggcucgcugccccucaucggggaggccgauugccugcacgagaaguacggcgggcugaacaagagcaagcccuacuacaccggcgagcacgcgaaggccaucggcaacugcccgaucugggugaagacgccccucaagcuggccaacgggaccaaguaucgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagugagcuggaggucaagaaccuccagcgccuguccggcgccauggacgagcugcacaacgagauccucgagcuggacgagaagguggacgaccugcgggccgacaccaucagcucccagaucgagcucgccgugcugcugucgaacgaggggaucaucaauuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuuugacgcgggcgaguucucccuccccacguucgacucgcugaacaucaccgccgccucccugaacgacgacggccucgacaaccauaccauccugcuguacuacagcaccgccgccuccucgcuggcggugacgcucaugaucgccaucuucguggucuacauggugucccgcgacaacgugagcugcuccaucugccuguga

SEQ ID NO: 15606 - RNA, 1758 nt, Artificial Sequence; identical to SEQ ID NO: 14124
  derived and/or modified CDS sequence (AUadapt) from InfluenzaB__AHE38022__HA

SEQ ID NO: 15607 - RNA, 1752 nt, Artificial Sequence
  derived and/or modified CDS sequence (AUadapt) from InfluenzaB__AHL91189__HA
augaaggccaucaucgugcugcucauggucgccaccaguaacgcggaccgcaucugcaccggcaucacguccagcaacagcccccauguggugaagaccgccacccagggggaggucaacgugaccggcgugaucucccugacgaccaccccgaccaagucccacuucgccaaccugaaggggacgaagacccggggcaagcucugccccaacugucugaacugcaccgaccuggacgucgcccucgggcgccccaucugcaucggcaccauccccagcgccaaggcguccauccugcaugaggugcggccggugacgagcggcugcuuccccaucaugcacgaccgcaccaagauccggcagcugcccaaccuccugcgcggguacgagcauauccggcuguccacccacaacgucaucaacgccgagcgcgcccccggcgggccguaccggcucggcaccagcggguccugccccaaugugacgagccgcuccggcuucuucgccaccauggcgugggccgugccccgggacaacaagaccgccaccaacccccugacggucgaggugccguauaucugcaccaagggcgaggaccagaucaccguguggggguuccacagcgacaauaagacccagaugaagaaccuguacggcgacuccaacccccagaaguucacgagcuccgccaacggggucaccacccauuacgugagccagaucggcggcuuccccaaccagaccgaggacgggggccucccccaguccgggcgcaucguggucgacuauauggugcagaagccgggcaagacggggaccaucguguaccagcggggcguccugcugccccagaagguguggugcgccagcggccgcucgaaggugaucaaggggucccucccccugaucggcgaggcggacugccugcaugagaaguacgggggccucaacaagagcaagcccuacuacaccggggagcacgccaaggccaucggcaauugcccgaucugggucaagacgccccugaagcuggccaacggcaccaaguaccggccgcccgccaagcuccugaaggagcgcggguucuucggcgcgaucgccggguuccuggagggcgggugggagggcaugaucgccggcuggcacggguauaccucccacggcgcccacgggguggccgucgcggccgaccucaagagcacccaggaggccaucaacaagaucaccaagaaccugaauucccugagcgagcucgaggugaagaaccugcagcggcuguccggcgccauggacgagcuccacaacgagauccuggagcuggacgagaagguggaugaccuccgcgccgacacgaucagcucccagaucgagcuggcgguccugcucagcaacgagggcaucaucaacuccgaggaugagcaccuccuggcccuggagcggaagcugaagaagaugcuggggcccagcgccguggacaucggcaacgggugcuucgagaccaagcacaaguguaaccagaccugccucgaccgcaucgccgcgggcaccuucaacgccggggaguucucccugcccaccuuugacagccugaacaucacggccgccucccucaacgacgacggccuggauaaccacaccauccugcuguacuacagcaccgccgcguccagccucgccgugacccugaugaucgccaucuuuaucgucuacauggugucccgggacaacgugagcugcagcaucugccuguga

SEQ ID NO: 15608 - RNA, 1752 nt, Artificial Sequence
  derived and/or modified CDS sequence (AUadapt) from InfluenzaB__AHL91200__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaagucccacuucgccaaccugaaggggacgaagacccggggcaagcucugccccaacugccugaauugcaccgaccuggacguggcccucgggcgccccaugugcaucggcaccaucccguccgccaaggccagcauccugcacgaggugcggcccgucacguccggcuguuuccccaucaugcacgaccgcaccaagauccggcagcugcccaaccuccugcgcggguacgagcacauccggcugagcacccauaacgugaucaacgcggagcgcgccccgggcgggcccuaccggcucggcaccuccgggagcugccccaacgugacgucccgcagcggcuuuuucgccaccauggccugggcggucccccgggacaacaagaccgccaccaacccgcugacgguggaggugcccuacaucugcaccaagggcgaggaucagaucaccgucuggggguuccacuccgacaacaagacccagaugaagaaccuguacggcgacaguaacccccagaaguucacguccagcgccaacggggugaccacccacuacgugucccagaucggcgacuuucccaaccagaccgaggacggcgggcucccgcagagcggccgcaucgucguggacuacauggugcagaagcccgggaagacgggcaccaucgucuaccagcgcggggugcugcugccccagaagguguggugugccuccggccggagcaaggucaucaagggcucgcucccccugaucggggaggccgacugccugcacgagaaguacggcgggcucaacaaguccaagccguauuacaccggcgagcacgcgaaggccaucgggaacugccccaucugggugaagacgccccugaagcuggccaacggcaccaaguaccggcccccggccaagcuccugaaggagcgcggcuuuuucggggccaucgcgggcuuccuggagggcgggugggaggggaugaucgccggcuggcacggcuacaccagccacggggcccacggcgucgccguggccgcggaucucaaguccacccaggaggccaucaacaagaucaccaagaaccugaacagccuguccgagcucgaggugaagaaccugcagcggcugagcggggccauggacgagcuccauaacgagauccuggagcuggacgagaaggucgacgaccuccgcgccgacacgaucuccagccagaucgagcuggccgugcugcucuccaaugagggcaucaucaacagcgaggacgagcaccuccuggcgcuggagcggaagcugaagaagaugcugggccccuccgccguggacaucgggaacggcugcuuugagaccaagcacaagugcaaccagaccugccucgaccgcaucgccgccgggaccuucaacgcgggcgaguuuagccugcccaccuucgacucccugaacaucacggccgccagccucaacgaugacgggcuggacaaccacaccauccugcuguacuacuccaccgccgccagcucccucgcggucacccugaugaucgccaucuuuaucguguacauggugagccgggacaacgucuccugcagcaucugccuguga

SEQ ID NO: 15609 - RNA, 1752 nt, Artificial Sequence
  derived and/or modified CDS sequence (AUadapt) from InfluenzaB__AHL91211__HA
augaaggccaucaucgugcugcucauggucgccaccaguaacgcggaccgcaucugcaccggcaucacguccagcaacagcccccauguggugaagaccgccacccagggggaggucaacgugaccggcgugaucucccugacgaccaccccgaccaagucccacuucgccaaccugaaggggacgaagacccggggcaagcucugccccaacugucugaacugcaccgaccuggacgucgcccucgggcgccccaugugcaucggcaccauccccagcgccaaggcguccauccugcaugaggugcggccggugacgagcggcugcuuccccaucaugcacgaccgcaccaagauccggcagcugcccaaccuccugcgcggguacgagcauauccggcuguccacccacaacgucaucaacgccgagcgcgcccccggcgggccguaccggcucggcaccagcggguccugccccaaugugacgagccgcuccggcuucuucgccaccauggcgugggccgugccccgggacaacaagaccgccaccaacccccugacggucgaggugccguauaucugcaccaagggcgaggaccagaucaccguguggggguuccacagcgacaauaagacccagaugaagaaccuguacggcgacuccaacccccagaaguucacgagcuccgccaacggggucaccacccauuacgugagccagaucggcggcuuccccaaccagaccgaggacgggggccucccccaguccgggcgcaucguggucgacuauauggugcagaagccgggcaagacggggaccaucguguaccagcggggcguccugcugccccagaagguguggugcgccagcggccgcucgaaggugaucaaggggucccucccccugaucggcgaggcggacugccugcaugagaaguacgggggccucaacaagagcaagcccuacuacaccggggagcacgccaaggccaucggcaauugcccgaucugggucaagacgccccugaagcuggccaacggcaccaaguaccggccgcccgccaagcuccugaaggagcgcggguucuucggcgcgaucgccggguuccuggagggcgggugggagggcaugaucgccggcuggcacggguauaccucccacggcgcccacgggguggccgucgcggccgaccucaagagcacccaggaggccaucaacaagaucaccaagaaccugaauucccugagcgagcucgaggugaagaaccugcagcggcuguccggcgccauggacgagcuccacaacgagauccuggagcuggacgagaagguggaugaccuccgcgccgacacgaucagcucccagaucgagcuggcgguccugcucagcaacgagggcaucaucaacuccgaggaugagcaccuccuggcccuggagcggaagcugaagaagaugcuggggcccagcgccguggacaucggcaacgggugcuucgagaccaagcacaaguguaaccagaccugccucgaccgcaucgccgcgggcaccuucaacgccggggaguucucccugcccaccuuugacagccugaacaucacggccgccucccucaacgacgacggccuggauaaccacaccauccugcuguacuacagcaccgccgcguccagccucgccgugacccugaugaucgccaucuuuaucgucuacauggugucccgggacaacgugagcugcagcaucugccuguga

SEQ ID NO: 15610 - RNA, 1755 nt, Artificial Sequence
  derived and/or modified CDS sequence (AUadapt) from InfluenzaB__AHL91222__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaagucccacuucgccaaccugaaggggacgaagacccggggcaagcucugccccaacugucugaacugcaccgaccuggacguggcccucgggcgccccaugugcgugggcaccacgccguccgccaaggccagcauccugcaugagguccggcccgugaccuccggcugcuuccccaucaugcacgaccgcaccaagauccggcagcugcccaaccuccugcgcggguacgagaauauccggcugagcacccagaacgugaucaacgcggagaaggccccgggcgggcccuaccgccucggcacguccgggagcugccccaacgccaccucccggaguggcuucuucgccaccauggcgugggccgucccccgcgacaacaacaagaccgccacgaacccgcugaccguggaggugcccuaugucugcaccgagggcgaggaccagaucaccguguggggguuccacuccgacaacaagacgcagaugaagaaucuguacggcgacucgaacccccagaaguucaccuccagcgccaauggggugaccacccacuacgucucccagaucggcggcuuccccgaccagacggaggacgggggccucccgcagagcgggcggaucgugguggauuacaugguccagaagcccggcaagaccgggaccaucguguaccagcgcggcgugcugcugccccagaaggucuggugcgccuccggccggagcaaggugaucaaggggagccucccccugaucggcgaggcggacugccugcaugagaaguacgggggccucaacaaguccaagccguacuacaccggggagcacgccaaggccaucggcaacugucccaucugggucaagacgccccugaagcuggccaacggcaccaaguaccggcccccggccaagcuccugaaggagcgcggguucuucggcgcgaucgccggguuccuggagggcgggugggagggcaugaucgccggcuggcacggguauaccagccacggcgcccacgggguggccguggcggccgaccucaaguccacccaggaggccaucaacaagaucacgaagaaccugaauagccuguccgagcucgaggucaagaaccugcagcgccugucgggcgccauggacgagcuccacaacgagauccuggagcuggaugagaagguggacgaccuccgggccgacaccaucuccagccagaucgagcuggcggugcugcucuccaacgagggcaucaucaacagcgaggaugagcaccuccuggcccuggagcgcaagcugaagaagaugcuggggcccuccgccgucgacaucggcaacgggugcuucgagaccaagcacaaguguaaccagaccugccucgaccggaucgccgcgggcaccuucaacgccggggaguucagucugcccacguucgacucccugaacaucaccgccgccagccucaacgacgauggccuggacaaccacaccauccugcuguacuacuccaccgccgcgagcucccucgccgugacgcugaugaucgccaucuuuaucguguacauggucagccgcgacaacaucuccugcagcaucugccuguga

SEQ ID NO: 15611 - RNA, 1755 nt, Artificial Sequence
  derived and/or modified CDS sequence (AUadapt) from InfluenzaB__AHL91244__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaagucccacuucgccaaccugaaggggacgaagacccggggcaagcucugcccgaccugccugaauugcaccgaccuggacguggcccucgggcgccccaugugcgugggcacgacccccuccgccaaggccagcauccugcacgagguccggcccgugaccuccggcugcuuucccaucaugcacgaccgcaccaagauccggcagcugcccaaccuccugcgcggguacgagaagauccggcugagcacgcagaacgugaucaaugcggagaaggccccgggcgggcccuaccgccucggcaccuccgggucgugccccaacgccaccucccggagcggcuucuucgccaccauggcgugggccgucccccgcgauaacaacaagacggccaccaacccgcugaccguggaggugcccuacaucugcaccaaggaggaggaccagaucacggucuggggcuuucacuccgacaacaagacccagaugaagaaccuguacggggacagcaauccccagaaguucaccuccagcgccaacggcgugaccacgcacuacgugucccagaucgggggcuuccccgaucagaccgaggacggcgggcucccgcagagcggccggaucgucguggacuacauggugcagaagcccgggaagaccggcaccaucgucuaccagcgcggggugcugcugccccagaagguguggugcgccuccggccggagcaaggucaucaagggcagucucccccugaucggggaggcggacugccugcacgagaaguacggcgggcucaacaaguccaagccguacuauacgggcgagcacgccaaggccaucgggaacugccccaucugggugaagacgccccugaagcuggccaacggcaccaaguaccggcccccggccaagcuccugaaggagcgcggcuucuucggggcgaucgccggcuuucuggagggcgggugggaggggaugaucgccggcuggcacggcuacaccagccacggggcccacggcgucgccguggcggccgaccucaaguccacccaggaggccaucaauaagaucaccaagaaccugaacagccuguccgagcucgaggugaagaaccugcagcgccugagcggggccauggacgagcuccacaaugagauccuggagcuggacgagaaggucgacgaccuccgggccgacaccaucuccagccagaucgagcuggcggugcugcucuccaacgagggcaucaucaauucggaggacgagcaccuccuggcccuggagcgcaagcugaagaagaugcugggccccuccgccguggacaucgggaacggcugcuucgagaccaagcauaagugcaaccagaccugccucgaccggaucgccgcggggacguucaacgccggcgaguuuagccugcccaccuucgacucccugaacaucaccgccgccagccucaacgacgaugggcuggacaaccacaccauccugcuguacuacuccacggccgcgagcucccucgccgucacccugaugaucgccaucuuuaucguguacauggugagccgcgacaacgucuccugcagcaucugccuguga

SEQ ID NO: 15612 - RNA, 1755 nt, Artificial Sequence; identical to SEQ ID NO: 14241
  derived and/or modified CDS sequence (AUadapt) from InfluenzaB__AHL91255__HA

SEQ ID NO: 15613 - RNA, 1755 nt, Artificial Sequence; identical to SEQ ID NO: 14241
  derived and/or modified CDS sequence (AUadapt) from InfluenzaB__AHL91266__HA

SEQ ID NO: 15614 - RNA, 1752 nt, Artificial Sequence
  derived and/or modified CDS sequence (AUadapt) from InfluenzaB__AHL91277__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaagucccacuucgccaaccugaaggggacgaagacccggggcaagcucugccccaacugccugaauugcaccgaccuggacguggcccucgggcgccccaugugcaucggcaucaccccguccgccaaggccagcauccugcacgaggugcggcccgucacguccggcuguuuccccaucaugcacgaccgcaccaagauccggcagcugcccaaccuccugcgcggguacgagcacauccggcugagcacccauaacgugaucaacgcggagcgcgccccgggcgggcccuaccggcucggcaccuccgggagcugccccaacgugacgucccgcaguggcuucuucgccaccauggccugggcggucccccgggacaacaagaccgccaccaacccgcugacgguggaggugcccuacaucugcaccaagggcgaggaucagaucaccgucuggggguuccacuccgacaacaagacccagaugaagaaccuguacggcgacaguaacccccagaaguucacguccagcgccaacgggaucaccacccacuacgugucccagaucggcggcuuucccaaccagaccgaggacgggggccucccgcagagcgggcgcaucguggucgacuacauggugcagaagcccggcaagacggggaccaucguguaccagcggggcguccugcugccccagaagguguggugcgccuccggccgcaguaaggugaucaaggggucgcucccccugaucggcgaggccgacugccugcacgagaaguacgggggccucaacaaguccaagccguauuacaccggggagcacgcgaaggccaucggcaacugccccaucugggucaagacgccccugaagcuggccaacggcaccaaguaccggcccccggccaagcuccugaaggagcgcggguucuuuggcgccaucgcgggguuccuggagggcgggugggagggcaugaucgccggcuggcacggguacaccagccacggcgcccacgggguggccgucgccgcggaucucaaguccacccaggaggccaucaacaagaucaccaagaaccugaacagccuguccgagcucgaggugaagaaccugcagcggcugagcggcgccauggacgagcuccauaacgagauccuggagcuggacgagaagguggacgaccuccgcgccgacacgaucuccagccagaucgagcuggccguccugcucuccaacgagggcaucaucaauagcgaggacgagcaccuccuggcgcuggagcggaagcugaagaagaugcuggggcccuccgccguggacaucggcaacgggugcuuugagaccaagcacaagugcaaccagaccugccucgaccgcaucgccgccggcaccuucaacgcgggggaguuuagccugcccaccuucgacucccugaacaucacggccgccagccucaacgaugacggccuggacaaccacaccauccugcuguacuacuccaccgccgccagcucccucgcggugacccugaugaucgccaucuuuaucgucuacauggugagccgggacaacguguccugcagcaucugccuguga

SEQ ID NO: 15615 - RNA, 1755 nt, Artificial Sequence
  derived and/or modified CDS sequence (AUadapt) from InfluenzaB__AHL91299__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccacccggucccacuucgccaaccugaaggggacgaagacccgcggcaagcucugcccgaccugccugaauugcaccgaccuggacguggcccucgggcggcccaugugcgugggcacgacccccuccgccaaggccagcauccugcacgagguccgccccgugaccuccggcugcuuucccaucaugcacgaccggaccaagauccgccagcugcccaaccuccugcggggguacgagaagauccgccugagcacgcagaacgugaucaaugcggagaaggccccgggcgggcccuaccggcucggcaccuccgggucgugccccaacgccaccucccgcagcggcuucuucgccaccauggcgugggccgucccccgggauaacaacaagacggccaccaacccgcugaccguggaggugcccuacaucugcaccaaggaggaggaccagaucacggucuggggcuuucacuccgacaacaagacccagaugaagaaccuguacggggacagcaauccccagaaguucaccuccagcgccaacggcgugaccacgcacuacgugucccagaucgggggcuuccccgaucagaccgaggacggcgggcucccgcagagcggccgcaucgucguggacuacauggugcagaagcccgggaagaccggcaccaucgucuaccagcgggggauccugcugccccagaagguguggugcgccuccggccgcagcaaggugaucaagggcagucucccccugaucggggaggcggacugccugcacgagaaguacggcgggcucaacaaguccaagccguacuauacgggcgagcacgccaaggccaucgggaacugccccaucugggucaagacgccccugaagcuggccaacggcaccaaguaccggcccccggccaagcuccugaaggagcgcggcuucuucggggcgaucgccggcuuucuggagggcgggugggaggggaugaucgccggcuggcacggcuacaccagccacggggcccacggcguggccgucgcggccgaccucaaguccacccaggaggccaucaauaagaucaccaagaaccugaacagccuguccgagcucgaggugaagaaccugcagcggcugagcggggccauggacgagcuccacaaugagauccuggagcuggacgagaagguggacgaccuccgcgccgacaccaucuccagccagaucgagcuggcgguccugcucuccaacgagggcaucaucaauucggaggacgagcaccuccuggcccuggagcggaagcugaagaagaugcugggccccuccgccguggacaucgggaacggcugcuucgagaccaagcauaagugcaaccagaccugccucgaccgcaucgccgcggggacguucaacgccggcgaguuuagccugcccaccuucgacucccugaacaucaccgccgccagccucaacgacgaugggcuggacaaccacaccauccugcuguacuacuccacggccgcgagcucccucgccgugacccugaugaucgccaucuuuaucgucuacaugaucagccgggacaacguguccugcagcaucugccuguga

SEQ ID NO: 15616 - RNA, 1755 nt, Artificial Sequence
  derived and/or modified CDS sequence (AUadapt) from InfluenzaB__AHL91310__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaagucccacuucgccaaccugaaggggacgaagacccggggcaagcucugcccgaccugccugaacugcaccgaucuggacguggcccucgggcgccccaugugcgugggcacgacccccuccgccaaggccucgauccugcacgagguccggcccgugaccuccggcugcuuccccaucaugcacgaccgcaccaagauccggcagcugcccaaucuccugcgcggguacgagaagauccggcugagcacgcagaacgugaucaacgcggagaaggccccgggcgggcccuaccgccucggcaccuccgggagcugccccaaugccaccucccggagcggcuucuucgccaccauggcgugggccgucccccgcgacaacaacaagacggccaccaacccgcugaccguggaggugcccuauaucugcaccaaggaggaggaccagaucacggucuggggcuuccacuccgacaacaagacccagaugaagaaccuguacggggauucgaacccccagaaguucaccuccagcgccaacggcgugaccacgcacuacgugucccagaucgggggcuuucccgaccagaccgaggacggcgggcucccgcagagcggccggaucgucguggacuacauggugcagaagcccgggaagaccggcaccaucgucuaccagcgcgggauccugcugccccagaagguguggugcgccuccggccggaguaaggugaucaagggcucgcucccccugaucggggaggcggacugccugcacgagaaguacggcgggcucaacaaguccaagccguacuacacgggcgagcaugccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcauggcuacaccagccacggggcccacggcguggccgucgcggccgaccucaaguccacccaggaggccaucaacaagaucaccaagaaccugaauagccuguccgagcucgaggugaagaaccugcagcgccugucgggggccauggacgagcuccacaacgagauccuggagcuggacgagaagguggacgaucuccgggccgacaccaucuccagccagaucgagcuggcgguccugcucuccaacgagggcaucaucaacagcgaggacgagcaccuccuggcccuggagcgcaagcugaagaagaugcugggccccuccgccguggauaucgggaacggcugcuucgagaccaagcacaagugcaaccagaccugccucgaucggaucgccgcggggacguucaacgccggcgaguucagccugcccaccuucgacucccugaacaucaccgccgccucgcucaaugacgacgggcuggacaaccacaccauccugcuguacuacuccacggccgcgaguucccucgccgugacccugaugaucgccaucuucaucgucuacaugaucagccgcgacaacguguccugcagcaucugccuguga

SEQ ID NO: 15617 - RNA, 1755 nt, Artificial Sequence
  derived and/or modified CDS sequence (AUadapt) from InfluenzaB__AHL91321__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaagucccacuucgccaaccugaaggggacgaagacccggggcaagcucugcccgaccugccugaacugcaccgaucuggacguggcccucgggcgccccaugugcgugggcacgacccccuccgccaaggccucgauccugcacgagguccggcccgugaccuccggcugcuuccccaucaugcacgaccgcaccaagauccggcagcugcccaaucuccugcgcggguacgagaagauccggcugagcacgcagaacgugaucaacgcggagaaggccccgggcgggcccuaccgccucggcaccuccgggagcugccccaaugccaccucccggagcggcuucuucgccaccauggcgugggccgucccccgcgacaacaacaagacggccaccaacccgcugaccguggaggugcccuauaucugcaccaaggaggaggaccagaucacggucuggggcuuccacuccgacaacaagacccagaugaagaaccuguacggggauucgaacccccagaaguucaccuccagcgccaacggcgugaccacgcacuacgugucccagaucgggggcuuucccgaccagaccgaggacggcgggcucccgcagagcggccggaucgucguggacuacauggugcagaagcccgggaagaccggcaccaucgucuaccagcgcggggugcugcugccccagaagguguggugcgccuccggccggaguaaggucaucaagggcucgcucccccugaucggggaggcggacugccugcacgagaaguacggcgggcucaacaaguccaagccguacuacacgggcgagcaugccaaggccaucgggaacugccccaucugggugaagacgccccugaagcuggccaacggcaccaaguaccggcccccggccaagcuccugaaggagaagggcuucuucggggcgaucgccggcuuccuggagggcgggugggaggggaugaucgccggcuggcauggcuacaccagccacggggcccacggcgucgccguggcggccgaccucaaguccacccaggaggccaucaacaagaucaccaagaaccugaauagccuguccgagcucgaggugaagaaccugcagcgccugucgggggccauggacgagcuccacaacgagauccuggagcuggacgagaaggucgacgaucuccgcgccgacaccaucuccagccagaucgagcuggcggugcugcucuccaacgagggcaucaucaacagcgaggacgagcaccuccuggcccuggagcggaagcugaagaagaugcugggccccuccgccguggauaucgggaacggcugcuucgagaccaagcacaagugcaaccagaccugccucgaucgcaucgccgcggggacguucaacgccggcgaguucagccugcccaccuucgacucccugaacaucaccgccgccucgcucaaugacgacgggcuggacaaccacaccauccugcuguacuacuccacggccgcgaguucccucgccgucacccugaugaucgccaucuucaucguguacauggugagccgggacaacgucuccugcagcaucugccuguga

SEQ ID NO: 15618 - RNA, 1755 nt, Artificial Sequence; identical to SEQ ID NO: 15616
  derived and/or modified CDS sequence (AUadapt) from InfluenzaB__AHL91332__HA

SEQ ID NO: 15619 - RNA, 1755 nt, Artificial Sequence; identical to SEQ ID NO: 15616
  derived and/or modified CDS sequence (AUadapt) from InfluenzaB__AHL91343__HA

SEQ ID NO: 15620 - RNA, 1755 nt, Artificial Sequence; identical to SEQ ID NO: 15616
  derived and/or modified CDS sequence (AUadapt) from InfluenzaB__AHL91354__HA

SEQ ID NO: 15621 - RNA, 1755 nt, Artificial Sequence; identical to SEQ ID NO: 14219
  derived and/or modified CDS sequence (AUadapt) from InfluenzaB__AHL91365__HA

SEQ ID NO: 15622 - RNA, 1755 nt, Artificial Sequence
  derived and/or modified CDS sequence (AUadapt) from InfluenzaB__AHL91376__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacggccacccccaccaagucccacuucgccaaccugaaggggaccaagacgcggggcaagcucugcccgaccugccugaauugcaccgaccuggacguggcccucgggcgccccaugugcgugggcgucacccccuccgccaaggcgagcauccugcacgaggugcggcccgugacguccggcugcuuucccaucaugcacgaccgcaccaagauccggcagcugcccaaccuccugcgcggguacgagaagauccggcugagcacccagaacgucaucaaugccgagaaggccccgggcgggcccuaccgccucggcaccuccgggucgugccccaacgccacgucccggagcggcuucuucgcgaccauggccugggccgugccccgcgauaacaacaagaccgccaccaacccgcugacgguggaggucccccacaucugcaccaaggaggaggaccagaucaccguguggggcuuucacuccgacaacaagacccagaugaagaaccuguacggggacagcaauccccagaaguucacguccagcgccaacggcgugaccacccacuacgucucccagaucgggggcuuccccgaucagaccgaggacggcgggcucccgcagagcggccggaucgugguggacuacaugguccagaagcccgggaagacgggcaccaucguguaccagcgcgggauccugcugccccagaagguguggugcgcguccggccggagcaaggucaucaagggcagucucccccugaucggggaggccgacugccugcacgagaaguacggcgggcucaacaaguccaagccguacuauaccggcgagcacgccaaggccaucgggaacugccccaucugggugaagacgccccugaagcuggccaacggcaccaaguaccggcccccggcgaagcuccugaaggagcgcggcuucuucggggccaucgccggcuuucuggagggcgggugggaggggaugaucgccggcuggcacggcuacaccagccacggggcccacggcgucgcgguggccgccgaccucaaguccacccaggaggccaucaauaagaucaccaagaaccugaacagccuguccgagcucgaggugaagaaccugcagcgccugagcggggccauggacgagcuccacaaugagauccuggagcuggacgagaaggucgacgaccuccgggcggacacgaucuccagccagaucgagcuggccgugcugcucuccaacgagggcaucaucaauucggaggacgagcaccuccuggcccuggagcgcaagcugaagaagaugcugggccccuccgccguggacaucgggaacggcugcuucgagaccaagcauaagugcaaccagaccugccucgaccggaucgcggccgggaccuucaacgccggcgaguuuagccugcccaccuucgacucccugaacaucacggccgccagccucaacgacgaugggcuggacaaccacaccauccugcuguacuacuccaccgcggccagcucccucgccgucacccugaugaucgccaucuuuaucguguacaugaucagccgcgacaacguguccugcagcaucugccuguga

SEQ ID NO: 15623 - RNA, 1755 nt, Artificial Sequence
  derived and/or modified CDS sequence (AUadapt) from InfluenzaB__AHL91387__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccgccaagucccacuucgccaaccugaaggggaccaagacgcggggcaagcucugcccgaccugccugaauugcaccgaccuggacguggcccucgggcgccccaugugcgugggcgucacccccuccgccaaggcgagcauccugcacgaggugcggcccgugacguccggcugcuuucccaucaugcacgaccgcaccaagauccggcagcugcccaaccuccugcgcggguacgagaagauccggcugagcacccagaacgucaucaaugccgagaaggccccgggcgggcccuaccgccucggcaccuccgggucgugccccaacgccacgucccggagcggcuucuucgcgaccauggccugggccgugccccgcgauaacaacaagaccgccaccaacccgcugacgguggaggucccccacaucugcaccaaggaggaggaccagaucaccguguggggcuuucacuccgacaacaagacccagaugaagaaccuguacggggacagcaauccccagaaguucacguccagcgccaacggcgugaccacccacuacgucucccagaucgggggcuuccccgaucagaccgaggacggcgggcucccgcagagcggccggaucgugguggacuacaugguccagaagcccgggaagacgggcaccaucguguaccagcgcgggauccugcugccccagaagguguggugcgcguccggccggagcaaggucaucaagggcagucucccccugaucggggaggccgacugccugcacgagaaguacggcgggcucaacaaguccaagccguacuauaccggcgagcacgccaaggccaucgggaacugccccaucugggugaagacgccccugaagcuggccaacggcaccaaguaccggcccccggcgaagcuccugaaggagcgcggcuucuucggggccaucgccggcuuucuggagggcgggugggaggggaugaucgccggcuggcacggcuacaccagccacggggcccacggcgucgcgguggccgccgaccucaaguccacccaggaggccaucaauaagaucaccaagaaccugaacagccuguccgagcucgaggugaagaaccugcagcgccugagcggggccauggacgagcuccacaaugagauccuggagcuggacgagaaggucgacgaccuccgggcggacacgaucuccagccagaucgagcuggccgugcugcucuccaacgagggcaucaucaauucggaggacgagcaccuccuggcccuggagcgcaagcugaagaagaugcugggccccuccgccguggacaucgggaacggcugcuucgagaccaagcauaagugcaaccagaccugccucgaccggaucgcggccgggaccuucaacgccggcgaguuuagccugcccaccuucgacucccugaacaucacggccgccagccucaacgacgaugggcuggacaaccacaccauccugcuguacuacuccaccgcggccagcucccucgccgucacccugaugaucgccaucuuuaucguguacaugaucagccgcgacaacguguccugcagcaucugccuguga

SEQ ID NO: 15624 - RNA, 1755 nt, Artificial Sequence
  derived and/or modified CDS sequence (AUadapt) from InfluenzaB__AHL91409__HA
augaaggccaucaucgugcugcucauggucgugaccaguaacgccgaccgcaucugcaccggcaucacguccagcgacagcccccauguggucaagaccgcgacccagggggaggugaacgugaccggcgccaucccgcugacgaccacccccaccaaguccuacuucgccaaccugaaggggacgaagacccggggcaagcucugcccgaccugccugaacuguaccgaccuggacgucgcccucgggcgccccaugugcgugggcaucacgcccuccgccaaggcgagcauccugcacgaggugcggcccgucaccuccggcugcuuccccaucaugcaugaccgcaccaagauccggcagcugcccaaccuccugcgcggguacgagaagauccggcugucgacccagaacgugaucaacgccgagaaggccccgggcgggcccuaccgccucggcacguccgggaguugccccaacgccaccucccggagcggcuucuucgcgaccauggccugggccgugccccgcgacaacaauaagaccgccacgaacccgcugaccgucgaggugccccacaucugcaccaaggaggaggaccagaucaccguguggggcuuccacuccgacaauaagacgcagaugaagaaccuguacggggacagcaacccccagaaguucaccuccucggccaauggcaucaccacccacuacgucucccagaucgggggcuuccccgaccagacggaggacggcgggcucccgcagagcggccggaucgugguggacuauaugguccagaagcccgggaagaccggcaccaucguguaccagcgcgggauccugcugccccagaagguguggugcgcguccggccggagcaaggucaucaagggcagccucccccugaucggggaggccgacugccugcacgagaaguauggcgggcucaacaaguccaagccguacuacaccggcgagcacgccaaggccaucgggaacugccccaucugggugaagacgccccugaagcuggccaauggcaccaaguaccggcccccggcgaagcuccugaaggagcgcggcuucuucggggccaucgccggcuuccuggagggcgggugggaggggaugguggccggcuggcacggcuacaccagccauggggcccacggcgucgcgguggccgccgaccucaaguccacccaggaggccaucaacaagaucacgaagaaccugaacucgcuguccgagcucgaggucaagaaccugcagcgccugaguggggccauggacgagcuccacaacgagauccuggagcuggacgagaagguggacgaccuccgggcggacaccaucuccagucagaucgagcuggccgugcugcucuccaacgagggcaucaucaacagcgaggacgagcaccuccuggcccuggagcgcaagcugaagaagaugcugggccccuccgccgucgacaucgggaacggcuguuucgagaccaagcacaagugcaaccagaccugccucgaccggaucgcggccgggaccuucaaugccggcgaguucucgcugcccacguucgacucccugaacaucaccgccgccagccucaacgaugacgggcuggacaaccacaccauccugcuguacuacuccaccgcggccagcucccucgccgugacgcugaugaucgccaucuuuaucguguacaugaucagccgcgacaacgucuccugcagcaucugccuguga

SEQ ID NO: 15625 - RNA, 1755 nt, Artificial Sequence
  derived and/or modified CDS sequence (AUadapt) from InfluenzaB__AHL91431__HA
augaaggccaucaucgugcugcucauggucgugaccaguaacgccgaccgcaucugcaccggcaucacguccagcaacucgccccacguggucaagaccgcgacccagggggaggugaacgugaccggcgccaucccgcugacgaccacccccaccaagucccacuuugccaaccugaaggggacgaagacccggggcaagcucugcccgaccugccugaacugcaccgaccuggacgucgcccucgggcgccccaugugcgugggcaucacgcccuccgccaaggcgagcauccugcaugaggugcggcccgucaccuccggcugcuuccccaucaugcacgaccgcaccaagauccggcagcugcccaaccuccugcgcggguacgagaagauccggcugagcacccagaacgugaucaacgccgagaaggccccgggcgggcccuaucgccucggcacguccgggucgugccccaacgccaccuccaagagcggcuucuucgcgaccauggccugggccgugccccgggacaacaacaagaccgccacgaauccgcugaccgucgaggugccccacaucugcaccaaggaggaggaccagaucaccguguggggcuuccacuccgacaacaagacgcagaugaagaaccuguacggggauucgaacccccagaaguucaccuccagcgccaacggcaucaccacccacuacgucucccagaucgggggcuuccccgaccagacggaggauggcgggcucccgcagagcggccgcaucgugguggacuacaugguccagaagcccgggaagaccggcaccaucguguaccagcgggggauccugcugccccagaagguguggugcgcguccggccgcucgaaggucaucaagggcagccucccccugaucggggaggccgacugccugcacgagaaguauggcgggcucaacaaguccaagccguacuacaccggcgagcacgccaaggccaucgggaacugccccaucugggugaagacgccccugaagcuggccaacggcaccaaguaccggcccccggcgaagcuccugaaggagcgcggcuucuuuggggccaucgccggcuuccuggagggcgggugggaggggaugaucgccggcuggcacggcuacaccagccacggggcccacggcguggcggucgccgccgaccucaaguccacccaggaggccaucaacaagaucacgaagaaccugaauuuccugucggagcucgaggugaagaaccugcagcggcuguccggggccauggacgagcuccacaacgagauccuggagcuggacgagaaggucgacgaccuccgcgcggauaccaucagcucccagaucgagcuggccgugcugcucucgaacgagggcaucaucaacuccgaggacgagcaccuccuggcccuggagcggaagcugaagaagaugcugggccccagcgccguggacaucgggaacggcuguuucgagaccaagcacaagugcaaccagaccugccucgaccgcaucgcggccgggaccuucaacgccggcgaguucucccugcccacguuugacagccugaacaucaccgccgccucccucaacgacgacgggcuggacaaccacaccauccugcuguauuacucgaccgcggccuccagccucgccgucacgcugaugaucgccaucuucaucguguacaugaucucccgggacaacgugagcugcuccaucugccuguga

SEQ ID NO: 15626 - RNA, 1755 nt, Artificial Sequence
  derived and/or modified CDS sequence (AUadapt) from InfluenzaB__AHL91442__HA
augaaggccaucaucgugcugcucauggucgugaccaguaacgccgaccgcaucugcaccggcaucacguccagcaacucgccccacguggucaagaccgcgacccagggggaggugaaugugaccggcgccaucccgcugacgaccacccccaccaagucccacuucgccaaccugaaggggacgaagacccggggcaagcucugcccgaccugccugaacugcaccgaccuggaugucgcccucgggcgccccaugugcgugggcaucacgcccuccgccaaggcgagcauccugcacgaggugcggcccgucaccuccggcugcuuccccaucaugcacgaccgcaccaagauccggcagcugcccaaccuccugcgcggguaugagaagauccggcugagcacccagaacgugaucaacgccgagacggccccgggcgggcccuaccgccucggcaccuccgggucgugccccaacgccaccuccaagagcggcuuuuucgcgaccauggccugggccgugccccgggacaacaacaagacggccaccaacccgcugaccgucgaggugccccacaucugcaccaaggaggaggaccagaucacgguguggggcuuucacuccgacaacaagacccagaugaagaaccuguacggggacagcaacccccagaaguuuaccuccucggccaacggcaucaccacgcacuacgucucccagaucgggggcuuccccgaccagaccgaggacggcgggcucccgcagagcggccgcaucgugguggauuacaugguccagaagcccgggaagaccggcaccaucguguaccagcgggggauccugcugccccagaagguguggugcgcguccggccgcagcaaggucaucaagggcucgcucccccugaucggggaggccgacugccugcacgagaaguauggcgggcucaacaaguccaagccguacuacacgggcgagcacgccaaggccaucgggaacugccccaucugggugaagacgccccugaagcuggccaacggcaccaaguaucggcccccggcgaagcuccugaaggagcgcggcuucuucggggccaucgccggcuuccuggagggcgggugggaggggaugaucgccggcuggcacggcuacaccagccacggggcccacggcguggcggucgccgccgaucucaaguccacccaggaggccaucaacaagaucaccaagaaccugaacucgcuguccgagcucgaggugaagaaccugcagcggcugagcggggccauggacgagcuccacaaugagauccuggagcuggacgagaaggucgacgaccuccgcgcggacaccaucuccagccagaucgagcuggccgugcugcucuccaacgagggcaucaucaacucggaggaugagcaccuccuggcccuggagcggaagcugaagaagaugcugggccccuccgccguggacaucgggaacggcugcuucgagaccaagcacaagugcaaccagaccugucucgaccgcaucgcggccgggacguucaacgccggcgaguucagccugcccaccuucgacucccugaacaucaccgccgccagucucaacgacgacgggcuggacaaccacaccauccugcuguacuacuccacggcggccaguucccucgccgucacccugaugaucgccaucuucaucguguacaugaucagccgggacaacguguccugcagcaucugccuguga

SEQ ID NO: 15627 - RNA, 1755 nt, Artificial Sequence
  derived and/or modified CDS sequence (AUadapt) from InfluenzaB__AHL91453__HA
augaaggccaucaucgugcugcucauggucgugaccaguaacgccgaccgcaucugcaccggcaucacguccagcaacucgccccacguggucaagaccgcgacccagggggaggugaacgugaccggcgccaucccgcugacgaccacccccaccaagucccauuucgccaaccugaaggggacgaagacccggggcaagcucugcccgaccugccugaacugcaccgaccuggacgucgcccucgggcgccccaugugugugggcaucacgcccuccgccaaggcgagcauccugcacgaggugcggcccgucaccuccggcugcuuccccaucaugcacgaccgcaccaagauccggcagcugcccaaccuccugcgcggguacgagaagauccggcugucgacccagaaugugaucaacgccgagaaggccccgggcgggcccuaccgccucggcacguccgggagcugccccaacgccaccuccaagagcggcuucuucgcgaccauggccugggccgugccccgggauaacaacaagaccgccacgaacccgcugaccaucgaggucccccacgugugcaccaaggaggaggaccagaucaccguguggggcuuccacuccgacaauaagacgcagaugaagaaccuguacggggacucgaacccccagaaguucaccuccagcgccaacggcaucaccacccauuacgucucccagaucgggggcuuccccgaccagacggaggacggcgggcucccgcagucgggccgcaucgugguggacuacaugguccagaagcccgggaagaccggcaccaucguguaccagcgggggauccugcugccccagaagguguggugcgcguccggccgcaguaaggucaucaagggcagccucccccugaucggggaggccgacugccugcacgagaaguacggcgggcucaacaaguccaagccguacuacaccggcgagcaugccaaggccaucgggaacugccccaucugggugaagacgccccugaagcuggccaacggcaccaaguaccggcccccggcgaagcuccugaaggagcgcggcuucuucggggccaucgccggcuuccuggagggcgggugggaggggaugaucgccggcuggcacggcuacaccagucacggggcccacggcguggcggucgccgccgaccucaaguccacccaggaggccaucaacaagaucacgaagaaccugaacagccuguccgagcucgaggugaagaaccugcagcggcugaguggggccauggacgagcuccacaacgagauccuggagcuggacgagaaggucgacgaccuccgcgcggacaccaucuccagccagaucgagcuggccgugcugcucuccaacgagggcaucaucaauagcgaggacgagcaccuccuggcccuggagcggaagcugaagaagaugcugggccccuccgccguggacaucgggaacggcugcuucgagaccaagcacaaguguaaccagaccugccucgaccgcaucgcggccgggaccuucaacgccggcgaguucucgcugcccacguucgacucccugaauaucaccgccgccagccucaacgacgacgggcuggacaaccacaccauccugcuguacuauuccaccgcggccucgucccucgccgucacgcugaugaucgccaucuucaucguguacaugaucagccgggacaacguguccugcagcaucugccuguga

SEQ ID NO: 15628 - RNA, 1755 nt, Artificial Sequence; identical to SEQ ID NO: 14145
  derived and/or modified CDS sequence (AUadapt) from InfluenzaB__AHL91464__HA

SEQ ID NO: 15629 - RNA, 1755 nt, Artificial Sequence; identical to SEQ ID NO: 14251
  derived and/or modified CDS sequence (AUadapt) from InfluenzaB__AHL91475__HA

SEQ ID NO: 15630 - RNA, 1755 nt, Artificial Sequence; identical to SEQ ID NO: 15626
  derived and/or modified CDS sequence (AUadapt) from InfluenzaB__AHL91486__HA

SEQ ID NO: 15631 - RNA, 1755 nt, Artificial Sequence; identical to SEQ ID NO: 15626
  derived and/or modified CDS sequence (AUadapt) from InfluenzaB__AHL91497__HA

SEQ ID NO: 15632 - RNA, 1755 nt, Artificial Sequence; identical to SEQ ID NO: 15626
  derived and/or modified CDS sequence (AUadapt) from InfluenzaB__AHL91530__HA

SEQ ID NO: 15633 - RNA, 1755 nt, Artificial Sequence; identical to SEQ ID NO: 14145
  derived and/or modified CDS sequence (AUadapt) from InfluenzaB__AHL91541__HA

SEQ ID NO: 15634 - RNA, 1755 nt, Artificial Sequence; identical to SEQ ID NO: 15626
  derived and/or modified CDS sequence (AUadapt) from InfluenzaB__AHL91552__HA

SEQ ID NO: 15635 - RNA, 1755 nt, Artificial Sequence; identical to SEQ ID NO: 15626
  derived and/or modified CDS sequence (AUadapt) from InfluenzaB__AHL91574__HA

SEQ ID NO: 15636 - RNA, 1755 nt, Artificial Sequence
  derived and/or modified CDS sequence (AUadapt) from InfluenzaB__AHL91585__HA
augaaggccaucaucgugcugcucauggucgugaccaguaacgccgaccgcaucugcaccggcaucacguccagcaacucgccccacguggucaagaccgcgacccagggggaggugaacgugaccggcgccaucccgcugacgaccacccccaccaagucccauuucgccaaccugaaggggacgaagacccggggcaagcucugcccgaccugccugaacugcaccgaccuggacgucgcccucgggcgccccaugugugugggcaucacgcccuccgccaaggcgagcauccugcacgaggugcggcccgucaccuccggcugcuuccccaucaugcacgaccgcaccaagauccggcagcugcccaaccuccugcgcggguacgagaagauccggcugucgacccagaaugugaucaacgccgagaaggccccgggcgggcccuaccgccucggcacguccgggagcugccccaacgccaccuccaagagcggcuucuucgcgaccauggccugggccgugccccgggauaacaacaagaccgccacgaacccgcugaccgucgaggugccccacaucugcaccaaggaggaggaccagaucaccguguggggcuuccacuccgacaauaagacgcagaugaagaaccuguacggggacucgaacccccagaaguucaccuccagcgccaacggcaugaccacccauuacgucucccagaucgggggcuuccccgaccagacggaggacggcgggcucccgcagucgggccgcaucgugguggacuacaugguccagaagcccgggaagaccggcaccaucguguaccagcgggggauccugcugccccagaagguguggugcgcguccggccgcaguaaggucaucaagggcagccucccccugaucggggaggccgacugccugcacgagaaguacggcgggcucaacaaguccaagccguacuacaccggcgagcaugccaaggccaucgggaacugccccaucugggugaagacgccccugaagcuggccaacggcaccaaguaccggcccccggcgaagcuccugaaggagcgcggcuucuucggggccaucgccggcuuccuggagggcgggugggaggggaugaucgccggcuggcacggcuacaccagucacggggcccacggcguggcggucgccgccgaccucaaguccacccaggaggccaucaacaagaucacgaagaaccugaacagccuguccgagcucgaggugaagaaccugcagcggcugaguggggccauggacgagcuccacaacgagauccuggagcuggacgagaaggucgacgaccuccgcgcggacaccaucuccagccagaucgagcuggccgugcugcucuccaacgagggcaucaucaauagcgaggacgagcaccuccuggcccuggagcggaagcugaagaagaugcugggccccuccgccguggacaucgggaacggcugcuucgagaccaagcacaaguguaaccagaccugccucgaccgcaucgcggccgggaccuucaacgccggcgaguucucgcugcccacguucgacucccugaauaucaccgccgccagccucaacgacgacgggcuggacaaccacaccauccugcuguacuauuccaccgcggccucgucccucgccgucacgcugaugaucgccaucuucaucguguacaugaucagccgggacaacguguccugcagcaucugccuguga

SEQ ID NO: 15637 - RNA, 1755 nt, Artificial Sequence
  derived and/or modified CDS sequence (AUadapt) from InfluenzaB__AHL91596__HA
augaaggccaucaucgugcugcucauggucgugaccaguaacgccgaccgcaucugcaccggcaucacguccagcaacucgccccacguggucaagaccgcgacccagggggaggugaacgugaccggcgccaucccgcugacgaccacccccaccaagucccacuuugccaaccugaaggggacgaagacccggggcaagcucugcccgaccugccugaacugcaccgaccuggacgucgcccucgggcgccccaugugcgugggcaucacgcccuccgccaaggcgagcauccugcaugaggugcggcccgucaccuccggcugcuuccccaucaugcacgaccgcaccaagauccggcagcugcccaaccuccugcgcggguacgagaagauccggcugucgacccagaacgugaucaacgccgagaaggccccgggcgggcccuaucgccucggcacguccgggagcugccccaacgccaccuccaagucgggcuucuucgcgaccauggccugggccgugccccgggacaacaacaagaccgccacgaauccgcugaccgucgaggugccccacaucugcaccaaggaggaggaccagaucaccguguggggcuuccacuccgacaacaagacgcagaugaagaaccuguacggggauagcaacccccagaaguucaccuccucggccaacggcaucaccacccacuacgucucccagaucgggggcuuccccgaccagacggaggauggcgggcucccgcagagcggccgcaucgugguggacuacaugguccagaagcccgggaagaccggcaccaucguguaccagcgggggauccugcugccccagaagguguggugcgcguccggccgcagcaaggucaucaagggcucgcucccccugaucggggaggccgacugccugcacgagaaguauggcgggcucaacaaguccaagccguacuacaccggcgagcacgccaaggccaucgggaacugccccaucugggugaagacgccccugaagcuggccaacggcaccaaguaccggcccccggcgaagauccucaaggagcgcggcuucuuuggggccaucgccggcuuccuggagggcgggugggaggggaugaucgccggcuggcacggcuacaccagccacggggcccacggcguggcggucgccgccgaccugaaguccacccaggaggccaucaacaagaucacgaagaaccucaauucgcuguccgagcuggaggugaagaaccuccagcggcugagcggggccauggacgagcugcacaacgagauccucgagcuggacgagaaggucgacgaccugcgcgcggauaccaucuccucgcagaucgagcucgccgugcugcuguccaacgagggcaucaucaacagcgaggacgagcaccuccuggcccuggagcggaagcucaagaagaugcugggccccuccgccguggacaucgggaacggcugcuuugagaccaagcacaagugcaaccagaccugccuggaccgcaucgcggccgggaccuucaacgccggcgaguucucgcuccccacguuugacucccugaacaucaccgccgccagccugaacgacgacgggcucgacaaccacaccauccugcuguauuacuccaccgcggccucgucccuggccgucacgcucaugaucgccaucuucaucguguacaugaucagccgggacaacguguccugcagcaucugccuguga

SEQ ID NO: 15638 - RNA, 1755 nt, Artificial Sequence; identical to SEQ ID NO: 15637
  derived and/or modified CDS sequence (AUadapt) from InfluenzaB__AHL91607__HA

SEQ ID NO: 15639 - RNA, 1755 nt, Artificial Sequence
  derived and/or modified CDS sequence (AUadapt) from InfluenzaB__AHL91618__HA
augaaggccaucaucgugcugcucauggucgugaccaguaacgccgaccgcaucugcaccggcaucacguccagcaacucgccccacguggucaagaccgcgacccagggggaggugaacgugaccggcgccaucccgcugacgaccacccccaccaagucccauuucgccaaccugaaggggacgaagacccggggcaagcucugcccgaccugccugaacugcaccgaccuggacgucgcccucgggcgccccaugugugugggcaucacgcccuccgccaaggcgagcauccugcacgaggugcggcccgucaccuccggcugcuuccccaucaugcacgaccgcaccaagauccggcagcugcccaaccuccugcgcggguacgagaagauccggcugagcacccagaaugugaucaacgccgagacggccccgggcgggcccuaccgccucggcaccuccgggucgugccccaacgccaccuccaagagcggcuucuucgcgaccauggccugggccgugccccgggauaacaacaagacggccaccaacccgcugaccgucgaggugccccacaucugcaccaaggaggaggaccagaucacgguguggggcuuccacuccgacaauaagacccagaugaagaaccuguacggggacagcaacccccagaaguucaccuccucggccaacggcaucaccacgcauuacgucucccagaucgggggcuuccccgaccagaccgaggacggcgggcucccgcagagcggccgcaucgugguggacuacaugguccagaagcccgggaagaccggcaccaucguguaccagcgggggauccugcugccccagaagguguggugcgcguccggccgcaguaaggucaucaagggcucgcucccccugaucggggaggccgacugccugcacgagaaguacggcgggcucaacaaguccaagccguacuacacgggcgagcaugccaaggccaucgggaacugccccaucugggugaagacgccccugaagcuggccaacggcaccaaguaccggcccccggcgaagcuccugaaggagcgcggcuucuucggggccaucgccggcuuccuggagggcgggugggaggggaugaucgccggcuggcacggcuacaccagucacggggcccacggcguggcggucgccgccgaccucaaguccacccaggaggccaucaacaagaucaccaagaaccugaacucgcuguccgagcucgaggugaagaaccugcagcggcugaguggggccauggacgagcuccacaacgagauccuggagcuggacgagaaggucgacgaccuccgcgcggacaccaucuccagccagaucgagcuggccgugcugcucuccaacgagggcaucaucaauucggaggacgagcaccuccuggcccuggagcggaagcugaagaagaugcugggccccuccgccguggacaucgggaacggcugcuucgagaccaagcacaaguguaaccagaccugccucgaccgcaucgcggccgggacguucaacgucggcgaguucagccugcccaccuucgacucccugaauaucaccgccgccagccucaacgacgacgggcuggacaaccacaccauccugcuguacuauuccacggccgcgucgucccucgccgugacccugaugaucgccaucuucaucguguacaugaucagccgggacaacgucuccugcagcaucugccuguga

SEQ ID NO: 15640 - RNA, 1755 nt, Artificial Sequence
  derived and/or modified CDS sequence (AUadapt) from InfluenzaB__AHL91629__HA
augaaggccaucaucgugcugcucauggucgugaccaguaacgccgaccgcaucugcaccggcaucacguccagcaacucgccccacguggucaagaccgcgacccagggggaggugaacgugaccggcgccaucccgcugacgaccacccccaccaagucccacuucgccaaucugaaggggacgaagacccggggcaagcucugcccgaccugcuucaacugcaccgaccuggacgucgcccuggggcgccccaugugcgugggcaucacgcccuccgccaaggcgagcauccuccacgaggugcggcccgucaccuccggcuguuuccccaucaugcacgaccgcaccaagauccggcagcugcccaaccugcuccgcggguacgagaagauccggcugucgacccagaacgugaucgacgccgagaaggccccgggcgggcccuacaagcugggcacguccgggagcugucccaacgccaccuccaagucgggcuucuucgcgaccauggccugggccgugccccgcgacaacaacaagaccgccacgaacccgcucaccgucgaggugccccacaucugcaccaaggaggaggaucagaucaccguguggggcuuccacuccgacaacaagacgcagaugaagaaccuguacggggacagcaacccccagaaguucaccuccagugccaacggcaucaccacccacuacgucucccagaucgggggcuuccccgaccagacggaggacggcgggcugccgcagagcggccggaucgugguggacuacaugguccagaagcccgggaagaccggcaccaucguguaccagcgcgggauccuccugccccagaagguguggugugcguccggccggagcaaggucaucaagggcucgcugccccucaucggggaggccgacugccugcacgagaaguacggcgggcugaacaaguccaagccguacuacaccggcgagcacgccaaggccaucgggaauugccccaucugggugaagacgccccucaagcuggccaacggcaccaaguaccggcccccggcgaagcugcucaaggagcgcggcuucuucggggccaucgccggcuuccuggagggcgggugggaggggaugaucgccggcuggcacggcuacaccagccacggggcccauggcguggcggucgccgccgaccugaaguccacccaggaggccaucaacaagaucacgaagaaccucaacucgcuguccgagcuggaggugaagaaccuccagcgccugagcggggccauggacgagcugcacaacgagauccucgagcuggaugagaaggucgacgaccugcgggcggacaccaucuccucgcagaucgagcucgccgugcugcuguccaacgagggcaucaucaacagcgaggacgagcaccuccuggcccuggagcgcaagcucaagaagaugcugggccccuccgccguggacaucgggaauggcugcuucgagaccaagcacaagugcaaccagaccugccuggaccggaucgcggccgggaccuucaacgccggcgaguucagucuccccacguucgacucccugaacaucaccgccgccagccugaacgacgacgggcucgacaaccacaccauccugcuguauuacuccaccgcggccucgucccuggccgucacgcucaugaucgccaucuucaucguguacaugaucagccgcgacaacguguccugcagcaucugccuguga

SEQ ID NO: 15641 - RNA, 1755 nt, Artificial Sequence; identical to SEQ ID NO: 15640
  derived and/or modified CDS sequence (AUadapt) from InfluenzaB__AHL91640__HA

SEQ ID NO: 15642 - RNA, 1755 nt, Artificial Sequence; identical to SEQ ID NO: 14147
  derived and/or modified CDS sequence (AUadapt) from InfluenzaB__AHL91651__HA

SEQ ID NO: 15643 - RNA, 1752 nt, Artificial Sequence
  derived and/or modified CDS sequence (AUadapt) from InfluenzaB__AHL91662__HA
augaaggccaucaucgugcugcucauggucgugaccaguaacgccgaccgcaucugcaccggcaucacguccagcaacagcccccacguggucaagaccgcgacccagggggaggugaaugugaccggcgccaucccgcugacgaccacccccaccaagucccacuucgccaaccugaaggggacgaagacccggggcaagcucugcccgaccugccugaacugcaccgaucuggacgucgcccucgggcgccccaugugcgugggcaucacgcccuccgccaaggcgucgauccugcacgaggugcggcccgucaccuccggcugcuuccccaucaugcacgaucgcaccaagauccggcagcugcccaaccuccugcgcggguacgagaagauccggcugagcacccagaacgugaucaacgccgagacggccccgggcgggcccuaccgccucggcaccuccgggagcugccccaaugccaccuccaagucgggcuucuucgcgaccauggccugggccgugccccgggacaacaacaagacggccaccaacccgcugaccgucgaggugccccauaucugcaccaaggaggaggaccagaucacgguguggggcuuccacuccgacaacaagacccagaugaagaaccuguauggggacagcaacccccagaaguucaccuccagcgccaacggcaucaccacgcacuacgucucccagaucgggggcuuucccgaccagaccgaggacggcgggcucccgcagucgggccgcaucgugguggacuacaugguccagaagcccgggaagaccggcaccaucguguaccagcgggggauccugcugccccagaagguguggugcgcguccggccgcaguaaggucaucaagggcagccucccccugaucggggaggccgacugccugcacgagaaguacggcgggcucaacaaguccaagccguacuauacgggcgagcacgccaaggccaucgggaacugccccaucugggugaagacgccccugaagcuggccaacggcaccaaguaccggcccccggcgaagcuccugaaggagcgcggcuucuucggggccaucgccggcuuucuggagggcgggugggaggggaugaucgccggcuggcacggcuacaccucgcacggggcccacggcguggcggucgccgccgaccucaaguccacccaggaggccaucaacaagaucaccaagaaccugaauagccuguccgagcucgaggugaagaaccugcagcggcugagcggggccauggacgagcuccacaacgagauccuggagcuggacgagaaggucgaugaccuccgcgcggacaccaucuccucgcagaucgagcuggccgugcugcucuccaacgagggcaucaucaacagcgaggacgagcaucuccuggcccuggagcggaagcugaagaagaugcugggccccuccgccguggacaucgggaacggcugcuucgagaccaagcacaagugcaaccagaccugccucgaucgcaucgcggccgggacguucaacgccggcgaguucagccugcccaccuucgacucccugaacaucaccgccgccagucucaacgacgggcuggacaaccacaccauccugcuguacuacuccacggcggccaguucccucgccgucacccugaugaucgccaucuucaucguguacaugaucagccgggacaacguguccugcagcaucugccuguga

SEQ ID NO: 15644 - RNA, 1755 nt, Artificial Sequence; identical to SEQ ID NO: 14251
  derived and/or modified CDS sequence (AUadapt) from InfluenzaB__AHL91673__HA

SEQ ID NO: 15645 - RNA, 1755 nt, Artificial Sequence
  derived and/or modified CDS sequence (AUadapt) from InfluenzaB__AHL91684__HA
augaaggccaucaucgugcugcucauggucgugaccaguaacgccgaccgcaucugcaccggcaucacguccagcaacucgccccacguggucaagaccgcgacccagggggaggugaacgugaccggcgccaucccgcugacgaccacccccaccaagucccacuuugccaaccugaaggggacgaagacccggggcaagcucugcccgaccugccugaacugcaccgaccuggacgucgcccucgggcgccccaugugcgugggcaucacgcccuccgccaaggcgagcauccugcacgaggugcggcccgucaccuccggcuguuuccccaucaugcacgaccgcaccaagauccggcagcugcccaaccuccugcgcggguacgagaagauccggcugucgacccagaacgugaucaacgccgagaaggccccgggcgggcccuaccgccucggcacguccgggagcugucccaacgccaccuccaagagcggcuucuucgcgaccauggccugggccgugccccgggacaacaacaagaccgccacgaacccgcugaccaucgaggucccccacaucugcaccaaggaggaggaucagaucaccguguggggcuuccacuccgacaacaagacgcagaugaagaaccuguacggggacucgaacccccagaaguucaccuccagugccaacggcaucaccacccacuacgugucccagaucgggggcuuccccgaccagacggaggacggcgggcucccgcagucgggccgcaucgucguggacuacauggugcagaagcccgggaagaccggcaccaucgucuaccagcgggggauccugcugccccagaagguguggugugcguccggccgcagcaaggugaucaagggcuuccucccccugaucggggaggccgacugccugcacgagaaguacggcgggcucaacaagucgaagccguacuacaccggcgagcaugccaaggccaucgggaacugccccaucugggucaagacgccccugaagcuggccaacggcaccaaguaccggcccccggcgaagcuccugaaggagcgcggcuucuucggggccaucgccggcuuccuggagggcgggugggaggggaugaucgccggcuggcacggcuacaccucccacggggcccauggcguggcgguggccgccgaccucaagagcacccaggaggccaucaacaagaucacgaagaaccugaacucccugagcgagcucgaggucaagaaccugcagcggcuguccggggccauggacgagcuccacaacgagauccuggagcuggaugagaagguggacgaccuccgcgcggacaccaucucgucccagaucgagcuggccguccugcucagcaacgagggcaucaucaacuccgaggacgagcaccuccuggcccuggagcggaagcugaagaagaugcugggccccucggccguggauaucgggaacggcugcuucgagaccaagcacaagugcaaccagaccugccucgaccgcaucgcggccgggaccuucaacgccggcgaguuuucccugcccacguucgacagccugaacaucaccgccgccucccucaacgacgacgggcuggacaaccacaccauccugcuguauuacucgaccgcggccuccagccucgccgugacgcugaugaucgccaucuucaucgucuacaugaucucccgggacaacgugagcugcuccaucugccuguga

SEQ ID NO: 15646 - RNA, 1755 nt, Artificial Sequence; identical to SEQ ID NO: 14147
  derived and/or modified CDS sequence (AUadapt) from InfluenzaB__AHL91695__HA

SEQ ID NO: 15647 - RNA, 1755 nt, Artificial Sequence; identical to SEQ ID NO: 14251
  derived and/or modified CDS sequence (AUadapt) from InfluenzaB__AHL91706__HA

SEQ ID NO: 15648 - RNA, 1758 nt, Artificial Sequence; identical to SEQ ID NO: 14719
  derived and/or modified CDS sequence (AUadapt) from InfluenzaB__AHL91717__HA

SEQ ID NO: 15649 - RNA, 1758 nt, Artificial Sequence; identical to SEQ ID NO: 14719
  derived and/or modified CDS sequence (AUadapt) from InfluenzaB__AHL91728__HA

SEQ ID NO: 15650 - RNA, 1758 nt, Artificial Sequence; identical to SEQ ID NO: 14719
  derived and/or modified CDS sequence (AUadapt) from InfluenzaB__AHL91739__HA

SEQ ID NO: 15651 - RNA, 1755 nt, Artificial Sequence; identical to SEQ ID NO: 14251
  derived and/or modified CDS sequence (AUadapt) from InfluenzaB__AHL91750__HA

SEQ ID NO: 15652 - RNA, 1758 nt, Artificial Sequence; identical to SEQ ID NO: 14719
  derived and/or modified CDS sequence (AUadapt) from InfluenzaB__AHL91761__HA

SEQ ID NO: 15653 - RNA, 1758 nt, Artificial Sequence
  derived and/or modified CDS sequence (AUadapt) from InfluenzaB__AHL91772__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaauaucccguccgccaaggugucgauccugcacgagguccggcccgugacguccggcugcuuccccaucaugcacgaccgcaccaagauccggcagcugcccaaccuccugcgcggguacgagcacauccggcugucgacccacaacgugaucaacgccgagaaggcgccgggcgggcccuacaagaucggcaccuccgggucgugccccaacaucacgaacggcaacggcuucuuugccaccauggccugggccguccccaagaacgacaacaacaagaccgcgaccaacucccucacgaucgaggugccguacaucugcaccgagggggaggaccagaucaccguguggggcuuccacagcgacaacgagacccagauggccaagcuguacggggacuccaagccccagaaguucacgucguccgccaacggcgucaccacccacuacgugagucagaucggcggguuccccaaccagaccgaggacggcgggcugccccaguccggccgcaucguggucgacuacauggugcagaaguccgggaagacgggcaccaucaccuaccagcggggcauccuccugccgcagaagguguggugcgccuccgggcgcagcaaggucaucaagggcucgcugccccucaucggggaggccgacugccugcacgagaaguacggcgggcugaacaaguccaagcccuacuacaccggcgagcacgcgaaggccaucggcaacugccccaucugggugaagacgccgcucaagcuggccaaugggaccaaguaccggccgcccgccaagcugcucaaggagcgcggcuucuucggggccaucgcgggcuuccuggagggcgggugggagggcaugaucgccggguggcacggcuacaccucgcacggggcccacggcguggccgucgccgcggaccugaaguccacccaggaggccaucaacaagaucacgaagaaccucaacucgcuguccgagcuggaggugaagaaccuccagcggcugagcggcgccauggacgagcugcacaacgagauccucgagcuggacgagaaggucgaugaccugcgcgccgacaccaucuccucgcagaucgagcucgccgugcugcuguccaacgaggggaucaucaacucggaggacgagcaccuccuggcgcuggagcggaagcucaagaagaugcugggccccuccgccguggagaucgggaacggcugcuucgagaccaagcacaagugcaaccagaccugccuggaccgcaucgccgccgggaccuucgacgcgggcgaguucucgcuccccacguuugacucccugaacaucaccgccgccagccugaacgacgacggccucgacaaccacaccauccugcuguacuacuccaccgccgccucgucccuggcggucacgcucaugaucgccaucuucgugguguacauggucucgcgggacaacguguccugcagcaucugccuguga

SEQ ID NO: 15654 - RNA, 1758 nt, Artificial Sequence; identical to SEQ ID NO: 15653
  derived and/or modified CDS sequence (AUadapt) from InfluenzaB__AHL91783__HA

SEQ ID NO: 15655 - RNA, 1758 nt, Artificial Sequence; identical to SEQ ID NO: 15653
  derived and/or modified CDS sequence (AUadapt) from InfluenzaB__AHL91794__HA

SEQ ID NO: 15656 - RNA, 1758 nt, Artificial Sequence
  derived and/or modified CDS sequence (AUadapt) from InfluenzaB__AHL91805__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacgaagacccggggcaagcucugccccaagugcuucaacugcaccgaucuggacguggcccuggggcgccccaagugcaccggcaacaucccguccgccgaggugucgauccuccacgagguccggcccgugacguccggcugcuuccccaucaugcacgaccgcaccaagauccggcagcugcccaaccugcuccgcggguacgagcacauccggcugagcacccacaacgugaucaacgccgagaaggcgccgggcgggcccuacaagaucggcaccuccgggaguugccccaacgucacgaacggcaacggcuucuucgccaccauggccugggccgugcccaagaacgacaacaacaagaccgcgaccaacucccugacgaucgaggugccguacaucugcaccgagggggaggaccagaucaccgucuggggcuuccacucggauaacgagacccagauggccaagcucuacggggacuccaagccccagaaguucacgagcuccgccaacggcgugaccacccacuacgugucgcagaucggcggguuccccaaccagaccgaggacggcgggcugccccaguccggccgcaucgucguggacuacauggugcagaaguccgggaagacgggcaccaucaccuaccagcggggcauccugcucccgcagaaggucuggugcgccuccgggcgcagcaaggugaucaagggcucgcugccccugaucggggaggccgauugccuccacgagaaguacggcgggcugaacaaguccaagcccuacuacaccggcgagcacgcgaaggccaucggcaacugccccaucugggugaagacgccgcugaagcucgccaacgggaccaaguaccggccgcccgccaagcugcugaaggagcgcggcuucuucggggccaucgcgggcuuccucgagggcgggugggagggcaugaucgccggguggcacggcuacaccucgcauggggcccacggcgucgccguggccgcggaccugaaguccacccaggaggccaucaacaagaucacgaagaaccugaacagccucuccgagcuggaggucaagaaccugcagcggcucucgggcgccauggacgagcugcacaacgagauccuggagcucgacgagaagguggacgaccugcgcgccgacaccaucuccucgcagaucgagcuggccgugcuccuguccaacgaggggaucaucaauagcgaggacgagcaccuccuggcgcuggagcggaagcugaagaagaugcucggccccuccgccgucgagaucgggaacggcugcuucgagaccaagcacaagugcaaccagaccugccuggaccgcaucgccgccgggaccuucgacgcgggcgaguucucgcugcccacguucgacucccucaauaucaccgccgccucgcugaacgacgacggccuggacaaccacaccauccuccuguacuacuccaccgccgccagcucccuggcggugacgcugaugaucgccaucuucguggucuacauggugucgcgggacaacguguccugcagcaucugccucuga

SEQ ID NO: 15657 - RNA, 1758 nt, Artificial Sequence; identical to SEQ ID NO: 14159
  derived and/or modified CDS sequence (AUadapt) from InfluenzaB__AHL91816__HA

SEQ ID NO: 15658 - RNA, 1758 nt, Artificial Sequence; identical to SEQ ID NO: 14159
  derived and/or modified CDS sequence (AUadapt) from InfluenzaB__AHL91827__HA

SEQ ID NO: 15659 - RNA, 1755 nt, Artificial Sequence; identical to SEQ ID NO: 14766
  derived and/or modified CDS sequence (AUadapt) from InfluenzaB__AHL91838__HA

SEQ ID NO: 15660 - RNA, 1755 nt, Artificial Sequence
  derived and/or modified CDS sequence (AUadapt) from InfluenzaB__AHL91849__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaaguccuacuucgccaaccugaaggggacgcggacccgcggcaagcucugccccgacugccugaauugcaccgaccuggacguggcccucgggcggcccaugugcgugggcaccacgccguccgccaaggccagcauccugcacgaggcgcgccccgucaccuccggcugcuuucccaucaugcacgaccggaccaagauccgccagcugcccaaccuccugcggggguacgagaacauccgccugagcacccagaaugugaucgacgccgagaacgccccgggcgggcccuaccggcucggcacguccgggucgugccccaacgccaccuccaagagcggcuuuuucgcgaccauggccugggccgugcccaaggacaacaacaagaacgccaccaacccgcugacggucgaggugcccuacaucuguaaggagggcgaggaccagaucaccguguggggguuccacuccgacaacaagacccagaugaagaaccuguauggcgacagcaacccccagaaguucaccuccagcgccaacggggucacgacccacuaugugucccagaucagcggcuuccccgcgcagaccgaggacggcgggcucccgcaguccggccgcaucguggucgacuacauggugcagaagccccggaagaccgggacgaucguguaccagcgcggcguccugcugccccagaagguguggugcgccagugggcggucgaaggugaucaagggcucccucccccugaucggcgaggccgacugccugcacgagaaguacgggggccucaacaagaguaagccguacuacaccggggagcacgccaaggccaucggcaacugccccaucugggucaagacgccccugaagcuggcgaacgggaccaaguaccggcccccggccaagcuccugaaggagcgcggcuuuuucggcgccaucgccggguuccuggagggcgggugggagggcaugaucgccggguggcacggcuacaccucccacggcgcgcacgggguggccgucgccgccgaccucaagaguacccaggaggccaucaacaagaucaccaagaaccugaacucccugagcgagcucgaggugaagaaccugcagcgccuguccggcgcgauggacgagcuccauaacgagauccuggagcuggacgagaagguggacgaccuccgggccgacaccaucagcucccagaucgagcuggccguccugcucagcaaugaggggaucaucaacuccgaggacgagcaccuccuggcccuggagcgcaagcugaagaagaugcugggccccucggcgguggacaucggcaacgggugcuuugagacgaagcacaagugcaaccagaccugccucgaccggaucgccgccggcaccuucaaugccggggaguucucccugcccaccuucgacagccugaacaucaccgccgcgucccucaacgacgauggccuggacaaccacacgauccugcuguacuacagcaccgccgccuccagccucgccgugacccugaugcuggccaucuuuaucgucuacauggugucccgcgacaacgugagcugcagcaucugccucuga

SEQ ID NO: 15661 - RNA, 1755 nt, Artificial Sequence
  derived and/or modified CDS sequence (AUadapt) from InfluenzaB__AHL91860__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacuguaccgaccuggacguggcccucgggcggcccaugugcgugggcaccacgccguccgccaaggccagcauccugcacgagguccgccccgugaccuccggcugcuuccccaucaugcaugaccggaccaagauccgccagcugcccaaccuccugcggggguacgagaacauccgccugagcacccagaacgugaucgacgcggagaaggccccgggcgggcccuaucggcucggcacguccgggucgugccccaacgccaccuccaagagcggcuucuucgccaccauggcgugggccguccccaaggacaauaacaagaacgccaccaacccgcugacgguggagauccccuacaucugcaccgagggcgaggaccagaucaccguguggggguuccauuccgacaacaagacccagaugaagaaccuguacggcgacagcaacccccagaaguuuacguccagcgccaacggggucaccacccacuacgugucccagaucggcggcuuccccgaccagaccgaggacgggggccucccgcagagugggcgcaucguggucgacuacaugaugcagaagcccggcaagacggggaccaucguguaccagcggggcgugcugcugccccagaaggucuggugcgccuccggccgcagcaaggugaucaaggggucgcucccccugaucggcgaggcggacugucugcacgagaaguacgggggccucaacaaguccaagccguacuacaccggggagcacgccaaggccaucggcaacugucccaucugggugaagacgccccugaagcuggccaacggcaccaaguaccggcccccggccaagcuccugaaggagcgcggguucuucggcgcgaucgccggguuccuggagggcgggugggagggcaugaucgccggcuggcacggguacaccagucacggcgcccacggggucgccguggcggccgaccucaaguccacccaggaggccaucaacaagaucaccaagaaccugaacagccuguccgagcucgaggucaagaaucugcagcggcugagcggcgccauggacgagcuccacaacgagauccuggagcuggacgagaagguggacgaccuccgcgccgauacgaucuccagccagaucgagcuggcggugcugcucuccaacgagggcaucaucaacucggaggacgagcaccuccuggcccuggagcggaagcugaagaagaugcuggggcccuccgccgucgagaucggcaacggguguuucgagaccaagcacaagugcaaccagaccugccucgaccgcaucgccgcgggcaccuucaaugccggggaguucagccugcccaccuucgacucccugaacaucacggccgccagccucaacgaugacggccuggacaaccacgccauccugcuguacuacuccaccgcggccagcucccucgccgugacccugaugcuggccaucuuuaucguguacauggucagccgggacaacguguccugcagcaucugccucuga

SEQ ID NO: 15662 - RNA, 1755 nt, Artificial Sequence
  derived and/or modified CDS sequence (AUadapt) from InfluenzaB__AHL91871__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacuguaccgaccuggacguggcccucgggcggcccaugugcgugggcaccacgccguccgccaaggccagcauccugcacgagguccgccccgugaccuccggcugcuuccccaucaugcacgaucggaccaagauccgccagcugcccaaccuccugcggggguacgagaacauccgccugucgacccagaacgugaucgacgcggagaaggccccgggcgggcccuaccggcucggcacguccgggaguugccccaacgccaccuccaagagcggcuucuucgccaccauggcgugggccguccccaaggacaacaacaagaaugccaccaacccgcugacgguggagauccccuacaucugcaccgagggcgaggaccagaucaccguguggggguuccacuccgacaauaagacccagaugaagaaccuguacggcgacagcaacccccagaaguucacguccucggccaacggggucaccacccauuacgugucccagaucggcggcuuccccgaccagaccgaggacgggggccucccgcagagcgggcgcaucguggucgacuacaugaugcagaagcccggcaagacggggaccaucguguaucagcggggcgugcugcugccccagaaggucuggugcgccuccggccgcagcaaggugaucaaggggagccucccccugaucggcgaggcggacugccugcacgagaaguacgggggccucaacaaguccaagccguauuacaccggggagcacgccaaggccaucggcaacugccccaucugggugaagacgccccugaagcuggccaacggcaccaaguaccggcccccggccaagcuccugaaggagcgcggguucuuuggcgcgaucgccggguuccuggagggcgggugggagggcaugaucgccggcuggcacggguacaccagccacggcgcccacggggucgccguggcggccgaccucaaguccacccaggaggccaucaacaagaucaccaagaaucugaacucgcuguccgagcucgaggucaagaaccugcagcggcugagcggcgccauggacgagcuccacaacgagauccuggagcuggaugagaagguggacgaccuccgcgccgacacgaucuccagccagaucgagcuggcggugcugcucuccaacgagggcaucaucaacagcgaggacgagcaucuccuggcccuggagcggaagcugaagaagaugcuggggcccuccgccgucgagaucggcaacgggugcuucgagaccaagcacaagugcaaccagaccugccucgaucgcaucgccgcgggcaccuucaacgccggggaguucucgcugcccaccuucgacucccugaacaucacggccgccagccucaaugacgacggccuggacaaccacaccauccugcuguacuacuccaccgccgcgaguucccucgccgugacccugaugcuggccaucuucaucguguacauggucagccgggacaacguguccugcagcaucugccucuga

SEQ ID NO: 15663 - RNA, 1755 nt, Artificial Sequence; identical to SEQ ID NO: 14166
  derived and/or modified CDS sequence (AUadapt) from InfluenzaB__AHL91882__HA

SEQ ID NO: 15664 - RNA, 1755 nt, Artificial Sequence
  derived and/or modified CDS sequence (AUadapt) from InfluenzaB__AHL91904__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacugcaccgaucuggacguggcccucgggcggcccaugugcgugggcaccacgccguccgccaaggccagcauccugcacgagguccgccccgugaccuccggcugcuuccccaucaugcacgaucggaccaagauccgccagcuggcgaaccuccugcggggguacgagaacauccgccugucgacccagaacgugaucgacgccgagaaggcccccggcgggccguaccggcucggcacguccgggagcugucccaacgccaccuccaagagcggcuucuucgcgaccauggccugggccguccccaaggacaacaacaagaaugccaccaacccccugacgguggaggugccguacaucugcaccgagggcgaggaccagaucaccgucuggggguuccacuccgacaacaagacccagaugaagaaucuguacggcgacagcaacccccagaaguucacguccucggccaacggggugaccacccacuaugugucccagaucggcggcuuccccgaccagaccgaggacgggggccucccccagagcgggcgcaucgucguggacuacaugaugcagaagcacggcaagacggggaccaucguguaucagcggggcguccugcugccgcagaagguguggugcgcguccggccgcagcaaggugaucaaggggagccucccccugaucggcgaggccgacugccugcacgagaaguacgggggccucaacaaguccaagcccuauuacaccggggagcacgccaaggccaucggcaacugccccaucugggucaagaccccgcugaagcuggccaacggcacgaaguaccggccgcccgcgaagcuccugaaggagcgcggguucuuuggcgccaucgccggguuccuggagggcgggugggagggcaugaucgccggcuggcacggguacaccagccacggcgcccacgggguggcggucgccgccgaccucaaguccacccaggaggccaucaacaagaucaccaagaaucugaacucgcuguccgagcucgaggugaagaaccugcagcggcugagcggcgccauggacgagcuccacaacgagauccuggagcuggacgagaagguggaugaccuccgcgcggacacgaucuccagccagaucgagcuggccguccugcucuccaacgagggcaucaucaacagcgaggacgagcaucuccuggcccuggagcggaagcugaagaagaugcuggggcccuccgccguggacaucggcaacgggugcuucgagaccaagcacaagugcaaccagaccugccucgaucgcaucgcggccggcaccuucaacgccggggaguucucgcugcccaccuucgacucccugaacaucacggccgccagucucaacgacgacggccuggacaaccacaccauccugcuguacuacuccaccgcggccaguucccucgccgugacccugaugcuggccaucuucaucgucuacauggugagccgggacaacguguccugcagcaucugccucuga

SEQ ID NO: 15665 - RNA, 1755 nt, Artificial Sequence
  derived and/or modified CDS sequence (AUadapt) from InfluenzaB__AHL91915__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacuguaccgaccuggacguggcccucgggcggcccaugugcgugggcaccacgccguccgccaaggccagcauccugcacgagguccgccccgugaccuccggcugcuuccccaucaugcaugaccggaccaagauccgccagcugcccaaccuccugcggggguacgagaacauccgccugagcacccagaacgugaucgacgcggagaaggccccgggcgggcccuaucggcucggcacguccgggagcugccccaacgccaccuccaagagcggcuucuucgccaccauggcgugggccguccccaaggacaauuacaagaacgccaccaacccgcugacgguggaggugcccuacaucugcaccgagggcgaggaccagaucaccgucuggggguuccauuccgacaacaagacccagaugaagaaccuguacggcgacucgaacccccagaaguuuacguccagcgccaacggggugaccacccacuacgugucccagaucggcggcuuccccgaccagaccgaggacgggggccucccgcagagugggcgcaucgucguggacuacaugaugcagaagcccggcaagacggggaccaucguguaccagcggggcguccugcugccccagaagguguggugcgccuccggccgcagcaaggugaucaaggggagccucccccugaucggcgaggcggacugucugcacgagaaguacgggggccucaacaaguccaagccguacuacaccggggagcacgccaaggccaucggcaacugucccaucugggucaagacgccccugaagcuggccaacggcaccaaguaccggcccccggccaagcuccugaaggagcgcggguucuucggcgcgaucgccggguuccuggagggcgggugggagggcaugaucgccggcuggcacggguacaccagucacggcgcccacgggguggccgucgcggccgaccucaaguccacccaggaggccaucaacaagaucaccaagaaccugaacagccuguccgagcucgaggugaagaaucugcagcggcugucgggcgccauggacgagcuccacaacgagauccuggagcuggacgagaagguggacgaccuccgcgccgauacgaucuccagccagaucgagcuggcgguccugcucuccaacgagggcaucaucaacagcgaggacgagcaccuccuggcccuggagcggaagcugaagaagaugcuggggcccuccgccguggacaucggcaaugggugcuucgagaccaagcacaagugcaaccagaccugccucgaccgcaucgccgcgggcaccuuuaacgccggggaguucagccugcccaccuucgacucccugaacaucacggccgccagccucaaugacgacggccuggacaaccacaccauccugcuguacuacuccaccgccgcgaguucccucgccgugacccugaugcuggccaucuucaucgucuacauggugagccgggacaacguguccugcagcaucugccucuga

SEQ ID NO: 15666 - RNA, 1755 nt, Artificial Sequence; identical to SEQ ID NO: 14764
  derived and/or modified CDS sequence (AUadapt) from InfluenzaB__AHL91926__HA

SEQ ID NO: 15667 - RNA, 1755 nt, Artificial Sequence; identical to SEQ ID NO: 15339
  derived and/or modified CDS sequence (AUadapt) from InfluenzaB__AHL91937__HA

SEQ ID NO: 15668 - RNA, 1755 nt, Artificial Sequence; identical to SEQ ID NO: 14166
  derived and/or modified CDS sequence (AUadapt) from InfluenzaB__AHL91948__HA

SEQ ID NO: 15669 - RNA, 1758 nt, Artificial Sequence
  derived and/or modified CDS sequence (AUadapt) from InfluenzaB__AHL91959__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaauaucccguccgccgaggugucgauccugcacgagguccggcccgugacguccggcugcuuccccaucaugcacgaccgcaccaagauccggcagcugcccaaccuccugcgcggguacgagcacauccggcugucgacccacaacgugaucaacgccgagaaggcgccgggcgggcccuacaagaucggcaccuccgggagcugccccaacgucacgaacggcaacggcuucuuugccaccauggccugggccgugcccaagaacgacaacaacaagaccgcgaccaacucccucacgaucgaggugccguacaucugcaccgagggggaggaccagaucaccaucuggggcuuccacucggacaacgagacccagauggccaagcuguacggggacuccaagccccagaaguucacgucguccgccaacggcgucaccacccacuacgugagucagaucggcggguuccccaaccagaccgaggacggcgggcugccccaguccggccgcaucguggucgacuacauggugcagaaguccgggaagacgggcaccaucaccuaccagcggggcauccuccugccgcagaagguguggugcgccuccgggcgcucgaaggucaucaagggcucgcugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaucggccgcccgccaagcugcucaaggagcgcggcuucuucggggccaucgcgggcuuccuggagggcgggugggagggcaugaucgccggguggcacggcuacaccagccacggggcccacggcguggccgucgccgcggaccugaaguccacccaggaggccaucaacaagaucacgaagaaccucaacucgcuguccgagcuggaggugaagaaccuccagcggcugucgggcgccauggacgagcugcacaacgagauccucgagcuggacgagaaggucgacgaucugcgcgccgacaccaucuccagccagaucgagcucgccgugcugcuguccaacgaggggaucaucaacucggaggacgagcaccuccuggcgcuggagcggaagcucaagaagaugcugggccccuccgccguggagaucgggaacggcugcuucgagaccaagcacaagugcaaccagaccugccuggaccgcaucgccgccgggaccuucgacgcgggcgaguucucgcuccccacguucgauucccugaacaucaccgccgccagcuucaacgacgacggccuggacaaccacaccauccuccuguacuacuccaccgccgccucgucccuggcggucacgcugaugaucgccaucuucgugguguacauggucucgcgggacaacguguccugcagcaucugccucuga

SEQ ID NO: 15670 - RNA, 1758 nt, Artificial Sequence; identical to SEQ ID NO: 14378
  derived and/or modified CDS sequence (AUadapt) from InfluenzaB__AHL91970__HA

SEQ ID NO: 15671 - RNA, 1755 nt, Artificial Sequence
  derived and/or modified CDS sequence (AUadapt) from InfluenzaB__AHL91991__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacugcaccgaucuggacguggcccucgggcggcccaugugcgugggcaccacgccguccgccaaggccagcauccugcacgagguccgccccgugaccuccggcugcuuccccaucaugcacgaucggaccaagauccgccagcuggcgaaccuccugcggggguacgagaacauccgccugucgacccagaacgugaucgacgccgagaaggcccccggcgggccguaccggcucggcacguccgggagcugucccaacgccaccaacaaguccggcuucuucgcgaccauggccugggccguccccaaggacaacaacaagaaugccaccaacccccugacgguggaggugccguacaucugcaccgagggcgaggaccagaucaccgucuggggguuccacagcgacaauaagacccagaugaagaaccuguacggcgacuccaacccccagaaguucacgagcuccgccaacggggugaccacccauuacgugucgcagaucggcggcuuccccgaccagaccgaggacgggggccucccccaguccgggcgcaucgucguggacuacaugaugcagaagccgggcaagacggggaccaucguguaccagcggggcguccugcugccccagaagguguggugugcgagcggccgcuccaaggugaucaaggggagccucccccugaucggcgaggccgacugccugcacgagaaguacgggggccucaacaagaguaagcccuacuacaccggggagcacgccaaggccaucggcaacugcccgaucugggucaagacgccccugaagcuggccaacggcaccaaguaccggccgcccgcgaagcuccugaaggagcgcggguucuuuggcgccaucgccggguuccuggagggcgggugggagggcaugaucgccggcuggcacggguacaccucccacggcgcccacgggguggcggucgccgccgaccucaagucgacccaggaggccaucaauaagaucaccaagaaccugaacucccugagcgagcucgaggugaagaaccugcagcggcuguccggcgccauggacgagcuccacaacgagauccuggagcuggacgagaagguggaugaccuccgcgcggacacgaucagcucccagaucgagcuggccguccugcucagcaacgagggcaucaucaacuccgaggacgagcaucuccuggcccuggagcggaagcugaagaagaugcuggggcccucggccguggacaucggcaacgggugcuucgagaccaagcacaagugcaaccagaccugucucgaccgcaucgcggccggcaccuucaacgccggggaguucucccugcccaccuucgacagccugaauaucacggccgccucccucaacgacgacggccuggacaaccacaccauccugcuguacuacaguaccgcggccuccagccucgccgugacccugaugcuggccaucuucaucgucuacauggugucccgggacaacgugagcugcuccaucugccucuga

SEQ ID NO: 15672 - RNA, 1758 nt, Artificial Sequence; identical to SEQ ID NO: 14254
  derived and/or modified CDS sequence (AUadapt) from InfluenzaB__AHL92002__HA

SEQ ID NO: 15673 - RNA, 1758 nt, Artificial Sequence; identical to SEQ ID NO: 14254
  derived and/or modified CDS sequence (AUadapt) from InfluenzaB__AHL92013__HA

SEQ ID NO: 15674 - RNA, 1758 nt, Artificial Sequence; identical to SEQ ID NO: 14254
  derived and/or modified CDS sequence (AUadapt) from InfluenzaB__AHL92024__HA

SEQ ID NO: 15675 - RNA, 1758 nt, Artificial Sequence; identical to SEQ ID NO: 14254
  derived and/or modified CDS sequence (AUadapt) from InfluenzaB__AHL92035__HA

SEQ ID NO: 15676 - RNA, 1758 nt, Artificial Sequence; identical to SEQ ID NO: 14254
  derived and/or modified CDS sequence (AUadapt) from InfluenzaB__AHL92046__HA

SEQ ID NO: 15677 - RNA, 1758 nt, Artificial Sequence; identical to SEQ ID NO: 14254
  derived and/or modified CDS sequence (AUadapt) from InfluenzaB__AHL92057__HA

SEQ ID NO: 15678 - RNA, 1758 nt, Artificial Sequence
  derived and/or modified CDS sequence (AUadapt) from InfluenzaB__AHL92068__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugucccaagugccugaacugcaccgaccuggacguggcccucgggcgccccaagugcaccggcaacaucccguccgcccgggugagcauccugcacgagguccgccccgugacguccggcugcuuccccaucaugcacgaucggaccaagauccgccagcugcccaaccuccugcggggguacgagcacauccgccugucgacccacaacgugaucaacgccgagaacgcgccgggcgggcccuacaagaucggcaccuccgggagcugccccaacaucacgaauggcaacggcuucuucgccaccauggccugggccguccccaagaacgacaacaacaagaccgcgaccaacucccucacgaucgaggugccguacaucugcaccgagggggaggaccagaucaccguguggggcuuccacagugacaacgagacccagauggccaagcuguacggggacuccaagccccagaaguucacgagcuccgccaacggcgucaccacccacuacgugucgcaggugggcggguuccccaaccagaccgaggauggcgggcugccccaguccggccggaucgucguggacuacauggugcagaaguccgggaagacgggcaccaucaccuaccagcgcggcauccuccugccgcagaaggucuggugcgccuccgggcggagcaaggugaucaagggcucgcugccccucaucggggaggccgacugccugcacgagaaguacggcgggcugaacaaguccaagcccuacuauaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccucgcacggggcccauggcgucgccguggccgcggaccugaaguccacccaggaggccaucaacaagaucacgaagaaccucaacagccuguccgagcuggaggucaagaaccuccagcgccugucgggcgccauggacgagcugcacaacgagauccucgagcuggacgagaagguggacgaccugcgggccgauaccaucuccagccagaucgagcucgccgugcugcuguccaacgaggggaucaucaacucggaggacgagcaccuccuggcgcuggagcgcaagcucaagaagaugcugggccccuccgccgucgagaucgggaacggcugcuucgagaccaagcacaagugcaaccagaccugucuggaccggaucgccgccgggaccuucgacgcgggcgaguucagccuccccacguucgacucccugaacaucaccgccgccucgcugaacgacgacggccucgauaaccacaccauccugcuguacuacuccaccgccgccagcucccuggcggugacgcucaugaucgccaucuucguggucuacauggugucgcgcgacaacguguccugcagcaucugccuguga

SEQ ID NO: 15679 - RNA, 1758 nt, Artificial Sequence
  derived and/or modified CDS sequence (AUadapt) from InfluenzaB__AHL92079__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugccccaagugucugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcauauccgccugucgacccacaacgugaucaacgccgagaacgcgccgggcgggcccuacaagaucggcaccuccgggucgugccccaacaucacgaacggcaacggcuucuucgccaccauggccugggccguccccaagaaugacaacaacaagaccgcgaccaacucccucacgaucgaggugccguacaucugcaccgagggggaggaccagaucaccguguggggcuuccacagcgacaacgagacccagauggccaagcuguacggggacuccaagccccagaaguuuacgucguccgccaacggcgucaccacccacuacgugagccagaucggcggguuccccaaccagaccgaggacggcgggcugccccaguccggccggaucguggucgacuacauggugcagaaguccgggaagacgggcaccaucaccuaccagcgcggcauccuccugccgcagaagguguggugcgccuccgggcggucgaaggucaucaagggcucgcugccccucaucggggaggccgauugccugcacgagaaguacggcgggcugaacaaguccaagcccuacuacaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuucuggagggcgggugggagggcaugaucgccggguggcacggcuacaccagccacggggcccacggcguggccgucgccgcggaccugaaguccacccaggaggccaucaacaagaucacgaagaaccucaacucgcuguccgagcuggaggugaagaaccuccagcgccugagcggcgccauggacgagcugcacaaugagauccucgagcuggacgagaaggucgacgaccugcgggccgacaccaucuccucgcagaucgagcucgccgugcugcuguccaacgaggggaucaucaacucggaggacgagcaccuccuggcgcuggagcgcaagcucaagaagaugcugggccccuccgccguggagaucgggaacggcugcuucgagaccaagcauaagugcaaccagaccugccuggaccggaucgccgccgggaccuucgacgcgggcgaguucagccuccccacguucgacucccugaacaucaccgccgccucgcugaacgacgauggccucgacaaccacaccauccugcuguacuacuccaccgccgccagcucccuggcggucacgcucaugaucgccaucuucgugguguacauggucucgcgcgacaacguguccugcagcaucugccuguga

SEQ ID NO: 15680 - RNA, 1758 nt, Artificial Sequence; identical to SEQ ID NO: 15679
  derived and/or modified CDS sequence (AUadapt) from InfluenzaB__AHL92090__HA

SEQ ID NO: 15681 - RNA, 1758 nt, Artificial Sequence; identical to SEQ ID NO: 14254
  derived and/or modified CDS sequence (AUadapt) from InfluenzaB__AHL92101__HA

SEQ ID NO: 15682 - RNA, 1755 nt, Artificial Sequence; identical to SEQ ID NO: 14307
  derived and/or modified CDS sequence (AUadapt) from InfluenzaB__AHL92112__HA

SEQ ID NO: 15683 - RNA, 1758 nt, Artificial Sequence; identical to SEQ ID NO: 14254
  derived and/or modified CDS sequence (AUadapt) from InfluenzaB__AHL92123__HA

SEQ ID NO: 15684 - RNA, 1758 nt, Artificial Sequence; identical to SEQ ID NO: 15679
  derived and/or modified CDS sequence (AUadapt) from InfluenzaB__AHL92134__HA

SEQ ID NO: 15685 - RNA, 1758 nt, Artificial Sequence; identical to SEQ ID NO: 15679
  derived and/or modified CDS sequence (AUadapt) from InfluenzaB__AHL92145__HA

SEQ ID NO: 15686 - RNA, 1758 nt, Artificial Sequence; identical to SEQ ID NO: 14254
  derived and/or modified CDS sequence (AUadapt) from InfluenzaB__AHL92156__HA

SEQ ID NO: 15687 - RNA, 1758 nt, Artificial Sequence; identical to SEQ ID NO: 15679
  derived and/or modified CDS sequence (AUadapt) from InfluenzaB__AHL92167__HA

SEQ ID NO: 15688 - RNA, 1758 nt, Artificial Sequence; identical to SEQ ID NO: 14254
  derived and/or modified CDS sequence (AUadapt) from InfluenzaB__AHL92178__HA

SEQ ID NO: 15689 - RNA, 1758 nt, Artificial Sequence; identical to SEQ ID NO: 14254
  derived and/or modified CDS sequence (AUadapt) from InfluenzaB__AHL92189__HA

SEQ ID NO: 15690 - RNA, 1755 nt, Artificial Sequence; identical to SEQ ID NO: 14307
  derived and/or modified CDS sequence (AUadapt) from InfluenzaB__AHL92200__HA

SEQ ID NO: 15691 - RNA, 1758 nt, Artificial Sequence; identical to SEQ ID NO: 14254
  derived and/or modified CDS sequence (AUadapt) from InfluenzaB__AHL92211__HA

SEQ ID NO: 15692 - RNA, 1758 nt, Artificial Sequence; identical to SEQ ID NO: 14254
  derived and/or modified CDS sequence (AUadapt) from InfluenzaB__AHL92222__HA

SEQ ID NO: 15693 - RNA, 1755 nt, Artificial Sequence; identical to SEQ ID NO: 15569
  derived and/or modified CDS sequence (AUadapt) from InfluenzaB__AHL92233__HA

SEQ ID NO: 15694 - RNA, 1758 nt, Artificial Sequence; identical to SEQ ID NO: 15679
  derived and/or modified CDS sequence (AUadapt) from InfluenzaB__AHL92244__HA

SEQ ID NO: 15695 - RNA, 1758 nt, Artificial Sequence; identical to SEQ ID NO: 14254
  derived and/or modified CDS sequence (AUadapt) from InfluenzaB__AHL92255__HA

SEQ ID NO: 15696 - RNA, 1758 nt, Artificial Sequence; identical to SEQ ID NO: 14254
  derived and/or modified CDS sequence (AUadapt) from InfluenzaB__AHL92266__HA

SEQ ID NO: 15697 - RNA, 1758 nt, Artificial Sequence
  derived and/or modified CDS sequence (AUadapt) from InfluenzaB__AHL92277__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugccccaagugucugaacugcaccgaccuggacguggcccucgggcgccccaagugcaccggcaacaucccguccgcccgggugagcauccugcacgagguccgccccgugacguccggcugcuuccccaucaugcacgaccggaccaagauccgccagcugcccaaccuccugcggggguacgagcauauccgccugucgacccacaacgugaucaacgccgagaacgcgccgggcgggcccuacaagaucggcaccuccgggucgugccccaacgucacgaacggcaacggcuucuucgccaccauggccugggccgugcccaagaaugacaacaacaagaccgcgaccaacucccucacgaucgaggugccguacaucugcaccgagggggaggaccagaucaccgucuggggcuuccacagcgacaacgagacccagauggccaagcuguacggggacuccaagccccagaaguuuacgucguccgccaacggcgugaccacccacuacgugagccagaucggcggguuccccaaccagaccgaggacggcgggcugccccaguccggccggaucgucguggacuacauggugcagaaguccgggaagacgggcaccaucaccuaccagcgcggcauccuccugccgcagaaggucuggugcgccuccgggcggucgaaggugaucaagggcucgcugccccucaucggggaggccgauugccugcacgagaaguacggcgggcugaacaaguccaagcccuacuacaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuucuggagggcgggugggagggcaugaucgccggguggcacggcuacaccagccacggggcccacggcgucgccguggccgcggaccugaaguccacccaggaggccaucaacaagaucacgaagaaccucaacucgcuguccgagcuggaggucaagaaccuccagcgccugagcggcgccauggacgagcugcacaaugagauccucgagcuggacgagaagguggacgaccugcgggccgacaccaucuccucgcagaucgagcucgccgugcugcuguccaacgaggggaucaucaacucggaggacgagcaccuccuggcgcuggagcgcaagcucaagaagaugcugggccccuccgccgucgagaucgggaacggcugcuucgagaccaagcauaagugcaaccagaccugccuggaccggaucgccaccgggacguucgacgccggcgaguucagccuccccaccuucgacucccugaacaucaccgcggccucgcugaacgacgauggccucgacaaccacaccauccugcuguacuacuccacggccgccagcucccuggccgugacccucaugaucgcgaucuucguggucuacauggugucgcgcgacaacguguccugcagcaucugccuguga

SEQ ID NO: 15698 - RNA, 1758 nt, Artificial Sequence; identical to SEQ ID NO: 14254
  derived and/or modified CDS sequence (AUadapt) from InfluenzaB__AHL92288__HA

SEQ ID NO: 15699 - RNA, 1758 nt, Artificial Sequence; identical to SEQ ID NO: 14254
  derived and/or modified CDS sequence (AUadapt) from InfluenzaB__AHL92299__HA

SEQ ID NO: 15700 - RNA, 1755 nt, Artificial Sequence; identical to SEQ ID NO: 15372
  derived and/or modified CDS sequence (AUadapt) from InfluenzaB__AHL92310__HA

SEQ ID NO: 15701 - RNA, 1755 nt, Artificial Sequence; identical to SEQ ID NO: 14307
  derived and/or modified CDS sequence (AUadapt) from InfluenzaB__AHL92321__HA

SEQ ID NO: 15702 - RNA, 1755 nt, Artificial Sequence; identical to SEQ ID NO: 14307
  derived and/or modified CDS sequence (AUadapt) from InfluenzaB__AHL92332__HA

SEQ ID NO: 15703 - RNA, 1755 nt, Artificial Sequence
  derived and/or modified CDS sequence (AUadapt) from InfluenzaB__AHL92354__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacuguaccgaccuggacguggcccucgggcggcccaugugcgugggcaucaccccguccgccaaggccagcauccugcacgagguccgccccgugacguccggcugcuuccccaucaugcaugaccggaccaagauccgccagcuggcgaaccuccugcggggguacgagaacauccgccugagcacccagaacguggucgacgccgagaaggcccccggcgggccguaucggcucggcaccuccgggagcugccccaacgccacguccaagagcggcuucuucgcgaccauggccugggccgugcccaaggacaauaacaagaacgccaccaacccccugaccguggaggucccguacaucugcacggagggcgaggaccagaucaccguguggggguuccauuccgacaacaagacccagaugaagaaccuguacggcgacucgaacccccagaaguuuaccuccagcgccaacggggugacgacccacuacgucucccagaucggcggcuuccccgaccagaccgaggacgggggccucccccagagugggcgcaucgugguggacuacaugaugcagaagccgggcaagaccgggacgaucgucuaccagcggggcgugcugcugccccagaagguguggugcgcguccggccgcagcaaggucaucaaggggagccucccccugaucggcgaggccgacugucugcacgagaaguacgggggccucaacaaguccaagcccuacuacaccggggagcacgccaaggccaucggcaacuguccgaucugggugaagacgccccugaagcuggccaacggcaccaaguaccggccgcccgcgaagcuccugaaggagcgcggguucuucggcgccaucgccggguuccuggagggcgggugggagggcaugaucgccggcuggcacggguacaccagucacggcgcccacggggucgcgguggccgccgaccucaaguccacccaggaggccaucaacaagaucaccaagaaccugaacagccuguccgagcucgaggugaagaaucugcagcggcugucgggcgccauggacgagcuccacaacgagauccuggagcuggacgagaaggucgacgaccuccgcgcggauaccaucuccagccagaucgagcuggccgugcugcucuccaacgagggcaucaucaacagcgaggacgagcaccuccuggcccuggagcggaagcugaagaagaugcuggggcccuccgccguggacaucggcaaugggugcuucgagacgaagcacaagugcaaccagaccugccucgaccgcaucgcggccggcaccuuuaacgccggggaguucagccugcccaccuucgacucccugaacaucaccgccgccagccucaaugacgacggccuggacaaccacacgauccugcuguacuacuccaccgcggccaguucccucgccgucacccugaugcuggccaucuucaucguguacauggugagccgggacaacgucuccugcagcaucugccucuga

SEQ ID NO: 15704 - RNA, 1755 nt, Artificial Sequence; identical to SEQ ID NO: 15703
  derived and/or modified CDS sequence (AUadapt) from InfluenzaB__AHL92365__HA

SEQ ID NO: 15705 - RNA, 1755 nt, Artificial Sequence; identical to SEQ ID NO: 14117
  derived and/or modified CDS sequence (AUadapt) from InfluenzaB__AHL92376__HA

SEQ ID NO: 15706 - RNA, 1755 nt, Artificial Sequence; identical to SEQ ID NO: 14117
  derived and/or modified CDS sequence (AUadapt) from InfluenzaB__AHL92387__HA

SEQ ID NO: 15707 - RNA, 1755 nt, Artificial Sequence; identical to SEQ ID NO: 14117
  derived and/or modified CDS sequence (AUadapt) from InfluenzaB__AHL92398__HA

SEQ ID NO: 15708 - RNA, 1755 nt, Artificial Sequence; identical to SEQ ID NO: 14117
  derived and/or modified CDS sequence (AUadapt) from InfluenzaB__AHL92409__HA

SEQ ID NO: 15709 - RNA, 1755 nt, Artificial Sequence; identical to SEQ ID NO: 14117
  derived and/or modified CDS sequence (AUadapt) from InfluenzaB__AHL92420__HA

SEQ ID NO: 15710 - RNA, 1755 nt, Artificial Sequence; identical to SEQ ID NO: 14307
  derived and/or modified CDS sequence (AUadapt) from InfluenzaB__AHL92431__HA

SEQ ID NO: 15711 - RNA, 1755 nt, Artificial Sequence; identical to SEQ ID NO: 14117
  derived and/or modified CDS sequence (AUadapt) from InfluenzaB__AHL92442__HA

SEQ ID NO: 15712 - RNA, 1755 nt, Artificial Sequence; identical to SEQ ID NO: 14117
  derived and/or modified CDS sequence (AUadapt) from InfluenzaB__AHL92453__HA

SEQ ID NO: 15713 - RNA, 1755 nt, Artificial Sequence; identical to SEQ ID NO: 14117
  derived and/or modified CDS sequence (AUadapt) from InfluenzaB__AHL92464__HA

SEQ ID NO: 15714 - RNA, 1755 nt, Artificial Sequence
  derived and/or modified CDS sequence (AUadapt) from InfluenzaB__AHL92475__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacugcaccgaucuggacguggcccucgggcggcccaugugcgugggcaccacgccguccgccaaggccagcauccugcacgagguccgccccgugaccuccggcugcuuccccaucaugcacgaucggaccaagauccgccagcugcccaaccuccugcggggguacgagaacauccgccugagcacccagaacgugaucgacgcggagaaggccccgggcgggcccuaccggcucggcacguccgggagcugucccaacgccaccuccaagaucggcuucuucgccaccauggcgugggccguccccaaggacaacuacaagaacgccaccaauccgcugacgguggaggugcccuacaucugcaccgagggcgaggaccagaucaccgucuggggguuccacagcgacaacaagacccagaugaagaaucuguacggcgacuccaacccccagaaguucacgucguccgccaacggggugaccacccacuaugugagccagaucggcgacuuccccgaccagaccgaggacggcgggcucccgcaguccggccgcaucgucguggacuacaugaugcagaagcccgggaagacgggcaccaucguguaccagcgcgggguccugcugccccagaagguguggugugccagcggccgguccaaggugaucaagggcagccucccccugaucggggaggcggacugccugcacgagaaguacggcgggcucaacaagaguaagccguacuacaccggcgagcacgccaaggccaucgggaacugccccaucugggucaagacgccccugaagcuggccaacggcaccaaguaccggcccccggccaagcuccugaaggagcgcggcuucuuuggggcgaucgccggcuuccuggagggcgggugggaggggaugaucgccggcuggcacggcuacaccucccacggggcccacggcguggccgucgcggccgaccucaagagcacccaggaggccaucaauaagaucaccaagaaccugaacucccugagcgagcucgaggugaagaaccugcagcggcuguccggggccauggacgagcuccacaacgagauccuggagcuggacgagaagguggaugaccuccgcgccgacacgaucucgucccagaucgagcuggcgguccugcucagcaacgagggcaucaucaacuccgaggacgagcaucuccuggcccuggagcggaagcugaagaagaugcugggccccagcgccguggacaucgggaacggcugcuucgagaccaagcacaagugcaaccaggccugucucgaccgcaucgcggccgggaccuucaacgccggcgaguucucccugcccaccuucgacagccugaauaucaccgccgccucccucaacgacgacgggcuggacaaccacacgauccugcuguacuacaguaccgcggccuccagccucgccgugacccugaugcuggccaucuucaucgucuacauggugucccgggacaacgugagcugcuccaucugccucuga

SEQ ID NO: 15715 - RNA, 1755 nt, Artificial Sequence; identical to SEQ ID NO: 14307
  derived and/or modified CDS sequence (AUadapt) from InfluenzaB__AHL92486__HA

SEQ ID NO: 15716 - RNA, 1755 nt, Artificial Sequence; identical to SEQ ID NO: 14117
  derived and/or modified CDS sequence (AUadapt) from InfluenzaB__AHL92497__HA

SEQ ID NO: 15717 - RNA, 1755 nt, Artificial Sequence; identical to SEQ ID NO: 14117
  derived and/or modified CDS sequence (AUadapt) from InfluenzaB__AHL92508__HA

SEQ ID NO: 15718 - RNA, 1755 nt, Artificial Sequence; identical to SEQ ID NO: 14117
  derived and/or modified CDS sequence (AUadapt) from InfluenzaB__AHL92519__HA

SEQ ID NO: 15719 - RNA, 1755 nt, Artificial Sequence; identical to SEQ ID NO: 14117
  derived and/or modified CDS sequence (AUadapt) from InfluenzaB__AHL92530__HA

SEQ ID NO: 15720 - RNA, 1755 nt, Artificial Sequence; identical to SEQ ID NO: 14307
  derived and/or modified CDS sequence (AUadapt) from InfluenzaB__AHL92541__HA

SEQ ID NO: 15721 - RNA, 1752 nt, Artificial Sequence
  derived and/or modified CDS sequence (AUadapt) from InfluenzaB__AHL92563__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaagaaguccuauuucgccaaccugaaggggacccggacgcgcggcaagcucugccccgacugccugaacugcaccgaccuggauguggcccucgggcggcccaugugcgugggcaccaccccguccgccaaggccagcauccugcacgagguccgccccgugacguccggcugcuuccccaucaugcacgaccggaccaagauccgccagcugcccaaccuccugcggggguaugagaacauccgccugagcacccagaacgugaucgacgcggagaaggccccgggcgggcccuaccggcucggcaccuccgggucgugccccaacgccacguccaagaucggcuuuuucgccaccauggcgugggccguccccaaggacaacuacaagaacgccaccaacccgcugaccguggaggugcccuacaucugcacggagggcgaggaucagaucaccgucuggggguuccacagcgacaacaagacccagaugaagaaccuguacggcgacuccaauccccagaaguucaccagcuccgccaacggggugacgacccacuacgugagccagaucggcgacuuccccgaucagaccgaggacggcgggcucccgcaguccggccgcaucgucguggacuacaugaugcagaagcccgggaagaccggcacgaucguguaccagcgcgggguccugcugccccagaagguguggugcgccagcggccgguccaaggugaucaagggcucgcucccccugaucggggaggcggacugucugcacgagaaguacggcgggcucaacaagagcaagccguacuacaccggcgagcacgccaaggccaucgggaacugucccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccucccacggggcccauggcguggccgucgcggccgaccucaagagcacccaggaggccaucaacaagaucaccaagaaccugaacucccugagcgagcucgaggugaagaaccugcagcggcuguccggggccauggacgagcuccauaacgagauccuggagcuggacgagaagguggacgaccuccgcgccgacaccaucagcucccagaucgagcuggcgguccugcucucgaacgagggcaucaucaauuccgaggacgagcaccuccuggcccuggagcggaagcugaagaagaugcugggccccagcgccguggacaucgggaacggcugcuucgagacgaagcacaaguguaaccagaccugccucgaccgcaucgccgcggggaccuucaacgccggcgaguucucccugcccaccuucgacagucugaacaucaccgccgccucccucaacgacgggcuggacaaccacacgauccugcuguacuacaguaccgccgcguccagccucgccgugacccugaugcuggccaucuucaucgucuacauggugucccgggacaacgugagcugcuccaucugccucuga

SEQ ID NO: 15722 - RNA, 1755 nt, Artificial Sequence; identical to SEQ ID NO: 14117
  derived and/or modified CDS sequence (AUadapt) from InfluenzaB__AHL92574__HA

SEQ ID NO: 15723 - RNA, 1755 nt, Artificial Sequence
  derived and/or modified CDS sequence (AUadapt) from InfluenzaB__AHL92585__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacuguaccgaccuggacguggcccucgggcggcccaugugcgugggcgccaccccguccgccaaggcgagcauccugcacgagguccgccccgugacguccggcugcuuccccaucaugcaugaccggaccaagauccgccagcugcccaaccuccugcggggguacgagaacauccgccugagcacccagaacgugaucgacgccgagaaggccccgggcgggcccuaucggcucggcaccuccgggucgugccccaacgccacguccaagagcggcuucuucgcgaccauggccugggccguccccaaggacaauaacaagaacgccaccaacccgcugaccguggaggugcccuacaucugcacggagggcgaggaccagaucaccgucuggggguuccauuccgacaacaagacccagaugaagaaccuguacggcgacagcaacccccagaaguuuaccuccagcgccaacggggugacgacccacuacgugucccagaucggcagcuuccccgaccagaccgaggauggcgggcucccgcaguccggccgcaucgucguggacuacaugaugcagaagcccgggaagaccggcacgaucguguaccagcgcgggguccugcugccccagaagguguggugcgcgagcggccggucgaaggugaucaagggcucccucccccugaucggggaggccgacugucugcacgagaaguacggcgggcucaacaagagcaagccguacuacaccggcgagcacgccaaggccaucgggaauugccccaucugggucaagacgccccugaagcuggccaacggcaccaaguaccggcccccggcgaagcuccugaaggagcgcggcuucuucggggccaucgccggcuuccuggagggcgggugggaggggaugaucgccggcuggcacggcuauaccucccacggggcccacggcguggcggucgccgccgaccucaagagcacccaggaggccaucaacaagaucaccaagaaccugaacucccugagugagcucgaggugaagaaccugcagcggcuguccggggccauggacgagcuccacaacgagauccuggagcuggacgagaagguggacgaccuccgcgcggauaccaucagcucccagaucgagcuggccguccugcucagcaacgagggcaucaucaacuccgaggacgagcaccuccuggcccuggagcggaagcugaagaagaugcugggccccucggccguggagaucgggaauggcugcuucgagacgaagcacaagugcaaccagaccugccucgaccgcaucgcggccgggaccuuuaacgccggcgaguucucccugcccaccuucgacagccugaacaucaccgccgccucccucaacgaugacgggcuggacaaccacacgauccugcuguacuacagcaccgcggccuccagucucgccgugacccugaugcuggccaucuucaucgucuacauggugucccgggacaacgugagcugcagcaucugccucuga

SEQ ID NO: 15724 - RNA, 1755 nt, Artificial Sequence; identical to SEQ ID NO: 14117
  derived and/or modified CDS sequence (AUadapt) from InfluenzaB__AHL92596__HA

SEQ ID NO: 15725 - RNA, 1755 nt, Artificial Sequence; identical to SEQ ID NO: 14307
  derived and/or modified CDS sequence (AUadapt) from InfluenzaB__AHL92607__HA

SEQ ID NO: 15726 - RNA, 1755 nt, Artificial Sequence
  derived and/or modified CDS sequence (AUadapt) from InfluenzaB__AHL92629__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccgagaaguccuauuucgccaaccugaaggggacccggacgcgcggcaagcucugccccgacugccugaacugcaccgaccuggauguggcccucgggcggcccaugugcgugggcaccaccccguccgccaaggccagcauccugcacgagguccgccccgugacguccggcugcuuccccaucaugcacgaccggaccaagauccgccagcugcccaaccuccugcggggguaugagaacauccgccugagcacccagaacgugaucgacgcggagaaggccccgggcgggcccuaccggcucggcaccuccgggucgugccccaacgccacguccaagaucggcuuuuucgccaccauggcgugggccguccccaaggacaacuacaagaacgccaccaacccgcugaccguggaggugcccuacaucugcacggagggcgaggaucagaucaccgucuggggguuccacagcgacaacaagacccagaugaagaaccuguacggcgacuccaauccccagaaguucaccagcuccgccaacggggugacgacccacuacgugagccagaucggcgacuuccccgaucagaccgaggacggcgggcucccgcaguccggccgcaucgucguggacuacaugaugcagaagcccgggaagaccggcacgaucguguaccagcgcgggguccugcugccccagaagguguggugcgccagcggccgguccaaggugaucaagggcucgcucccccugaucggggaggcggacugucugcacgagaaguacggcgggcucaacaagagcaagccguacuacaccggcgagcacgccaaggccaucgggaacugucccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccucccacggggcccauggcguggccgucgcggccgaccucaagagcacccaggaggccaucaacaagaucaccaagaaccugaacucccugagcgagcucgaggugaagaaccugcagcggcuguccggggccauggacgagcuccauaacgagauccuggagcuggacgagaagguggacgaccuccgcgccgacaccaucagcucccagaucgagcuggcgguccugcucucgaacgagggcaucaucaauuccgaggacgagcaccuccuggcccuggagcggaagcugaagaagaugcugggccccagcgccguggacaucgggaacggcugcuucgagacgaagcacaaguguaaccagaccugccucgaccgcaucgccgcggggaccuucaacgccggcgaguucucccugcccaccuucgacagucugaacaucaccgccgccucccucaacgacgacgggcuggacaaccacacgauccugcuguacuauagcaccgccgcguccagccucgccgugacccugaugcuggccaucuucaucgucuacauggugucccgggacaacgugagcugcuccaucugccucuga

SEQ ID NO: 15727 - RNA, 1755 nt, Artificial Sequence; identical to SEQ ID NO: 14307
  derived and/or modified CDS sequence (AUadapt) from InfluenzaB__AHL92640__HA

SEQ ID NO: 15728 - RNA, 1755 nt, Artificial Sequence; identical to SEQ ID NO: 14307
  derived and/or modified CDS sequence (AUadapt) from InfluenzaB__AHL92651__HA

SEQ ID NO: 15729 - RNA, 1755 nt, Artificial Sequence
  derived and/or modified CDS sequence (AUadapt) from InfluenzaB__AHL92684__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuauuucgccaaccugaaggggacgcggacccgcggcaagcucugccccgacugccugaacugcaccgaccuggauguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguaugagaacauccgccugucgacccagaacgugaucgacgcggagaaggccccgggcgggcccuaccggcucggcacguccgggagcugccccaacgccaccuccaagaguggcuucuucgccaccauggcgugggccguccccaaggacaacaacaagaacgccaccaacccgcugacgguggaggugcccuacaucuguaccgagggcgaggaccagaucaccgucuggggguuccacuccgacaacaagacccagaugaagaaccuguacggcgacaguaacccccagaaguucacguccagcgccaacggggugaccacccacuacgugucccagaucggcucguuccccgaucagaccgaggacggcgggcucccgcaguccggccgcaucgucguggacuacaugaugcagaagcccgggaagacgggcaccaucguguaccagcgcgggguccugcugccccagaagguguggugcgccagcggccggagcaaggugaucaagggcucccucccccugaucggggaggcggacugucugcacgagaaguacggcgggcucaacaagagcaagccguacuacaccggcgagcacgccaaggccaucgggaacugucccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcacggcuacaccucccacggggcccauggcguggccgucgcggccgaccucaagucgacccaggaggccaucaacaagaucaccaagaaccugaacucccugagcgagcucgaggugaagaaccugcagcggcuguccggggccauggacgagcuccauaacgagauccuggagcuggacgagaagguggacgaccuccgcgccgacacgaucagcucccagaucgagcuggcgguccugcucagcaacgagggcaucaucaauuccgaggacgagcaccuccuggcccuggagcggaagcugaagaagaugcugggccccagcgccguggagaucgggaacggcugcuucgagaccaagcacaagugcaaucagaccugccucgaccgcaucgccgcggggaccuucaacgccggcgaguucucccugcccaccuucgacucgcugaauaucacggccgccucccucaacgacgacgggcuggacaaccacaucauccugcuguacuacaguaccgccgcguccagccucgccgugacccugaugcuggccaucuucaucgucuacauggugucccgggacaacgugagcugcagcaucugccucuga

SEQ ID NO: 15730 - RNA, 1755 nt, Artificial Sequence; identical to SEQ ID NO: 14117
  derived and/or modified CDS sequence (AUadapt) from InfluenzaB__AHL92695__HA

SEQ ID NO: 15731 - RNA, 1755 nt, Artificial Sequence; identical to SEQ ID NO: 14117
  derived and/or modified CDS sequence (AUadapt) from InfluenzaB__AHL92706__HA

SEQ ID NO: 15732 - RNA, 1755 nt, Artificial Sequence
  derived and/or modified CDS sequence (AUadapt) from InfluenzaB__AHL92728__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuacuuugccaaccugaaggggacgcggacccgcggcaagcucugccccgacugccugaacugcaccgaccuggacguggcccucgggcggcccaugugcgugggcaccacgccguccgccaaggccaguauccugcacgagguccgccccgugaccuccggcugcuuccccaucaugcacgaccggaccaagauccgccagcugcccaaccuccugcggggguacgagaacauccgccugagcacccagaacgugaucgaugcggagaaggccccgggcgggcccuaccggcucggcacguccgggagcugccccaacgccaccuccaagaucggcuucuucgccaccauggcgugggccguccccaaggacaacuacaagaaugccaccaacccgcugacgguggaggugcccuacaucugcaccgagggcgaggaccagaucaccgucuggggguuccacagcgacaacaagacccagaugaagaaucuguacggcgacuccaacccccagaaguucacgucguccgccaacggggugaccacccacuacgugagccagaucggcgacuuucccgaccagaccgaggacggcgggcucccgcaguccggccgcaucgucguggacuacaugaugcagaagcccgggaagacgggcaccaucguguaccagcgcgggguccugcugccccagaagguguggugcgccagcggccgguccaaggugaucaagggcucgcucccccugaucggggaggcggacugucugcacgagaaguacggcgggcucaacaagagcaagccguacuacaccggcaagcacgccaaggccaucgggaacugccccaucugggucaagacgccccugaagcuggccaauggcaccaaguaccggcccccggccaagcuccugaaggagcgcggcuucuucggggcgaucgccggcuuccuggagggcgggugggaggggaugaucgccggcuggcacggcuacaccucccacggggcccacggcguggccgucgcggccgaccucaagagcacccaggaggccaucaauaagaucaccaagaaccugaacucccugagcgagcucgaggugaagaaccugcagcggcuguccggggccauggacgagcuccacaacgagaucaucgagcuggacgagaagguggacgaucugcgcgccgacacgaucucgucccagaucgagcucgcgguccugcugagcaacgagggcaucaucaacuccgaggacgagcaccuccuggcccuggagcggaagcucaagaagaugcugggccccagcgccguggacaucgggaauggcugcuucgagaccaagcacaagugcaaccagaccugccuggaccgcaucgccgcggggaccuucaacgccggcgaguucucccuccccaccuuugacucgcugaacaucacggccgccucccugaacgacgacgggcucgacaaccacaccauccugcuguauuacagcaccgccgcguccagccuggccgugacccucaugcuggccaucuucaucgucuacauggugucccgggacaacgugagcugcuccaucugccuguga

SEQ ID NO: 15733 - RNA, 1755 nt, Artificial Sequence; identical to SEQ ID NO: 15732
  derived and/or modified CDS sequence (AUadapt) from InfluenzaB__AHL92739__HA

SEQ ID NO: 15734 - RNA, 1755 nt, Artificial Sequence; identical to SEQ ID NO: 15732
  derived and/or modified CDS sequence (AUadapt) from InfluenzaB__AHL92750__HA

SEQ ID NO: 15735 - RNA, 1755 nt, Artificial Sequence; identical to SEQ ID NO: 14117
  derived and/or modified CDS sequence (AUadapt) from InfluenzaB__AHL92761__HA

SEQ ID NO: 15736 - RNA, 1755 nt, Artificial Sequence
  derived and/or modified CDS sequence (AUadapt) from InfluenzaB__AHL92772__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuauuucgccaaccugaaggggacgcggacccgcggcaagcucugccccgacugccugaacugcaccgaccuggacguggcccucgggcggcccauguguaugggcaccacgccguccgccaaggccagcauccugcacgaggugcgccccgucaccuccggcugcuuccccaucaugcacgaccggaccaagauccgccagcugcccaaccuccugcggggguacgagaacauccgccugaguacccagaacgugaucgacgcggagaaggccccgggcgggcccuaccggcucggcacguccgggagcugccccaacgccaccuccaagaucggcuucuucgccaccauggcgugggccgugcccaaggauaacuacaagaacgccaccaacccgcugacggucgaggugcccuacaucugcaccgagggcgaggaccagaucaccguguggggguuccacagugacaacaagacccagaugaagaaccuguacggcgacuccaacccccagaaguucacgagcuccgccaacggggucaccacccauuacgugucgcagaucggcgacuuccccgaccagaccgaggacggcgggcucccgcaguccggccgcaucguggucgacuacaugaugcagaagcccgggaagacgggcaccaucguguaucagcgcggggugcugcugccccagaaggucuggugcgccagcggccgguccaaggugaucaagggcagccucccccugaucggggaggcggacugccugcacgagaaguacggcgggcucaacaagagcaagccguauuacaccggcgagcacgccaaggccaucgggaacugccccaucugggugaagacgccccugaagcuggccaacggcaccaaguaccggcccccggccaagcuccugaaggagcgcggcuucuucggggcgaucgccggcuuccuggagggcgggugggaggggaugaucgccggcuggcauggcuacaccucccacggggcccacggcgucgccguggcggccgaccucaagucgacccaggaggccaucaacaagaucaccaagaaccugaacucccugagugagcucgaggucaagaaccugcagcggcuguccggggccauggacgagcuccacaacgagauccuggagcuggacgagaagguggacgaccuccgcgccgacacgaucagcucccagaucgagcuggcggugcugcucaguaacgagggcaucaucaacuccgaggacgagcaccuccuggcccuggagcggaagcugaagaagaugcugggccccucggccgucgacaucgggaacggcugcuucgagaccaagcauaagugcaaccagaccugccucgaccgcaucgccgcggggaccuucaacgccggcgaguucucccugcccaccuucgauagccugaacaucacggccgccucccucaacgacgacgggcuggacaaccacaccauccugcuguacuauagcaccgccgcguccagccucgccgugacccugaugcuggccaucuucaucguguacauggucucccgggacaacgugagcugcuccaucugccucuga

SEQ ID NO: 15737 - RNA, 1755 nt, Artificial Sequence; identical to SEQ ID NO: 14117
  derived and/or modified CDS sequence (AUadapt) from InfluenzaB__AHL92794__HA

SEQ ID NO: 15738 - RNA, 1755 nt, Artificial Sequence; identical to SEQ ID NO: 14117
  derived and/or modified CDS sequence (AUadapt) from InfluenzaB__AHL92805__HA

SEQ ID NO: 15739 - RNA, 1755 nt, Artificial Sequence; identical to SEQ ID NO: 14117
  derived and/or modified CDS sequence (AUadapt) from InfluenzaB__AHL92816__HA

SEQ ID NO: 15740 - RNA, 1755 nt, Artificial Sequence
  derived and/or modified CDS sequence (AUadapt) from InfluenzaB__AHL92827__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacugcaccgaucuggacguggcccucgggcggcccaugugcgugggcaccacgccguccgccaaggccagcauccugcacgagguccgccccgugaccuccggcugcuuccccaucaugcacgaucggaccaagauccgccagcugcccaaccuccugcggggguacgagaacauccgccugagcacccagaacgugaucgacgcggagaaggccccgggcgggcccuaccggcucggcacguccgggagcugucccaacgccaccuccaagaucggcuucuucgccaccauggcgugggccguccccaaggacaacuacaagaacgccaccaauccgcugacgguggaggugcccuacaucugcaccgagggcgaggaccagaucaccgucuggggguuccacagcgacaacaagacccagaugaagaaucuguacggcgacuccaacccccagaaguucacgucguccgccaacggggugaccacccacuaugugagccagaucggcgacuuccccgaccagaccgaggacggcgggcucccgcaguccggccgcaucgucguggacuacaugaugcagaagcccgggaagacgggcaccaucguguaccagcgcgggguccugcugccccagaagguguggugugccagcggccgguccaaggugaucaagggcagccucccccugaucggggaggcggacugccugcacgagaaguacggcgggcucaacaagaguaagccguacuacaccggcgagcacgccaaggccaucgggaacugccccaucugggucaagacgccccugaagcuggccaacggcaccaaguaccggcccccggccaagcuccugaaggagcgcggcuucuuuggggcgaucgccggcuuccuggagggcgggugggaggggaugaucgccggcuggcacggcuacaccucccacggggcccacggcguggccgucgcggccgaccucaagagcacccaggaggccaucaauaagaucaccaagaaccugaacucccugagcgagcucgaggugaagaaccugcagcggcuguccggggccauggacgagcuccacaacgagauccuggagcuggacgagaagguggaugaccuccgcgccgacacgaucucgucccagaucgagcuggcgguccugcucagcaacgagggcaucaucaacuccgaggacgagcaucuccuggcccuggagcggaagcugaagaagaugcugggccccagcgccguggacaucgggaacggcugcuucgagaccaagcacaagugcaaccagaccugucucgaccgcaucgccgcggggaccuucaacgccggcgaguucucccugcccaccuucgacagccugaauaucacggccgccucccucaacgacgacgggcuggacaaccacaccauccugcuguacuacaguaccgccgcguccagccucgccgugacccugaugcuggccaucuucgucguguacauggugucccgggacaacgucagcugcuccaucugccucuga

SEQ ID NO: 15741 - RNA, 1755 nt, Artificial Sequence; identical to SEQ ID NO: 14117
  derived and/or modified CDS sequence (AUadapt) from InfluenzaB__AHL92838__HA

SEQ ID NO: 15742 - RNA, 1755 nt, Artificial Sequence; identical to SEQ ID NO: 14117
  derived and/or modified CDS sequence (AUadapt) from InfluenzaB__AHL92849__HA

SEQ ID NO: 15743 - RNA, 1755 nt, Artificial Sequence; identical to SEQ ID NO: 14117
  derived and/or modified CDS sequence (AUadapt) from InfluenzaB__AHL92860__HA

SEQ ID NO: 15744 - RNA, 1758 nt, Artificial Sequence; identical to SEQ ID NO: 14378
  derived and/or modified CDS sequence (AUadapt) from InfluenzaB__AHL92871__HA

SEQ ID NO: 15745 - RNA, 1755 nt, Artificial Sequence; identical to SEQ ID NO: 14166
  derived and/or modified CDS sequence (AUadapt) from InfluenzaB__AHL92882__HA

SEQ ID NO: 15746 - RNA, 1758 nt, Artificial Sequence
  derived and/or modified CDS sequence (AUadapt) from InfluenzaB__AHL92893__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaauaucccguccgccgaggugucgauccugcacgagguccggcccgugacguccggcugcuuccccaucaugcacgaccgcaccaagauccggcagcugcccaaccuccugcgcggguacgagcacauccggcugucgacccacaacgugaucaacgccgagaaggcgccgggcgggcccuacaagaucggcaccuccgggucgugccccaacgucacgaacggcaacggcuucuuugccaccauggccugggccgugcccaagaacgacaacaacaagaccgcgaccaacucccucacgaucgaggugccguacaucugcaccgagggggaggaccagaucaccaucuggggcuuccacagcgacaaggagacccagauggccaagcuguacggggacuccaagccccagaaguucacgucguccgccaacggcgucaccacccacuacgugagucagaucggcggguuccccaaccagaccgaggacggcgggcugccccaguccggccgcaucguggucgacuacauggugcagaaguccgggaagacgggcaccaucaccuaccagcggggcauccuccugccgcagaagguguggugcgccuccgggcgcagcaaggucaucaagggcucgcugccccucaucggggaggccgacugccugcacgagaaguacggcgggcugaacaaguccaagcccuacuacaccggcgagcacgcgaaggccaucggcaacugccccaucugggugaagacgccgcucaagcuggccaacgggaccaaguaucggccgcccgccaagcugcucaaggagcgcggcuucuucggggccaucgcgggcuuccuggagggcgggugggagggcaugaucgccggguggcacggcuacaccucgcacggggcccacggcguggccgucgccgcggaccugaaguccacccaggaggccaucaacaagaucacgaagaaccucaacucgcuguccgagcuggaggugaagaaccuccagcggcugagcggcgccauggacgagcugcacaacgagauccucgagcuggacgagaaggucgaugaccugcgcgccgacaccaucuccucgcagaucgagcucgccgugcugcuguccaacgaggggaucaucaacucggaggacgagcaccuccuggcgcuggagcggaagcucaagaagaugcugggccccuccgccguggagaucgggaacggcugcuucgagaccaagcacaagugcaaccagaccugccuggaccgcaucgccgccgggaccuucgacgcgggcgaguucucgcuccccacguuugacucccugaacaucaccgccgccagccugaacgacgacggccucgacaaccacaccauccugcuguacuacuccaccgccgccucgucccuggcggucacgcucaugaucgccaucuucaucguguacauggugucgcgggacaacgucuccugcagcaucugccuguga

SEQ ID NO: 15747 - RNA, 1755 nt, Artificial Sequence; identical to SEQ ID NO: 14763
  derived and/or modified CDS sequence (AUadapt) from InfluenzaB__AHL92904__HA

SEQ ID NO: 15748 - RNA, 1758 nt, Artificial Sequence
  derived and/or modified CDS sequence (AUadapt) from InfluenzaB__AHL92915__HA
augaaggccaucaucgugcugcucauggucgugaccaguaacgccgaccgcaucugcaccggcaucacguccucgaacucgccccacguggucaagaccgcgacccagggggaggugaacgugaccggcgucaucccgcugacgaccacccccaccaagagccacuucgccaaccugaaggggacgaagacccggggcaagcucugccccaagugccugaacugcaccgaccuggacguggcccucgggcgccccaagugcaccggcaauaucccguccgccgaggugucgauccugcacgagguccggcccgugacguccggcugcuuccccaucaugcacgaccgcaccaagauccggcagcugcccaaccuccugcgcggguacgagcacauccggcugucgacccacaacgugaucaacgccgagaaggcgccgggcgggcccuacaagaucggcaccuccgggucgugccccaacgucacgaacggcaacggcuucuuugccaccauggccugggccgugcccaagaacgacaacaacaagaccgcgaccaacucccucacgaucgaggugccguacaucugcaccgagggggaggaccagaucaccaucuggggcuuccacagcgacaacgagacccagauggccaagcuguacggggacuccaagccccagaaguucacgucguccgccaacggcgucaccacccacuacgugagucagaucggcggguuccccaaccagaccgaggacggcgggcugccccaguccggccgcaucguggucgacuacauggugcagaaguccgggaagacgggcaccaucaccuaccagcggggcauccuccugccgcagaagguguggugcgccuccgggcgcagcaaggucaucaagggcucgcugccccucaucggggaggccgacugccugcacgagaaguacggcgggcugaacaaguccaagcccuacuacaccggcgagcacgcgaaggccaucggcaacugccccaucugggugaagacgccgcucaagcuggccaaugggaccaaguaccggccgcccgccaagcugcucaaggagcgcggcuucuucggggccaucgcgggcuuccuggagggcgggugggagggcaugaucgccggguggcacggcuacaccucgcacggggcccacggcguggccgucgccgcggaccugaaguccacccaggaggccaucaacaagaucacgaagaaccucaacucgcuguccgagcuggaggugaagaaccuccagcggcugagcggcgccauggacgagcugcacaacgagauccucgagcuggacgagaaggucgaugaccugcgcgccgacaccaucuccucgcagaucgagcucgccgugcugcuguccaacgaggggaucaucaacucggaggacgagcaccuccuggcgcuggagcggaagcucaagaagaugcugggccccuccgccguggagaucgggaacggcugcuucgagaccaagcacaagugcaaccagaccugccuggaccgcaucgccgccgggaccuucgacgcgggcgaguucucgcuccccacguuugacucccugaacaucaccgccgccagccugaacgacgacggccucgacaaccacaccauccugcuguacuacuccaccgccgccucgucccuggcggucacgcucaugaucgccaucuucaucguguacauggugucgcgggacaacgucuccugcagcaucugccuguga

SEQ ID NO: 15749 - RNA, 1758 nt, Artificial Sequence; identical to SEQ ID NO: 14378
  derived and/or modified CDS sequence (AUadapt) from InfluenzaB__AHL92926__HA

SEQ ID NO: 15750 - RNA, 1755 nt, Artificial Sequence; identical to SEQ ID NO: 15339
  derived and/or modified CDS sequence (AUadapt) from InfluenzaB__AHL92937__HA

SEQ ID NO: 15751 - RNA, 1758 nt, Artificial Sequence; identical to SEQ ID NO: 14254
  derived and/or modified CDS sequence (AUadapt) from InfluenzaB__AHL92948__HA

SEQ ID NO: 15752 - RNA, 1758 nt, Artificial Sequence; identical to SEQ ID NO: 14254
  derived and/or modified CDS sequence (AUadapt) from InfluenzaB__AHL92959__HA

SEQ ID NO: 15753 - RNA, 1758 nt, Artificial Sequence; identical to SEQ ID NO: 14254
  derived and/or modified CDS sequence (AUadapt) from InfluenzaB__AHL92970__HA

SEQ ID NO: 15754 - RNA, 1758 nt, Artificial Sequence; identical to SEQ ID NO: 14254
  derived and/or modified CDS sequence (AUadapt) from InfluenzaB__AHL92981__HA

SEQ ID NO: 15755 - RNA, 1758 nt, Artificial Sequence; identical to SEQ ID NO: 14254
  derived and/or modified CDS sequence (AUadapt) from InfluenzaB__AHL92992__HA

SEQ ID NO: 15756 - RNA, 1758 nt, Artificial Sequence; identical to SEQ ID NO: 15679
  derived and/or modified CDS sequence (AUadapt) from InfluenzaB__AHL93004__HA

SEQ ID NO: 15757 - RNA, 1758 nt, Artificial Sequence; identical to SEQ ID NO: 14254
  derived and/or modified CDS sequence (AUadapt) from InfluenzaB__AHL93015__HA

SEQ ID NO: 15758 - RNA, 1758 nt, Artificial Sequence; identical to SEQ ID NO: 14254
  derived and/or modified CDS sequence (AUadapt) from InfluenzaB__AHL93026__HA

SEQ ID NO: 15759 - RNA, 1755 nt, Artificial Sequence; identical to SEQ ID NO: 15703
  derived and/or modified CDS sequence (AUadapt) from InfluenzaB__AHL93037__HA

SEQ ID NO: 15760 - RNA, 1755 nt, Artificial Sequence; identical to SEQ ID NO: 15703
  derived and/or modified CDS sequence (AUadapt) from InfluenzaB__AHL93048__HA

SEQ ID NO: 15761 - RNA, 1755 nt, Artificial Sequence; identical to SEQ ID NO: 15732
  derived and/or modified CDS sequence (AUadapt) from InfluenzaB__AHL93059__HA

SEQ ID NO: 15762 - RNA, 1755 nt, Artificial Sequence; identical to SEQ ID NO: 14117
  derived and/or modified CDS sequence (AUadapt) from InfluenzaB__AHL93070__HA

SEQ ID NO: 15763 - RNA, 1755 nt, Artificial Sequence
  derived and/or modified CDS sequence (AUadapt) from InfluenzaB__AHL93081__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacugcaccgaucuggacguggcccucgggcggcccaugugcgugggcaccacgccguccgccaaggccagcauccugcacgagguccgccccgugaccuccggcugcuuccccaucaugcacgaucggaccaagauccgccagcugcccaaccuccugcggggguacgagaacauccgccugagcacccagaacgugaucgacgcggagaaggccccgggcgggcccuaccggcucggcacguccgggagcugucccaacgccaccuccaagaucggcuucuucgccaccauggcgugggccguccccaaggacaacuacaagaacgccaccaauccgcugacgguggaggugcccuacaucugcaccgagggcgaggaccagaucaccgucuggggguuccacagcgacaacaagacccagaugaagaaucuguacggcgacuccaacccccagaaguucacgucguccgccaacggggugaccacccacuaugugagccagaucggcgacuuccccgaccagaccgaggacggcgggcucccgcaguccggccgcaucgucguggacuacaugaugcagaagcccgggaagacgggcaccaucguguaccagcgcgggguccugcugccccagaagguguggugugccagcggccgguccaaggugaucaagggcagccucccccugaucggggaggcggacugccugcacgagaaguacggcgggcucaacaagaguaagccguacuacaccggcgagcacgccaaggccaucgggaacugccccaucugggucaagacgccccugaagcuggccaacggcaccaaguaccggcccccggccaagcuccugaaggagcgcggcuucuuuggggcgaucgccggcuuccuggagggcgggugggaggggaugaucgccggcuggcacggcuacaccucccacggggcccacggcguggccgucgcggccgaccucaagagcacccaggaggccaucaauaagaucaccaagaaccugaacucccugagcgagcucgaggugaagaaccugcagcggcuguccggggccauggacgagcuccacaacgagauccuggagcuggacggcaagguggaugaccuccgcgccgacacgaucucgucccagaucgagcuggcgguccugcucagcaacgagggcaucaucaacuccgaggacgagcaucuccuggcccuggagcggaagcugaagaagaugcuggggcccagcgccguggacaucggcaacgggugcuucgagaccaagcacaagugcaaccagaccugucucgaccgcaucgccgcgggcaccuucaacgccggggaguucucccugcccaccuucgacagccugaauaucacggccgccucccucaacgacgacggccuggacaaccacaccauccugcuguacuacaguaccgccgcguccagccucgccgugacccugaugcuggccaucuucaucgucuacauggugucccgggacaacgugagcugcuccaucugccucuga

SEQ ID NO: 15764 - RNA, 1755 nt, Artificial Sequence; identical to SEQ ID NO: 14117
  derived and/or modified CDS sequence (AUadapt) from InfluenzaB__AHL93092__HA

SEQ ID NO: 15765 - RNA, 1755 nt, Artificial Sequence; identical to SEQ ID NO: 14117
  derived and/or modified CDS sequence (AUadapt) from InfluenzaB__AHL93103__HA

SEQ ID NO: 15766 - RNA, 1755 nt, Artificial Sequence; identical to SEQ ID NO: 14117
  derived and/or modified CDS sequence (AUadapt) from InfluenzaB__AHL93114__HA

SEQ ID NO: 15767 - RNA, 1755 nt, Artificial Sequence; identical to SEQ ID NO: 14307
  derived and/or modified CDS sequence (AUadapt) from InfluenzaB__AHL93125__HA

SEQ ID NO: 15768 - RNA, 1755 nt, Artificial Sequence
  derived and/or modified CDS sequence (AUadapt) from InfluenzaB__AHL93136__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacuguaccgaccuggacguggcccucgggcggcccaugugcgugggcaccacgccguccgccaaggccagcauccugcacgagguccgccccgugaccuccggcugcuuccccaucaugcaugaccggaccaagauccgccagcugcccaaccuccugcggggguacgagaacauccgccugagcacccagaacgugaucgacgcggagaaggccccgggcgggcccuaucggcucggcacguccgggagcugccccaacgccaccuccaagaucggcuucuucgccaccauggcgugggccguccccaaggacaacuauaagaacgccaccaacccgcugacgguggaggugcccuacaucugcaccgagggcgaggaccagaucaccgucuggggguuccacagugacaacaagacccagaugaagaaccuguacggcgacuccaacccccagaaguucacgaguuccgccaacggggugaccacccacuacgugagccagaucggcgacuuccccgaccagaccgaggauggcgggcucccgcaguccggccgcaucgucguggacuacaugaugcagaagcccgggaagacgggcaccaucguguaccagcgcgggguccugcugccccagcgcguguggugcgccagcggccgguccaaggugaucaagggcucgcucccccugaucggggaggcggacugucugcacgagaaguacggcgggcucaacaagagcaagccguacuacaccggcgagcacgccaaggccaucgggaauugccccaucugggucaagacgccccugaagcuggccaacggcaccaaguaccggcccccggccaagcuccugaaggagcggggcuucuucggggcgaucgccggcuuccuggagggcgggugggaggggaugaucgccggcuggcacggcuauaccucccacggggcccacggcguggccgucgcggccgaccucaagagcacccaggaggccaucaacaagaucaccaagaaccugaacucccugagugagcucgaggugaagaaccugcagcgccuguccggggccauggacgagcuccacaacgagauccuggagcuggacgagaagguggacgaccuccgggccgauacgaucagcucccagaucgagcuggcgguccugcucagcaacgagggcaucaucaacuccgaggacgagcaccuccuggcccuggagcgcaagcugaagaagaugcugggccccagcgccguggauaucgggaacggcugcuucgagaccaagcacaagugcaaccagaccugccucgaucggaucgccgcggggaccuucaacgccggcgaguucucccugcccaccuucgacagccugaacaucacggccgccucccucaaugacgacgggcuggacaaccacaccauccugcuguacuacaguaccgccgcguccagccucgccgugacccugaugcuggccaucuucaucgucuacauggugucccgcgacaacgugagcugcuccaucugccucuga

SEQ ID NO: 15769 - RNA, 1755 nt, Artificial Sequence; identical to SEQ ID NO: 14307
  derived and/or modified CDS sequence (AUadapt) from InfluenzaB__AHL93147__HA

SEQ ID NO: 15770 - RNA, 1755 nt, Artificial Sequence; identical to SEQ ID NO: 14117
  derived and/or modified CDS sequence (AUadapt) from InfluenzaB__AHL93158__HA

SEQ ID NO: 15771 - RNA, 1755 nt, Artificial Sequence
  derived and/or modified CDS sequence (AUadapt) from InfluenzaB__AHL93169__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaagaguuacuucgccaaccugaaggggacgcggacccgcggcaagcucugccccgacugcuucaacugcaccgaucuggacguggcccuggggcggcccaugugcgugggcaccacgccguccgccaaggccagcauccuccacgagguccgccccgugaccuccggcugcuuccccaucaugcacgaccggaccaagauccgccagcugcccaaccugcuccggggguaugagaacauccgccugucgacccagaacgugaucgacgcggagaaggccccgggcgggcccuaccggcugggcacguccgggagcugccccaacgccaccuccaagaucggcuuuuucgccaccauggcgugggccguccccaaggacaacuacaagaacgccaccaacccgcucacgguggaggugcccuacaucugcaccgagggcgaggaccagaucaccgucuggggguuucacagcgacaacaagacccagaugaagaaccuguacggcgacuccaacccccagaaguucacgaguuccgccaacggggugaccacccacuacgugagccagaucggcgacuuccccgaccagaccgaggacggcgggcugccgcaguccggccgcaucgucguggacuauaugaugcagaagcccgggaagacgggcaccaucguguaccagcgcgggguccuccugccccagaagguguggugcgccucgggccgguccaaggugaucaagggcagccugccccucaucggggaggcggacugccugcacgagaaguacggcgggcugaauaagagcaagccguacuacaccggcgagcacgccaaggccaucgggaacugccccaucugggucaagacgccccucaagcuggccaacggcaccaaguaccggcccccggccaagcugcucaaggagcgcggcuucuuuggggcgaucgccggcuuccuggagggcgggugggaggggaugaucgccggcuggcacggcuacaccucccacggggcccacggcguggccgucgcggccgaccugaaguccacccaggaggccaucaacaagaucaccaagaaccucaacucccugagugagcuggaggugaagaaccuccagcggcuguccggggccauggacgagcugcacaacgagauccucgagcuggacgagaagguggacgaccugcgcgccgacacgaucagcucccagaucgagcucgcgguccugcugaguaacgagggcaucaucaacuccgaggacgagcaccuccuggcccuggagcggaagcucaagaagaugcugggccccagcgccguggacaucgggaacggcugcuuugagaccaagcacaagugcaaccagaccugccuggaccgcaucgccgcggggaccuucaacgccggcgaguucucccuccccaccuucgauagccugaacaucacggccgccucccugaacgacgacgggcucgacaaccacaccauccugcuguacuauagcaccgccgcguccagccuggccgugacccucaugcuggccaucuucaucgucuacauggugucccgggacaacgugagcugcuccaucugccuguga

SEQ ID NO: 15772 - RNA, 1755 nt, Artificial Sequence
  derived and/or modified CDS sequence (AUadapt) from InfluenzaB__AHL93180__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaaguccuacuucgccaaccugaaggggacgcggacccgcggcaagcucugccccgacugccugaauugcaccgaccuggacguggcccucgggcggcccaugugcgugggcaccacgccguccgccaaggccagcauccugcacgagguccgccccgugaccuccggcuguuuccccaucauccacgaccggaccaagauccgccagcugcccaaccuccugcggggguacgagaacauccgccugagcacccagaaugugaucgacgcggagaaggccccgggcgggcccuaccggcucggcacguccgggagcugccccaacgccaccuccaagagcggcuucuuugccaccauggcgugggccguccccaaggacaacaacaagaacgccaccaacccgcugacgguggaggugcccuacaucuguaccgagggcgaggaccagaucaccgucuggggguuccacuccgacaacaagacccagaugaagaaccuguacggcgauucgaacccccagaaguucacguccagcgccaacggggugaccacccacuacgugucccagaucggcaguuuccccgaccagaccgaggacggcgggcucccgcaguccggccgcaucgucguggacuacaugaugcagaagcccgggaagacgggcaccaucguguaccagcgcgggguccugcugccccagcgcguguggugugccagcggccggagcaaggugaucaagggcucccucccccugaucggggaggcggacugccugcacgagaaguacggcgggcucaacaagaguaagccguacuacaccggcgagcacgccaaggccaucgggaacugccccaucugggucaagacgccccugaagcuggccaacggcaccaaguaucggcccccggccaagcuccugaaggagcggggcuucuucggggcgaucgccggcuuccuggagggcgggugggaggggaugaucgccggcuggcacggcuacaccucccacggggcccacggcguggccgucgcggccgaucucaagagcacccaggaggccaucaacaagaucaccaagaaccugaacucccugagcgagcucgaggugaagaaccugcagcgccuguccggggccauggacgagcuccauaacgagauccuggagcuggacgagaagguggacgaccuccgggccgacacgaucucgucccagaucgagcuggcgguccugcucaguaacgagggcaucaucaacuccgaggacgagcaccuccuggcccuggagcgcaagcugaagaagaugcugggccccagcgccguggagaucgggaacggcugcuuugagaccaagcacaagugcaaccagaccugccucgaccggaucgccgcggggaccuucaacgccggcgaguuuucccugcccaccuucgacagccugaacaucacggccgccucccucaacgacgaugggcuggacaaccacaccauccugcuguacuacagcaccgccgcguccagccucgccgugacccugaugcuggccaucuuuaucgucuacauggugucccgcgacaacgugagcugcagcaucugccucuga

SEQ ID NO: 15773 - RNA, 1755 nt, Artificial Sequence
  derived and/or modified CDS sequence (AUadapt) from InfluenzaB__AHL93191__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuauuucgccaaccugaaggggacgcggacccgcggcaagcucugccccgacugccugaacugcaccgaccuggacguggcccucgggcggcccaugugugugggcaccacgccguccgccaaggccagcauccugcacgagguccgccccgugaccuccggcugcuuccccaucaugcacgaccggaccaagauccgccagcugcccaaccuccugcggggguacgagaacauccgccugaguacccagaacgugaucgacgcggagaaggccccgggcgggcccuaccggcucggcacguccgggagcugccccaacgacaccuccaagaucggcuucuuugccaccauggccugggcgguccccaaggacaacuacaagaacgccaccaacccgcugacgguggaggugcccuacaucugcaccgagggcgaggaccagaucaccgucuggggguuccauagcgacaacaagacccagaugaagaaccuguacggcgacuccaacccccagaaguucacgagcuccgccaauggggugaccacccacuacgugucgcagaucggcgacuuccccgaccagaccgaggacggcgggcucccgcaguccggccgcaucgucguggacuacaugaugcagaagcccgggaagacgggcaccaucguguaucagcgcgggguccugcugccccagaagguguggugcgccagcggccgguccaaggugaucaagggcagccucccccugaucggggaggccgacugccugcacgagaaguacggcgggcucaacaagaguaagccguacuacaccggcgagcacgcgaaggccaucgggaacugccccaucugggucaagacgccccugaagcuggccaacggcaccaaguaccggcccccggccaagcuccugaaggagcgcggcuucuucggggccaucgcgggcuuucuggagggcgggugggaggggaugaucgccggcuggcacggcuacaccucccacggggcccacggcguggccgucgccgcggaccucaagucgacccaggaggccaucaacaagaucaccaagaaccugaacucccugagugagcucgaggugaagaaccugcagcggcuguccggggccauggacgagcuccacaacgagauccuggagcuggacgagaagguggacgaccuccgcgccgacacgaucagcucccagaucgagcuggccguccugcucaguaacgagggcaucaucaacuccgaggacgagcaccuccuggcgcuggagcggaagcugaagaagaugcugggccccucggccguggacaucgggaacggcugcuuugagaccaagcacaagugcaaccagaccugccucgaccgcaucgccgccgggaccuucaacgcgggcgaguucucccugcccaccuucgauagccugaacaucacggccgccucccucaacgacgacgggcuggacaaccacaccauccugcuguacuauagcaccgccgccuccagccucgcggugacccugaugcuggccaucuucaucgucuacauggugucccgggacaacgugagcugcuccaucugccucuga

SEQ ID NO: 15774 - RNA, 1755 nt, Artificial Sequence
  derived and/or modified CDS sequence (AUadapt) from InfluenzaB__AHL93202__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuauuucgccaaccugaaggggacgcggacccgcggcaagcucugccccgacugccugaacugcaccgaccuggacguggcccucgggcggcccaugugugugggcaccacgccguccgccaaggccagcauccugcacgagguccgccccgugaccuccggcugcuuccccaucaugcacgaccggaccaagauccgccagcugcccaaccuccugcggggguacgagaacauccgccugaguacccagaacgugaucgacgcggagaaggccccgggcgggcccuaccggcucggcacguccgggucgugccccaacgccaccuccaagaucggcuucuucgccaccauggcgugggccguccccaaggauaacuacaagaacgccaccaacccgcugacgguggaggugcccuacaucugcaccgagggcgaggaccagaucaccgucuggggguuccacagugacaacaagacccagaugaagaaccuguacggcgacuccaacccccagaaguucacgagcuccgccaacggggugaccacccauuacgugagccagaucggcgacuuccccgaccagaccgaggacggcgggcucccgcaguccggccgcaucgucguggacuacaugaugcagaagcccgggaagacgggcaccaucguguaccagcgcgggguccugcugccccagaagguguggugugccagcggccgguccaaggugaucaagggcucgcucccccugaucggggaggcggacugccugcacgagaaguacggcgggcucaacaagagcaagccguauuacaccggcgagcacgccaaggccaucgggaacugccccaucugggucaagacgccccugaagcuggccaacggcaccaaguaccggcccccggccaagcuccugaaggagcgcggcuucuucggggcgaucgccggcuuccuggagggcgggugggaggggaugaucgccggcuggcauggcuacaccucccacggggcccacggcguggccgucgcggccgaccucaagagcacccaggaggccaucaacaagaucaccaagaaccugaacucccugagcgagcucgaggugaagaaucugcagcggcuguccggggccauggacgaguuccacaacgagauccucgagcuggacgagaagguggacgaccugcgcgccgacacgaucagcucccagaucgagcucgcgguccugcugaguaacgagggcaucaucaacuccgaggacgagcaccuccuggcccuggagcggaagcucaagaagaugcugggccccagcgccguggacaucgggaacggcugcuuugagaccaagcacaagugcaaccagaccugccuggaccgcaucgccgcggggaccuucaacgccggcgaguucucccuccccaccuucgauagccugaacaucacggccgccucccugaacgacgacgggcucgacaaccacaccauccugcuguacuauagcaccgccgcguccagccuggccgugacccucaugcuggccaucuucaucgucuacauggugucccgggacaacgugagcugcuccaucugccuguga

SEQ ID NO: 15775 - RNA, 1758 nt, Artificial Sequence; identical to SEQ ID NO: 14085
  derived and/or modified CDS sequence (AUadapt) from InfluenzaB__AHL93213__HA

SEQ ID NO: 15776 - RNA, 1758 nt, Artificial Sequence; identical to SEQ ID NO: 14085
  derived and/or modified CDS sequence (AUadapt) from InfluenzaB__AHL93224__HA

SEQ ID NO: 15777 - RNA, 1758 nt, Artificial Sequence
  derived and/or modified CDS sequence (AUadapt) from InfluenzaB__AHL93235__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuuugccaaccugaaggggacggagacccggggcaagcucugccccaagugccccaacugcaccgaccuggacguggcccuggggcgcccgaagugcaccggcaagauccccuccgcccgggugagcauccuccacgagguccgccccgugacguccggcugcuuucccaucaugcacgaccggaccaagauccgccagcugccgaaccugcuccggggguacgagcacauccgccugucgacccacaacgugaucaacgccgagaacgcgcccggcgggcccuacaagaucggcaccuccgggaguugccccaacgucacgaacggcaacggcuucuucgccaccauggccugggccgugccgaagaacgacaagaacaagaccgcgaccaacccccugacgaucgaggugcccuacaucuguaccgagggggaggaccagaucaccgucuggggcuuccacuccgacaacgagacccagauggccaagcucuacggggacucgaagccccagaaguucacguccucggccaacggcgugaccacccauuacgugucccagaucggcggguucccgaaccagaccgaggacggcgggcugccccagagcggccggaucgucguggacuacauggugcagaaguccgggaagacgggcaccaucaccuaccagcgcggcauccugcucccccagaaggucuggugcgccucggggcgguccaaggugaucaagggcagccugccccugaucggggaggccgauugccuccacgagaaguacggcgggcugaacaagucgaagccguacuacaccggcgagcacgcgaaggccaucggcaacugccccaucugggugaagacgccccugaagcucgccaacgggaccaaguaucggcccccggccaagcugcugaaggagcgcggcuucuucggggccaucgcgggcuuccucgagggcgggugggagggcaugaucgccggguggcacggcuacaccucccacggggcccacggcgucgccguggccgcggaccugaaguccacccaggaggccaucaacaagaucacgaagaaccugaacucccucagugagcuggaggucaagaaccugcagcgccucuccggcgccauggacgagcugcacaacgagauccuggagcucgacgagaagguggacgaccugcgggccgacaccaucucgucccagaucgagcuggccgugcuccugucgaacgaggggaucaucaauuccgaggacgagcaccuccuggcgcuggagcgcaagcugaagaagaugcucggccccagcgccgucgagaucgggaacggcugcuucgagaccaagcacaagugcaaccagaccugccuggaccggaucgccgccgggaccuuugacgcgggcgaguucucccugcccacguucgacucgcucaacaucaccgccgccucccugaacaacgacggccuggacaaccauaccauccuccuguacuacagcaccgccgccuccucgcuggcggugacgcugaugaucgccaucuucguggucuacauggugucccgcgacaacgugagcugcuccaucugccucuga

SEQ ID NO: 15778 - RNA, 1758 nt, Artificial Sequence
  derived and/or modified CDS sequence (AUadapt) from InfluenzaB__AHL93246__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugucccaagugccugaacugcaccgaccuggacguggcccucgggcgccccaagugcaccggcaacaucccguccgcccgggugagcauccugcacgagguccgccccgugacguccggcugcuuccccaucaugcacgaucggaccaagauccgccagcugcccaaccuccugcggggguacgagcacauccgccugucgacccacaacgugaucaacgccgagaacgcgccgggcgggcccuacaagaucggcaccuccgggagcugccccaacgucacgaauggcaacggcuucuucgccaccauggccugggccgugcccaagaacgacaagaacaagaccgcgaccaacucccucacgaucgaggugccguacaucugcaccgagggggaggaccagaucaccaucuggggcuuccacagugacaacgagacccagauggccaagcuguacggggacuccaagccccagaaguucacgucguccgccaacggcgucaccacccacuacgugagccagaucggcggguuccccaaccagaccgaggauggcgggcugccccaguccggccggaucguggucgacuacauggugcagaaguccgggaagacgggcaccaucaccuaccagcgcggcauccuccugccgcagaagguguggugcgccuccgggcggucgaaggucaucaagggcagccugccccucaucggggaggccgacugccugcacgagaaguacggcgggcugaacaaguccaagcccuacuauaccggcgagcacgcgaaggccaucggcaacugccccaucugggugaagacgccgcucaagcuggccaacgggaccaaguaccgcccgcccgccaagcugcucaaggagcggggcuucuucggggccaucgcgggcuuccuggagggcgggugggagggcaugaucgccggguggcacggcuacaccucgcacggggcccauggcguggccgucgccgcggaccugaaguccacccaggaggccaucaacaagaucacgaagaaccucaacagccugggcgagcuggaggugaagaaccuccagcgccuguccggggccauggacgagcugcacaacgagauccucgagcuggacgagaaggucgacgaccugcgggccgauaccaucucgucccagaucgagcucgccgugcugcugucgaacgagggcaucaucaacuccgaggacgagcaccuccuggcgcuggagcgcaagcucaagaagaugcuggggcccagcgccguggagaucggcaacgggugcuucgagaccaagcacaagugcaaucagaccugccuggaccggaucgccgccggcaccuucgacgcgggcgaguucucccuccccacguucgacucgcugaacaucaccgccgccucccugaacgacgacgggcucgauaaccacaccauccugcuguacuacagcaccgccgccuccucgcuggcggucacgcucaugaucgccaucuucgugguguacauggucucccgcgacaacgugagcugcuccaucugccuguga

SEQ ID NO: 15779 - RNA, 1758 nt, Artificial Sequence; identical to SEQ ID NO: 14085
  derived and/or modified CDS sequence (AUadapt) from InfluenzaB__AHL93257__HA

SEQ ID NO: 15780 - RNA, 1758 nt, Artificial Sequence; identical to SEQ ID NO: 15062
  derived and/or modified CDS sequence (AUadapt) from InfluenzaB__AHL93268__HA

SEQ ID NO: 15781 - RNA, 1758 nt, Artificial Sequence
  derived and/or modified CDS sequence (AUadapt) from InfluenzaB__AHL93279__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugccccaagugccugaauugcaccgaccuggacguggcccucgggcgccccaagugcaccggcaagaucccguccgcccgggugucgauccugcacgagguccgccccgugacguccggcugcuuccccaucaugcacgaccggaccaagauccgccagcugcccaaccuccugcggggguacgagcacauccgccugagcacccacaaugugaucaacgccgagaacgcgccgggcgggcccuacaagaucggcaccuccgggucgugccccaacaucacgaacggcaacggcuucuucgccaccauggccugggccguccccaagaacgacaagaacaagaccgcgaccaacccgcucacgaucgaggugcccuacaucuguaccgagggggaggaccagaucaccguguggggcuuccacuccgacaacgagacccagauggccaagcuguacggggacucgaagccccagaaguucacguccagcgccaacggcgucaccacccacuacgugucccagaucggcggguuccccaaccagaccgaggauggcgggcugccgcagucgggccggaucguggucgacuacauggugcagaaguccgggaagacgggcaccaucaccuaccagcgcggcauccuccugccccagaagguguggugcgccucggggaaguccaaggucaucaagggcagccugccccucaucggggaggccgacugccugcacgagaaguacggcgggcugaacaagucgaagcccuacuacaccggcgagcaugcgaaggccaucggcaacugcccgaucugggugaagacgccccucaagcuggccaacgggaccaaguaccggccgcccgccaagcugcucaaggagcgcggcuucuucggggccaucgcgggcuuccuggagggcgggugggagggcaugaucgccggguggcacggcuacaccucccacggggcccacggcguggccgucgccgcggaccugaaguccacccaggaggccaucaacaagaucacgaagaaccucaacucccugagugagcuggaggugaagaaccuccagcggcuguccggcgccauggacgagcugcacaacgagauccucgagcuggacgagaaggucgacgaccugcgcgccgacaccaucagcucccagaucgagcucgccgugcugcugucgaacgaggggaucaucaacuccgaggacgagcaccuccuggcgcuggagcggaagcucaagaagaugcugggccccucggccguggagaucgggaauggcugcuucgagaccaagcacaagugcaaccagaccugccuggaccgcaucgccgccgggaccuucgacgcgggcgaguucucccuccccacguucgacagccugaacaucaccgccgccucccugaacgaugacggccucgacaaccacaccauccugcuguacuacucgaccgccgccuccucgcuggcggucacgcucaugaucgccaucuucgugguguacauggucucccgggacaacgugagcugcuccaucugccuguga

SEQ ID NO: 15782 - RNA, 1758 nt, Artificial Sequence; identical to SEQ ID NO: 14085
  derived and/or modified CDS sequence (AUadapt) from InfluenzaB__AHL93290__HA

SEQ ID NO: 15783 - RNA, 1758 nt, Artificial Sequence
  derived and/or modified CDS sequence (AUadapt) from InfluenzaB__AHL93301__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugccccaagugucugaacugcaccgaccuggacguggcccucgggcgccccaagugcaccggcaagaucccguccgcccgggugucgauccugcacgagguccgccccgugacguccggcugcuuccccaucaugcacgaccggaccaagauccgccagcugcccaaccuccugcggggguacgagcauauccgccugagcacccacaacgugaucaacgccgagaacgcgccgggcgggcccuacaagaucggcaccuccgggucgugccccaacaucacgaacggcaacggcuucuucgccaccauggccugggccguccccaagaaugacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagugccaacggcgucaccacccacuacgugucccagaucggcggguuccccaaccagaccgaggacggcgggcugccgcagucgggccggaucguggucgacuacauggugcagaaguccgggaagacgggcaccaucaccuaccagcgcggcauccuccugccccagaagguguggugcgccagcgggcgguccaaggucaucaagggcucgcugccccucaucggggaggccgauugccugcacgagaaguacggcgggcugaacaagucgaagcccuacuacaccggcgagcacgcgaaggccaucggcaacugcccgaucugggugaagacgccccucaagcuggccaacgggaccaaguaccgcccgcccgccaagcugcucaaggagcggggcuucuuuggggccaucgcgggcuuccuggagggcgggugggagggcaugaucgccggguggcacggcuacaccucccacggggcccacggcguggccgucgccgcggaccugaaguccacccaggaggccaucaacaagaucacgaagaaccucaacucccugagcgagcuggaggugaagaaccuccagcgccuguccggcgccauggacgagcugcacaacgagauccucgagcuggaugagaaggucgacgaccugcgggccgacaccaucucgucccagaucgagcucgccgugcugcugagcaacgaggggaucaucaacuccgaggacgagcaccuccuggcgcuggagcgcaagcucaagaagaugcugggccccucggccguggagaucgggaacggcugcuucgagaccaagcauaagugcaaccagaccugccuggaccggaucgccgccgggaccuucaacgcgggcgaguucucccuccccacguucgacucgcugaacaucaccgccgccucccugaacgacgauggccucgacaaccacaccauccugcuguacuacagcaccgccgccuccucgcuggcggucacgcucaugaucgccaucuucgugguguacauggucucccgcgacaacgugagcugcuccaucugccuguga

SEQ ID NO: 15784 - RNA, 1758 nt, Artificial Sequence
  derived and/or modified CDS sequence (AUadapt) from InfluenzaB__AHL93312__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugucccaagugccugaacugcaccgaccuggacguggcccucgggcgccccaagugcaccggcaagaucccguccgcccgggugucgauccugcacgagguccgccccgugacguccggcugcuuccccaucaugcacgaccggaccaagauccgccagcugcccaaucuccugcggggguacgagcacauccgccugagcacccacaacgugaucaacgccgagaacgcgccgggcgggcccuacaagaucggcaccuccgggucgugccccaacaucacgaacggcaauggcuucuacgccaccauggccugggccguccccaagaacgacaagaacaagaccgcgaccaacccgcucacgaucgaggugcccuacaucugcaccgagggggaggaccagaucaccguguggggcuuccacuccgacaaugagacccagauggccaagcuguacggggacagcaagccccagaaguucacguccucggccaacggcgucaccacccacuacgugucccagaucggcggguuccccaaccagaccgaggacggcgggcugccgcagucgggccggaucguggucgauuacauggugcagaaguccgggaagacgggcaccaucaccuaccagcgcggcauccuccugccccagaagguguggugcgccagcgggcgguccaaggucaucaagggcucgcugccccucaucggggaggccgacugccugcacgagaaguacggcgggcugaacaagucgaagcccuacuauaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcguggccgucgccgcggaucugaaguccacccaggaggccaucaacaagaucacgaagaaccucaacucccugagcgagcuggaggugaagaaccuccagcgccuguccggcgccauggacgagcugcacaacgagauccucgagcuggacgagaaggucgacgaccugcgggccgacaccaucaguucccagaucgagcucgccgugcugcugagcaacgaggggaucaucaacuccgaggacgagcaccuccuggcgcuggagcgcaagcucaagaagaugcugggccccucggccguggagaucgggaacggcugcuucgagaccaagcacaagugcaaccagaccugucuggaccggaucgccgccgggaccuucgacgcgggcgaguucucccuccccacguucgacucgcugaacaucaccgccgccucccugaacgacgacggccucgacaaucacaccauccugcuguacuacagcaccgccgccuccucgcuggcggucacgcucaugaucgccaucuucgugguguacauggucucccgcgacaacgugagcugcuccaucugccuguga

SEQ ID NO: 15785 - RNA, 1758 nt, Artificial Sequence
  derived and/or modified CDS sequence (AUadapt) from InfluenzaB__AHL93323__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugccccaagugucugaacugcaccgaccuggacguggcccucgggcgccccaagugcaccggcaagaucccguccgcccgggugucgauccugcacgagguccgccccgugacguccggcugcuuccccaucaugcacgaccggaccaagauccgccagcugcccaaccuccugcggggguacgagcauauccgccugagcacccacaacgugaucaacgccgagaacgcgccgggcgggcccuacaagaucggcaccuccgggucgugccccaacaucacgaacggcaacggcuucuucgccaccauggccugggccguccccaagaaugacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagugccaacggcgucaccacccacuacgugucccagaucggcggguuccccaaccagaccgaggacggcgggcugccgcagucgggccggaucguggucgacuacauggugcagaaguccgggaagacgggcaccaucaccuaccagcgcggcauccuccugccccagaagguguggugcaccagcgggcgguccaaggucaucaagggcucgcugccccucaucggggaggccgauugccugcacgagaaguacggcgggcugaacaagucgaagcccuacuacacgggcgagcacgccaaggcgaucggcaacugcccgaucugggugaagacgccccucaagcuggccaacgggaccaaguaccgcccgcccgccaagcugcucaaggagcggggcuucuuuggggccaucgccggcuuccuggagggcgggugggagggcaugaucgcgggguggcacggcuacaccucccacggggcccacggcguggccgucgccgccgaccugaaguccacccaggaggcgaucaacaagaucaccaagaaccucaacucccugagcgagcuggaggugaagaaccuccagcgccuguccggcgccauggacgagcugcacaacgagauccucgagcuggaugagaaggucgacgaccugcgggccgacaccaucucgucccagaucgagcucgccgugcugcugagcaacgaggggaucaucaacuccgaggacgagcaccuccuggcccuggagcgcaagcucaagaagaugcugggccccucggcgguggagaucgggaacggcugcuucgagaccaagcauaagugcaaccagaccugccuggaccggaucgccgccgggacguucgacgccggcgaguucucccuccccaccuucgacucgcugaacaucaccgcggccucccugaacgacgauggccucgacaaccacaccauccugcuguacuacagcacggccgccuccucgcuggccgucacccucaugaucgcgaucuucgugguguacauggucucccgcgacaacgugagcugcuccaucugccuguga

SEQ ID NO: 15786 - RNA, 1758 nt, Artificial Sequence
  derived and/or modified CDS sequence (AUadapt) from InfluenzaB__AHL93334__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugucccaagugccccaacugcaccgaccuggacguggcccuggggcgcccgaagugcaccggcaagauccccuccgcccgggugucgauccuccacgagguccgccccgugacguccggcugcuuccccaucaugcacgaccggaccaagauccgccagcugccgaaucugcuccggggguacgagcacauccgccugagcacccacaacgugaucaacgccgagaacgcgcccggcgggcccuacaagaucggcaccuccgggucgugccccaacaucacgaacggcaauggcuucuucgccaccauggccugggccgucccgaagaacgacaagaacaagaccgcgaccaacccccugacgaucgaggugcccuacaucugcaccgagggggaggaccagaucaccguguggggcuuccacuccgacaaugagacccagauggccaagcucuacggggacagcaagccccagaaguucacguccucggccaacggcgucaccacccacuacgugucccagaucggcggguucccgaaccagaccgaggacggcgggcugccccagucgggccggaucguggucgauuacauggugcagaaguccgggaagacgggcaccaucaccuaccagcgcggcauccugcucccccagaagguguggugcaccagcgggcgguccaaggucaucaagggcucgcugccccugaucggggaggccgacugccuccacgagaaguacggcgggcugaacaagucgaagccguacuauacgggcgagcacgccaaggcgaucggcaacugccccaucugggugaagacgccccugaagcucgccaacgggaccaaguaccggcccccggccaagcugcugaaggagcgcggcuucuucggggccaucgccggcuuccucgagggcgggugggagggcaugaucgcgggguggcacggcuacaccucccacggggcccacggcguggccgucgccgccgaucugaaguccacccaggaggcgaucaacaagaucaccaagaaccugaacucccucagcgagcuggaggugaagaaccugcagcgccucuccggcgccauggacgagcugcacaacgagauccuggagcucgacgagaaggucgacgaccugcgggccgacaccaucaguucccagaucgagcuggccgugcuccugagcaacgaggggaucaucaacuccgaggacgagcaccuccuggcccuggagcgcaagcugaagaagaugcucggccccucggcgguggagaucgggaacggcugcuucgagaccaagcacaagugcaaccagaccugucuggaccggaucgccgccgggacguucgacgccggcgaguucucccugcccaccuucgacucgcucaacaucaccgcggccucccugaacgacgacggccuggacaaucacaccauccuccuguacuacagcacggccgccuccucgcuggccgucacccugaugaucgcgaucuucgugguguacauggucucccgcgacaacgugagcugcuccaucugccucuga

SEQ ID NO: 15787 - RNA, 1758 nt, Artificial Sequence; identical to SEQ ID NO: 14085
  derived and/or modified CDS sequence (AUadapt) from InfluenzaB__AHL93345__HA

SEQ ID NO: 15788 - RNA, 1758 nt, Artificial Sequence; identical to SEQ ID NO: 14085
  derived and/or modified CDS sequence (AUadapt) from InfluenzaB__AHL93356__HA

SEQ ID NO: 15789 - RNA, 1758 nt, Artificial Sequence
  derived and/or modified CDS sequence (AUadapt) from InfluenzaB__AHL93367__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugccccaagugucugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgaguauauccgccugucgacccacaacgugaucaacgccgagaacgcgccgggcgggcccuacaagaucggcaccuccgggagcugccccaacaucacgaacggcaacggcuucuucgccaccauggccugggccguccccaagaaugacaagaacaagaccgcgaccaacccgcucacgaucgaggugcccuacaucugcaccgagggggaggaccagaucaccguguggggcuuccacuccgacaacgagacccagauggccaagcuguacggggacucgaagccccagaaguucacguccagugccaacggcgucaccacccacuacgugucccagaucggcggguuccccaaccagaccgaggacggcgggcugccgcagagcggccggaucguggucgacuacauggugcagaaguccgggaagacgggcaccaucaccuaccagcgcggcauccuccugccccagaagguguggugcgccucggggcgguccaaggucaucaagggcagccugccccucaucggggaggccgauugccugcacgagaaguacggcgggcugaacaagucgaagcccuacuacaccggcgagcacgcgaaggccaucggcaacugcccgaucugggugaagacgccccucaagcuggccaacgggaccaaguaccgcccgcccgccaagcugcucaaggagcggggcuucuuuggggccaucgcgggcuuccuggagggcgggugggagggcaugaucgccggguggcacggcuacaccucccacggggcccacggcguggccgucgccgcggaccugaaguccacccaggaggccaucaacaagaucacgaagaaccucaacucccugagcgagcuggaggugaagaaccuccagcgccuguccggcgccauggacgagcugcacaacgagauccucgagcuggaugagaaggucgacgaccugcgggccgacaccaucucgucccagaucgagcucgccgugcugcugucgaacgaggggaucaucaacuccgaggacgagcaccuccuggcgcuggagcgcaagcucaagaagaugcugggccccagcgccguggagaucgggaacggcugcuucgagaccaagcauaagugcaaccagaccugccuggaccggaucgccgccgggaccuucgacgcgggcgaguucucccuccccacguucgacucgcugaacaucaccgccgccucccugaacgacgauggccucgacaaccacaccauccugcuguacuacagcaccgccgccuccucgcuggcggucacgcucaugaucgccaucuucgugguguacauggucucccgcgacaacgugagcugcuccaucugccuguga

SEQ ID NO: 15790 - RNA, 1758 nt, Artificial Sequence; identical to SEQ ID NO: 14085
  derived and/or modified CDS sequence (AUadapt) from InfluenzaB__AHL93378__HA

SEQ ID NO: 15791 - RNA, 1758 nt, Artificial Sequence
  derived and/or modified CDS sequence (AUadapt) from InfluenzaB__AHL93389__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucguacuucgccaaccugaaggggacggagacccggggcaagcucugccccaagugucugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcauauccgccugucgacccacaacgugaucaacgccgagaacgcgccgggcgggcccuacaagaucggcaccuccgggagcugccccaacaucacgaacggcaacggcuucuucgccaccauggccugggccguccccaagaaugacaagaacaagaccgcgaccaacccgcucacgaucgaggugcccuacaucugcaccgagggggaggaccagaucaccguguggggcuuccacuccgacaacgagacccagauggccaagcuguacggggacucgaagccccagaaguucacguccagugccaacggcgucaccacccacuacgugucccagaucggcggguuccccaaccagaccgaggacggcgggcugccgcagagcggccggaucguggucgacuacauggugcagaaguccgggaagacgggcaccaucaccuaccagcgcggcauccuccugccccagaagguguggugcgccucggggcgguccaaggucaucaagggcagccugccccucaucggggaggccgauugccugcacgagaaguacggcgggcugaacaagucgaagcccuacuacaccggcgagcacgcgaaggccaucggcaacugcccgaucugggugaagacgccccucaagcuggccaacgggaccaaguaccgcccgcccgccaagcugcucaaggagcggggcuucuuuggggccaucgcgggcuuccuggagggcgggugggagggcaugaucgccggguggcacggcuacaccucccacggggcccacggcguggccgucgccgcggaccugaaguccacccaggaggccaucaacaagaucacgaagaaccucaacucccugagcgagcuggaggugaagaaccuccagcgccuguccggcgccauggacgagcugcacaacgagauccucgagcuggaugagaaggucgacgaccugcgggccgacaccaucucgucccagaucgagcucgccgugcugcugucgaacgaggggaucaucaacuccgaggacgagcaccuccuggcgcuggagcgcaagcucaagaagaugcugggccccagcgccguggagaucgggaacggcugcuucgagaccaagcauaagugcaaccagaccugccuggaccggaucgccgccgggaccuucgacgcgggcgaguucucccuccccacguucgacucgcugaacaucaccgccgccucccugaacgacgauggccucgacaaccacaccauccugcuguacuacagcaccgccgccuccucgcuggcggucacgcucaugaucgccaucuucgugguguacauggucucccgcgacaacgugagcugcuccaucugccuguga

SEQ ID NO: 15792 - RNA, 1758 nt, Artificial Sequence; identical to SEQ ID NO: 14085
  derived and/or modified CDS sequence (AUadapt) from InfluenzaB__AHL93400__HA

SEQ ID NO: 15793 - RNA, 1758 nt, Artificial Sequence; identical to SEQ ID NO: 15062
  derived and/or modified CDS sequence (AUadapt) from InfluenzaB__AHL93411__HA

SEQ ID NO: 15794 - RNA, 1758 nt, Artificial Sequence; identical to SEQ ID NO: 15062
  derived and/or modified CDS sequence (AUadapt) from InfluenzaB__AHL93422__HA

SEQ ID NO: 15795 - RNA, 1758 nt, Artificial Sequence; identical to SEQ ID NO: 15062
  derived and/or modified CDS sequence (AUadapt) from InfluenzaB__AHL93433__HA

SEQ ID NO: 15796 - RNA, 1758 nt, Artificial Sequence; identical to SEQ ID NO: 14085
  derived and/or modified CDS sequence (AUadapt) from InfluenzaB__AHL93444__HA

SEQ ID NO: 15797 - RNA, 1758 nt, Artificial Sequence
  derived and/or modified CDS sequence (AUadapt) from InfluenzaB__AHL93455__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugccccaagugucugaacugcaccgaccuggacguggcccucgggcgccccaagugcaccggcaagaucccguccgcccgggugucgauccugcacgagguccgccccgugacguccggcugcuuccccaucaugcacgaccggaccaagauccgccagcugcccaaccuccugcggggguacgagcauauccgccugagcacccacaacgugaucaacgccgagaacgcgccgggcgggcccuacaagaucggcaccuccgggucgugccccaacaucacgaacggcaacggcuucuucgccaccauggccugggccguccccaagaaugacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagugccaacggcgucaccacccacuacgugucccagaucggcggguuccccaaccagaccgaggacggcgggcugccgcagucgggccggaucguggucgacuacauggugcagaaguccgggaagacgggcaccaucaccuaccagcgcggcauccuccugccccagaagguguggugcgccagcgggcgguccaaggucaucaagggcucgcugccccucaucggggaggccgauugccugcacgagaaguacggcgggcugaacaagucgaagcccuacuacaccggcgagcacgcgaaggccaucggcaacugcccgaucugggugaagacgccccucaagcuggccaacgggaccaaguaccgcccgcccgccaagcugcucaaggagcggggcuucuuuggggccaucgcgggcuuccuggagggcgggugggagggcaugaucgccggguggcacggcuacaccucccacggggcccacggcguggccgucgccgcggaccugaaguccacccaggaggccaucaacaagaucacgaagaaccucaacucccugagcgagcuggaggugaagaaccuccagcgccuguccggcgccaugaacgagcugcacaacgagauccucgagcuggaugagaaggucgacgaccugcgggccgacaccaucucgucccagaucgagcucgccgugcugcugagcaacgaggggaucaucaacuccgaggacgagcaccuccuggcgcuggagcgcaagcucaagaagaugcugggccccucggccguggagaucgggaacggcugcuucgagaccaagcauaagugcaaccagaccugccuggaccggaucgccgccgggaccuucgacgcgggcgaguucucccuccccacguucgacucgcugaacaucaccgccgccucccugaacgacgauggccucgacaaccacaccauccugcuguacuacagcaccgccgccuccucgcuggcggucacgcucaugaucgccaucuucgugguguacauggucucccgcgacaacgugagcugcuccaucugccuguga

SEQ ID NO: 15798 - RNA, 1758 nt, Artificial Sequence; identical to SEQ ID NO: 14085
  derived and/or modified CDS sequence (AUadapt) from InfluenzaB__AHL93466__HA

SEQ ID NO: 15799 - RNA, 1758 nt, Artificial Sequence; identical to SEQ ID NO: 14348
  derived and/or modified CDS sequence (AUadapt) from InfluenzaB__AHL93477__HA

SEQ ID NO: 15800 - RNA, 1758 nt, Artificial Sequence; identical to SEQ ID NO: 14423
  derived and/or modified CDS sequence (AUadapt) from InfluenzaB__AHL93488__HA

SEQ ID NO: 15801 - RNA, 1755 nt, Artificial Sequence
  derived and/or modified CDS sequence (AUadapt) from InfluenzaB__AHL93499__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuauuucgccaaccugaaggggacgcggacccgcggcaagcucugccccgacugccugaacugcaccgaccuggauguggcccucgggcggcccaugugcgugggcaccacgccguccgccaaggccagcauccugcacgagauccgccccgucaccuccggcugcuuccccaucaugcacgaccggaccaagauccgccagcugcccaaccuccugcggggguaugagaacauccgccugagcacccagaacgugaucgacgcggagaaggccccgggcgggcccuaccggcucggcacguccgggucgugccccaacgccaccuccaagaucggcuuuuucgccaccauggcgugggccgugcccaaggacaacuacaagaacgccaccaacccgcugacggucgaggugcccuacaucugcaccgagggcgaggaucagaucaccguguggggguuccacagcgacaacaagacccagaugaagaaccuguacggcgacuccaauccccagaaguucacgagcuccgccaacggggucaccgcccacuacgugagccagaucggcgacuuccccgaucagaccgaggacggcgggcucccgcaguccggccgcaucguggucgacuacaugaugcagaagcccgggaagaccggcacgaucguguaccagcgcggggugcugcugccccagaaggucuggugcgcgagcggccgguccaaggugaucaagggcucgcucccccugaucggggaggccgacugucugcacgagaaguacggcgggcucaacaagagcaagccguacuacaccggcgagcacgccaaggccaucgggaacugucccaucugggugaagacgccccugaagcuggccaacggcaccaaguaccggcccccggcgaagcuccugaaggagcgcggcuucuucggggccaucgccggcuuccuggagggcgggugggaggggaugaucgccggcuggcacggcuacaccucccacggggcccauggcgucgcgguggccgccgaccucaagagcacccaggaggccaucaacaagaucaccaagaaccugaacucccugagcgagcucgaggucaagaaccugcagcggcuguccggggccauggacgagcuccauaacgagauccuggagcuggacgagaagguggacgaccuccgcgcggacaccaucagcucccagaucgagcuggccgugcugcucucgaacgagggcaucaucaauuccgaggacgagcaccuccuggcccuggagcggaagcugaagaagaugcugggccccagcgccgucgacaucgggaacggcugcuucgagacgaagcacaaguguaaccagaccugccucgaccgcaucgcggccgggaccuucaacgccggcgaguucucccugcccaccuucgacagucugaacaucaccgccgccucccucaacgacgacgggcuggacaaccacacgauccugcuguacuauagcaccgcggccuccagccucgccgugacccugaugcuggccaucuucaucguguacauggucucccgggacaacgugagcugcuccaucugccucuga

SEQ ID NO: 15802 - RNA, 1758 nt, Artificial Sequence; identical to SEQ ID NO: 14348
  derived and/or modified CDS sequence (AUadapt) from InfluenzaB__AHL93510__HA

SEQ ID NO: 15803 - RNA, 1755 nt, Artificial Sequence
  derived and/or modified CDS sequence (AUadapt) from InfluenzaB__AHL93521__HA
augaaggccaucaucgcccugcucaugguggucaccaguaacgcggaccgcaucugcaccggcaucacguccagcaacagcccccauguggugaagaccgccacccagggggaggucaacgugaccggcgugaucccgcugacgaccacccccaccaaguccuacuucgccaaccugaaggggacgcggacccgcggcaagcucugccccgacugucugaacugcaccgaccuggacgucgcccucgggcggcccaugugcgugggcaccacgccguccgccaaggcgagcauccugcaugaggugcgccccgucaccuccggcugcuuccccaucaugcacgaccggaccaagauccgccagcugcccaaccuccugcggggguacgagaacauccgccugaguacccagaacgugaucgacgccgagaaggccccgggcgggcccuaccggcucggcacguccgggagcugccccaacgccaccuccaagaucggcuuuuucgcgaccauggccugggccgugcccaaggacaacuacaagaacgccaccaacccgcugacggucgaggugcccuauaucugcaccgagggcgaggaccagaucaccguguggggguuccacagcgacaauaagacccagaugaagaaccuguacggcgacuccaacccccagcgcuucacgagcuccgccaacggggucaccacccauuacgugagccagaucggcgacuuccccgaccagaccgaggacggcgggcucccgcaguccggccggaucguggucgauuacauggugcagaagcccgggaagacgggcaccaucguguaccagcgcgggguccugcugccccagaagguguggugcgcgagcggccgguccaaggugaucaagggcagccucccccugaucggggaggccgacugucugcacgagaaguacggcgggcucaacaagagcaagccguacuacaccggcgagcaugccaaggccaucgggaacugccccaucugggucaagacgccccugaagcuggccaacggcaccaaguaccggcccccggcgaagcuccugaaggagcgcggcuucuucggggccaucgccggcuuccuggagggcgggugggaggggaugaucgccggcuggcauggcuacaccucccacggggcccacggcguggcggucgccgccgaccucaagagcacccaggaggccaucaacaagaucaccaagaaucugaacucccugagcgagcucgaggugaagaaccugcagcgccuguccggggccauggacgagcuccacaacgagauccuggagcuggaugagaagguggacgaccuccgggcggacacgaucagcucccagaucgagcuggccguccugcucagcaacgagggcaucaucaauuccgaggacgagcaccuccuggcccuggagcgcaagcugaagaagaugcugggccccagcgccguggacaucgggaacggcugcuucgagaccaagcauaagugcaaccagaccugccucgaccggaucgcggccgggaccuucaacgccggcgaguuuucccugcccaccuucgacagccugaacaucacggccgccucccucaacgacgaugggcuggacaaccacaccauccugcuguacuacagcaccgcggccuccagucucgccgugacccugaugcuggccaucuucaucgucuacauggugucccgcgacaacgugagcugcuccaucugccucuga

SEQ ID NO: 15804 - RNA, 1758 nt, Artificial Sequence; identical to SEQ ID NO: 14423
  derived and/or modified CDS sequence (AUadapt) from InfluenzaB__AHL93532__HA

SEQ ID NO: 15805 - RNA, 1758 nt, Artificial Sequence; identical to SEQ ID NO: 14118
  derived and/or modified CDS sequence (AUadapt) from InfluenzaB__AHL93543__HA

SEQ ID NO: 15806 - RNA, 1758 nt, Artificial Sequence; identical to SEQ ID NO: 14118
  derived and/or modified CDS sequence (AUadapt) from InfluenzaB__AHL93554__HA

SEQ ID NO: 15807 - RNA, 1758 nt, Artificial Sequence; identical to SEQ ID NO: 14118
  derived and/or modified CDS sequence (AUadapt) from InfluenzaB__AHL93565__HA

SEQ ID NO: 15808 - RNA, 1758 nt, Artificial Sequence; identical to SEQ ID NO: 14423
  derived and/or modified CDS sequence (AUadapt) from InfluenzaB__AHL93576__HA

SEQ ID NO: 15809 - RNA, 1758 nt, Artificial Sequence; identical to SEQ ID NO: 14423
  derived and/or modified CDS sequence (AUadapt) from InfluenzaB__AHL93587__HA

SEQ ID NO: 15810 - RNA, 1758 nt, Artificial Sequence
  derived and/or modified CDS sequence (AUadapt) from InfluenzaB__AHL93609__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccauuucgccaaccugaaggggacggagacccggggcaagcucugccccaagugccccaacugcaccgaccuggacguggcccuggggcgcccgaagugcaccggcaagauccccuccgcccgggugaguauccuccacgagguccgccccgugacguccggcugcuuccccaucaugcacgaccggaccaagauccgccagcugccgaaccugcuccggggguacgagcacauccgccugagcacccauaacgugaucaacgccgagaacgcgcccggcgggcccuacaagaucggcaccuccgggucgugccccaacgucacgaacggcaacggcuuuuucgccaccauggccugggccgugccgaagaacgacaagaacaagaccgcgaccaacccccugacgaucgaggugcccuacaucugcaccgagggggaggaccagaucaccgucuggggcuuccacuccgauaacgagacccagauggccaagcucuacggggacagcaagccccagaaguucacguccucggccaacggcgugaccacccacuacgugucccagaucggcggguuuccgaaccagaccgaggacggcgggcugccccagagcggccggaucgucguggacuacauggugcagaaguccgggaagacgggcaccaucaccuaccagcgcggcauccugcucccccagaaggucuggugcgccucggggcgguccaaggugaucaagggcagccugccccugaucggggaggccgauugccuccacgagaaguacggcgggcugaacaagucgaagccguacuacaccggcgagcacgcgaaggccaucggcaacugucccaucugggugaagacgccccugaagcucgccaacgggaccaaguaccggcccccggccaagcugcugaccgagcgcggcuucuucggggccaucgcgggcuuccucgagggcgggugggagggcaugaucgccggguggcacggcuacaccucccacggggcccacggcgucgccguggccgcggaucugaaguccacgcaggaggccaucaacaagaucaccaagaaccugaacucccucagcgagcuggaggucaagaaccugcagcgccucuccggcgccauggacgagcugcacaacgagauccuggagcucgacgagaagguggacgaucugcgggccgacaccaucucgucccagaucgagcuggccgugcuccugagcaacgaggggaucaucaacuccgaggacgagcaccuccuggcgcuggagcgcaagcugaagaagaugcucggccccucggccgucgagaucgggaacggcuguuucgagaccaagcacaagugcaaccagaccugccuggaccggaucgccgccgggacguucgacgcgggcgaguucucccugcccaccuuugacagccucaacaucaccgccgccucccugaacgacgacggccuggacaaccacaccauccuccuguauuacucgacggccgccuccagccuggcggugacccugaugaucgccaucuucguggucuacauggugucccgcgacaacgugagcugcuccaucugccucuga

SEQ ID NO: 15811 - RNA, 1758 nt, Artificial Sequence; identical to SEQ ID NO: 14423
  derived and/or modified CDS sequence (AUadapt) from InfluenzaB__AHL93620__HA

SEQ ID NO: 15812 - RNA, 1758 nt, Artificial Sequence; identical to SEQ ID NO: 15810
  derived and/or modified CDS sequence (AUadapt) from InfluenzaB__AHL93631__HA

SEQ ID NO: 15813 - RNA, 1758 nt, Artificial Sequence; identical to SEQ ID NO: 15810
  derived and/or modified CDS sequence (AUadapt) from InfluenzaB__AHL93642__HA

SEQ ID NO: 15814 - RNA, 1755 nt, Artificial Sequence
  derived and/or modified CDS sequence (AUadapt) from InfluenzaB__AHL93653__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacuguaccgaccuggacguggcccucgggcggcccaugugcgugggcaccacgccguccgccaaggccagcauccugcacgagguccgccccgugaccuccggcugcuuccccaucaugcaugaccggaccaagauccgccagcugcccaaccuccugcggggguacgagaacauccgccugagcacccagaacgugaucgacgcggagaaggccccgggcgggcccuaucggcucggcacguccgggagcugccccaacgccaccuccaagaucggcuucuucgccaccauggcgugggccguccccaaggacaacuauaagaacgccaccaacccgcugacgguggaggugcccuacaucugcaccgagggcgaggaccagaucaccgucuggggguuccacagugacaacaagacccagaugaagaaccuguacggcgacuccaacccccagaaguucacgaguuccgccaacggggugaccacccacuacgugagccagaucggcgacuuccccgaccagaccgaggauggcgggcucccgcaguccggccgcaucgucguggacuacauggugcagaagcccgggaagacgggcaccaucgucuaccagcgcggggugcugcugccccagaagguguggugcgccagcggccgguccaaggucaucaagggcucgcucccccugaucggggaggcggacugucugcacgagaaguacggcgggcucaacaagagcaagccguacuacaccggcgagcacgccaaggccaucggggauugccccaucugggugaagacgccccugaagcuggccaacggcaccaaguaccggcccccggccaagcuccugaaggagcgcggcuucuucggggcgaucgccggcuuccuggagggcgggugggaggggaugaucgccggcuggcacggcuauaccucccacggggcccacggcgucgccguggcggccgaccucaagagcacccaggaggccaucaacaagaucaccaagaaccugaacucccugagugagcucgaggugaagaaccugcagcggcuguccggggccauggacgagcuccacaacgagauccuggagcuggacgagaaggucgacgaccuccgcgccgauacgaucagcucccagaucgagcuggcggugcugcucagcaacgagggcaucaucaacuccgaggacgagcaccuccuggcccuggagcggaagcugaagaagaugcugggccccagcgccguggauaucgggaacggcugcuucgagaccaagcacaagugcaaccagaccugccucgaucgcaucgccgcggggaccuucaacgccggcgaguucucccugcccaccuucgacagccugaacaucacggccgccucccucaaugacgacgggcuggacaaccacaccauccugcuguacuacaguaccgccgcguccagccucgccgucacccugaugcuggccaucuucaucguguacauggugucccgggacaacgucagcugcuccaucugccucuga

SEQ ID NO: 15815 - RNA, 1758 nt, Artificial Sequence; identical to SEQ ID NO: 14423
  derived and/or modified CDS sequence (AUadapt) from InfluenzaB__AHL93664__HA

SEQ ID NO: 15816 - RNA, 1758 nt, Artificial Sequence; identical to SEQ ID NO: 14348
  derived and/or modified CDS sequence (AUadapt) from InfluenzaB__AHL93675__HA

SEQ ID NO: 15817 - RNA, 1758 nt, Artificial Sequence; identical to SEQ ID NO: 15810
  derived and/or modified CDS sequence (AUadapt) from InfluenzaB__AHL93686__HA

SEQ ID NO: 15818 - RNA, 1758 nt, Artificial Sequence; identical to SEQ ID NO: 15810
  derived and/or modified CDS sequence (AUadapt) from InfluenzaB__AHL93697__HA

SEQ ID NO: 15819 - RNA, 1758 nt, Artificial Sequence
  derived and/or modified CDS sequence (AUadapt) from InfluenzaB__AHL93708__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuuugccaaccugaaggggacggagacccggggcaagcucugccccaagugccccaacugcaccgaccuggacguggcccuggggcgcccgaagugcaccggcaagauccccuccgcccgggugagcauccuccacgagguccgccccgugacguccggcuguuuccccaucaugcacgaccggaccaagauccgccagcugccgaaccugcuccggggguacgagcacauccgccugucgacccacaacgugaucaacgccgagaaugcgcccggcgggcccuacaagaucggcaccuccgggagcugccccaacgucacgaacggcaacggcuucuucgccaccauggccugggccgugccgaagaacgacaagaauaagaccgcgaccaacccccugacgaucgaggugcccuacaucugcaccgagggggaggaccagaucaccgucuggggcuuccacuccgacaacgagacccagauggccaagcucuacggggacaguaagccccagaaguucacguccagcgccaacggcgugaccacccacuacgugucccagaucggcggguucccgaaccagaccgaggacggcgggcugccccagucgggccggaucgucguggacuauauggugcagaaguccgggaagacgggcaccaucaccuaccagcgcggcauccugcucccccagaaggucuggugcgccagcgggcgguccaaggugaucaagggcucgcugccccugaucggggaggccgacugccuccacgagaaguacggcgggcugaacaagagcaagccguauuacaccggcaagcacgcgaaggccaucggcaacugccccaucugggugaagacgccccugaagcucgccaacgggaccaaguaccggcccccggccaagcugcugaccgagcgcggcuucuucggggccaucgcgggcuuccucgagggcgggugggagggcaugaucgccggguggcacggcuauaccucccacggggcccacggcgucgccguggccgcggaccugaaguccacgcaggaggccaucaacaagaucaccaagaaccugaacucccucucggagcuggaggucaagaaccugcagcgccucuccggcgccauggacgagcugcacaaugagauccuggagcucgacgagaagguggacgaccugcgggccgacaccaucagcucccagaucgagcuggccgugcuccugucgaacgaggggaucaucaacuccgaggacgagcaccuccuggcgcuggagcgcaagcugaagaagaugcucggccccagugccgucgagaucgggaacggcugcuucgagaccaagcacaagugcaaccagaccugccuggaccggaucgccgccgggacguucgacgcgggcgaguuuucccugcccaccuucgacucgcucaacaucaccgccgccucccugaacgacgacggccuggacaaccacaccauccuccuguauuacagcacggccgccuccucgcuggcggugacccugaugaucgccaucuucguggucuacauggugucccgcgacaacgugagcugcuccaucugccucuga

SEQ ID NO: 15820 - RNA, 1758 nt, Artificial Sequence
  derived and/or modified CDS sequence (AUadapt) from InfluenzaB__AHL93719__HA
augaaggccaucaucgugcugcucauggucgugaccaguaacgccgaccgcaucugcaccggcaucacguccucgaacagcccccacaucgugaagaccgcgacccagggggaggucaacgugaccggcgugaucccgcugacgaccacccccaccaagucgcacuucgccaaccugaaggggacggagacccggggcaagcucugccccaagugccugaacugcaccgaucuggacgucgcccucgggcgccccaagugcaccggcaagaucccguccgcccgggugucgauccugcacgaggugauccccgucacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggaguugccccaacaucacgaacggcaacggcuucuucgccaccauggccugggccgugcccaagaacgacaagaacaagaccgcgaccaacccgcucacgaucgagguccccuacaucugcaccgagggggaggaccagaucaccguguggggcuuccacuccgacaacgagacccagauggccaagcuguauggggacucgaagccccagaaguucacguccagcgccaacggcgugaccacccacuacgucucccagaucggcggguuccccaaccagaccgaggacggcgggcugccgcagucgggccgcaucgugguggacuacaugguccagaaguccgggaagacgggcaccaucaccuaccagcggggcauccuccugccccagaagguguggugcgccucggggcgcuccaaggugaucaagggcagccugccccucaucggggaggccgauugccugcacgagaaguacggcgggcugaacaagucgaagcccuacuacaccggcgagcacgcgaaggccaucggcaacugcccgaucugggucaagacgccccucaagcuggccaacgggaccaaguaccggccgcccgccaagcugcucaaggagcgcggcuucuucggggccaucgcgggcuuccuggagggcgggugggagggcaugaucgccggguggcacggcuacaccucccauggggcccacggcguggccguggccgcggaccugaaguccacccaggaggccaucaacaagaucacgaagaaccucaacucccugucggagcuggaggucaagaaccuccagcggcuguccggcgccauggacgagcugcacaacgagauccucgagcuggacgagaagguggacgaccugcgcgccgacaccaucagcucccagaucgagcucgccguccugcugucgaacgaggggaucaucaauuccgaggacgagcaccuccuggcgcuggagcggaagcucaagaagaugcugggccccucggccguggagaucgggaacggcugcuucgagaccaagcacaagugcaaccagaccugccuggaccgcaucgccgccgggaccuucgacgcgggcgaguucucccuccccacguucgacagccugaauaucaccgccgccucccugaacgacgacggccucgacaaccacaccauccugcuguacuacucgaccgccgccuccucgcuggcggugacgcucaugaucgccaucuucgucguguacauggugucccgggacaacgucagcugcuccaucugccuguga

SEQ ID NO: 15821 - RNA, 1758 nt, Artificial Sequence; identical to SEQ ID NO: 14423
  derived and/or modified CDS sequence (AUadapt) from InfluenzaB__AHL93730__HA

SEQ ID NO: 15822 - RNA, 1758 nt, Artificial Sequence; identical to SEQ ID NO: 14423
  derived and/or modified CDS sequence (AUadapt) from InfluenzaB__AHL93741__HA

SEQ ID NO: 15823 - RNA, 1758 nt, Artificial Sequence; identical to SEQ ID NO: 14118
  derived and/or modified CDS sequence (AUadapt) from InfluenzaB__AHL93752__HA

SEQ ID NO: 15824 - RNA, 1758 nt, Artificial Sequence; identical to SEQ ID NO: 15810
  derived and/or modified CDS sequence (AUadapt) from InfluenzaB__AHL93763__HA

SEQ ID NO: 15825 - RNA, 1758 nt, Artificial Sequence; identical to SEQ ID NO: 14348
  derived and/or modified CDS sequence (AUadapt) from InfluenzaB__AHL93774__HA

SEQ ID NO: 15826 - RNA, 1758 nt, Artificial Sequence; identical to SEQ ID NO: 15810
  derived and/or modified CDS sequence (AUadapt) from InfluenzaB__AHL93785__HA

SEQ ID NO: 15827 - RNA, 1758 nt, Artificial Sequence; identical to SEQ ID NO: 14423
  derived and/or modified CDS sequence (AUadapt) from InfluenzaB__AHL93796__HA

SEQ ID NO: 15828 - RNA, 1758 nt, Artificial Sequence; identical to SEQ ID NO: 14348
  derived and/or modified CDS sequence (AUadapt) from InfluenzaB__AHL93818__HA

SEQ ID NO: 15829 - RNA, 1758 nt, Artificial Sequence
  derived and/or modified CDS sequence (AUadapt) from InfluenzaB__AHL93829__HA
augaaggccaucaucgugcugcucauggucgugaccaguaacgccgaccgcaucugcaccggcaucacguccucgaacagcccccacaucgugaagaccgcgacccagggggaggucaacgugaccggcgugaucccgcugacgaccacccccaccaagucgcacuucgccaaccugaaggggacggagacccggggcaagcucugccccaagugccugaauugcaccgaccuggacgucgcccucgggcgccccaagugcaccggcaagaucccguccgcccgggugucgauccugcacgaggugcgccccgucacguccggcugcuuccccaucaugcacgaccggaccaagauccgccagcugcccaaccuccugcggggguacgagcacauccgccugagcacccacaaugugaucaacaccgagaacgccccgggcgggcccuacaagaucggcacguccgggucgugccccaacaucaccaacggcaacggcuucuucgcgaccauggccugggccgugcccaagaacgacaagaacaagaccgccacgaacccgcucaccaucgagguccccuacaucuguaccgagggggaggaccagaucaccguguggggcuuccacuccgacaacgagacgcagauggcgaagcuguacggggacucgaagccccagaaguucaccuccagcgccaacggcgugaccacccacuacgucucccagaucggcggguuccccaaccagacggaggauggcgggcugccgcagucgggccggaucgugguggacuacaugguccagaaguccgggaagaccggcaccaucaccuaccagcgcggcauccuccugccccagaagguguggugcgccucggggcgguccaaggugaucaagggcagccugccccucaucggggaggccgacugccugcacgagaaguacggcgggcugaacaagucgaagcccuacuacacgggcgagcaugccaaggcgaucggcaacugcccgaucugggucaagacgccccucaagcuggccaacgggaccaaguaccgcccgcccgccaagcugcucaaggagcggggcuucuucggggccaucgccggcuuccuggagggcgggugggagggcaugaucgcgggguggcacggcuacaccucccacggggcccacggcguggccguggccgccgaccugaaguccacccaggaggcgaucaacaagaucaccaagaaccucaacucccugagugagcuggaggucaagaaccuccagcgccuguccggcgccauggacgagcugcacaacgagauccucgagcuggacgagaagguggacgaccugcgggccgacaccaucagcucccagaucgagcucgccguccugcugucgaacgaggggaucaucaacuccgaggacgagcaccuccuggcccuggagcgcaagcucaagaagaugcugggccccucggcgguggagaucgggaauggcugcuucgagaccaagcacaagugcaaccagaccugccuggaccggaucgccgccgggacguucgacgccggcgaguucucccuccccaccuucgacagccugaacaucaccgcggccucccugaacgaugacggccucgacaaccacaccauccugcuguacuacucgacggccgccuccucgcuggccgugacccucaugaucgcgaucuucgucguguacauggugucccgcgacaacgucagcugcuccaucugccuguga

SEQ ID NO: 15830 - RNA, 1758 nt, Artificial Sequence; identical to SEQ ID NO: 14085
  derived and/or modified CDS sequence (AUadapt) from InfluenzaB__AHL93840__HA

SEQ ID NO: 15831 - RNA, 1758 nt, Artificial Sequence; identical to SEQ ID NO: 14423
  derived and/or modified CDS sequence (AUadapt) from InfluenzaB__AHL93851__HA

SEQ ID NO: 15832 - RNA, 1758 nt, Artificial Sequence; identical to SEQ ID NO: 14423
  derived and/or modified CDS sequence (AUadapt) from InfluenzaB__AHL93862__HA

SEQ ID NO: 15833 - RNA, 1758 nt, Artificial Sequence
  derived and/or modified CDS sequence (AUadapt) from InfluenzaB__AHL93873__HA
augaaggccaucaucgugcugcucauggucgugaccaguaacgccgaccgcaucugcaccggcaucacguccucgaacagcccccacaucgugaagaccgcgacccagggggaggucaacgugaccggcgugaucccgcugacgaccacccccaccaagucgcacuucgccaaccugaaggggacggagacccggggcgagcucugucccaagugccugaacugcaccgaccuggacgucgcccucgggcgccccaagugcaccggcaagaucccguccgcccgggugagcauccugcacgaggugcgccccgucacguccggcugcuuccccaucaugcacgaccggaccaagauccgccagcugcccaaucuccugcggggguacgagcacauccgccugucgacccacaacgugaucaacgccgagaacgcgccgggcgggcccuacaagaucggcaccuccgggagcugccccaacaucacgaacggcaauggcuucuucgccaccauggccugggccgugcccaagaacgacaagaacaagaccgcgaccaacccgcucacgaucgagguccccuacaucugcaccgagggggaggaccagaucaccguguggggcuuccacuccgacaaugagacccagauggccaagcuguacggggacucgaagccccagaaguucacguccucggccaacggcgugaccacccacuacgucucccagaucggcggguuccccaaccagaccgaggacggcgggcugccgcagagcggccggaucgugguggauuacaugguccagaaguccgggaagacgggcaccaucaccuaccagcgcggcauccuccugccccagaagguguggugcgccucggggcgguccaaggugaucaagggcagccugccccucaucggggaggccgacugccugcacgagaaguacggcgggcugaacaagucgaagcccuacuauaccggcgagcacgcgaaggccaucggcaacugcccgaucugggucaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcguggccguggccgcggaucugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucaguucccagaucgagcucgccguccugcugucgaacgaggggaucaucaacuccgaggacgagcaccuccuggcgcuggagcgcaagcucaagaagaugcugggccccagcgccguggagaucgggaacggcugcuucgagaccaagcacaagugcaaccagaccugucuggaccggaucgccgccgggaccuucgacgcgggcgaguucucccuccccacguucgacucgcugaacaucaccgccgccucccugaacgacgacggccucgacaaucacaccauccugcuguacuacagcaccgccgccuccucgcuggcggugacgcucaugaucgccaucuucgucguguacauggugucccgcgacaacgucagcugcuccaucugccuguga

SEQ ID NO: 15834 - RNA, 1758 nt, Artificial Sequence; identical to SEQ ID NO: 14423
  derived and/or modified CDS sequence (AUadapt) from InfluenzaB__AHL93884__HA

SEQ ID NO: 15835 - RNA, 1758 nt, Artificial Sequence; identical to SEQ ID NO: 14423
  derived and/or modified CDS sequence (AUadapt) from InfluenzaB__AHL93895__HA

SEQ ID NO: 15836 - RNA, 1758 nt, Artificial Sequence; identical to SEQ ID NO: 14423
  derived and/or modified CDS sequence (AUadapt) from InfluenzaB__AHL93906__HA

SEQ ID NO: 15837 - RNA, 1758 nt, Artificial Sequence; identical to SEQ ID NO: 14423
  derived and/or modified CDS sequence (AUadapt) from InfluenzaB__AHL93917__HA

SEQ ID NO: 15838 - RNA, 1758 nt, Artificial Sequence; identical to SEQ ID NO: 14348
  derived and/or modified CDS sequence (AUadapt) from InfluenzaB__AHL93928__HA

SEQ ID NO: 15839 - RNA, 1758 nt, Artificial Sequence; identical to SEQ ID NO: 14118
  derived and/or modified CDS sequence (AUadapt) from InfluenzaB__AHL93939__HA

SEQ ID NO: 15840 - RNA, 1758 nt, Artificial Sequence; identical to SEQ ID NO: 14423
  derived and/or modified CDS sequence (AUadapt) from InfluenzaB__AHL93950__HA

SEQ ID NO: 15841 - RNA, 1758 nt, Artificial Sequence; identical to SEQ ID NO: 14118
  derived and/or modified CDS sequence (AUadapt) from InfluenzaB__AHL93961__HA

SEQ ID NO: 15842 - RNA, 1758 nt, Artificial Sequence
  derived and/or modified CDS sequence (AUadapt) from InfluenzaB__AHL93972__HA
augaaggccaucaucgugcugcucauggucgugaccaguaccgccgaccgcaucugcacgggcaucaccuccagcaacucgccccacguggucaagaccgcgacccagggggaggugaacgugacgggcgucaucccgcugaccaccacccccaccaagagccacuuugccaaccugaaggggaccgagacccggggcaagcucugccccaagugccugaacugcaccgaccuggacguggcccucgggcgccccaagugcacgggcaagaucccguccgcccgggugucgauccugcaugagguccgccccgugaccuccggcugcuuccccaucaugcacgaccggaccaagauccgccagcugcccaaccuccugcggggguacgagcacauccgccugagcacccacaaugugaucaacgccgagaacgcgccgggcgggcccuacaagaucggcacguccgggagcugccccaacgucaccaacggcaacggcuucuuugccaccauggccugggccgugcccaagaacgacaagaacaagaccgcgacgaacccgcucaccaucgaggugcccuacaucugcaccgagggggaggaccagaucaccgucuggggcuuccacuccgauaacgagacgcagauggccaagcuguacggggacucgaagccccagaaguucaccuccagcgccaacggcgugaccacccacuacgugucccagaucggcggguuucccaaccagacggaggacggcgggcugccgcagucgggccggaucgucguggacuacauggugcagaaguccgggaagaccggcaccaucaccuaccagcgcggcauccuccugccccagaaggucuggugcgccagcgggcgguccaaggugaucaagggcucgcugccccucaucggggaggccgacugucugcacgagaaguacggcgggcugaacaagagcaagcccuacuacacgggcgagcacgcgaaggccgugggcaacugcccgaucugggucaagacgccccucaagcuggccaaugggaccaaguaccgcccgcccgccaagcugcucaaggagcggggcuucuucggggccaucgcgggcuuccuggagggcgggugggagggcaugaucgccggguggcacggcuacaccucccacggggcccacggcguggccgucgccgcggaccugaaguccacgcaggaggccaucaauaagaucaccaagaaccucaacucccugagcgagcuggaggugaagaaccuccagcgccuguccggcgccauggacgagcugcacaacgagauccucgagcuggacgagaagguggacgaucugcgggccgacaccaucucgucccagaucgagcucgccguccugcugagcaacgaggggaucaucaacuccgaggacgagcaccuccuggcgcuggagcgcaagcucaagaagaugcugggccccucggccguggagaucgggaacggcuguuucgagaccaagcacaagugcaaccagaccugccuggaccggaucgccgccgggacguucgacgcgggcgaguucucccuccccaccuuugacagccugaacaucaccgccgccucccugaacgacgacggccucgacaaccacaccauccugcuguauuacucgacggccgccuccagccuggcggugacccucaugaucgccaucuucgucguguacauggugucccgcgacaacgucagcugcuccaucugccuguga

SEQ ID NO: 15843 - RNA, 1758 nt, Artificial Sequence; identical to SEQ ID NO: 14348
  derived and/or modified CDS sequence (AUadapt) from InfluenzaB__AHL93983__HA

SEQ ID NO: 15844 - RNA, 1755 nt, Artificial Sequence
  derived and/or modified CDS sequence (AUadapt) from InfluenzaB__AHL93994__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaagaaguccuauuucgccaaccugaaggggaccaagacgcggggcaagcucugccccgacugccugaacugcaccgaccuggacguggcccucgggcgccccaugugugugggcaccaccccguccgccaaggccucgauccugcacgagguccggcccgugacguccggcugcuuccccaucaugcacgaccgcaccaagauccggcagcuggcgaaccuccugcgcggguacgagaacauccggcugaguacccagaacgugaucgacgccgagaaggcccccggcgggccguaccgccucggcaccuccgggagcugccccaacgccacguccaagucgggcuucuuugcgaccauggccugggccguccccaaggacaacaacaagaacgccaccaacccccugaccguggaggugccguacaucugcgccgagggcgaggaccagaucacggucuggggguuccauuccgacaacaagacccagaugaagaaccuguacggcgacagcaacccccagaaguucaccuccagcgcgaauggggugaccacgcacuacgugucccagaucggcggcuuccccgaccagaccgaggacgggggccucccccagucggggcggaucgucguggacuacaugaugcagaagccgggcaagaccgggaccaucguguaucagcgcggcguccugcugccccagaagguguggugcgccuccggccggagcaaggugaucaaggggagccucccccugaucggcgaggccgacugccugcacgagaaguacgggggccucaacaaguccaagcccuacuauacgggggagcacgccaaggccaucggcaacugcccgaucugggucaagacgccccugaagcuggcgaacggcaccaaguaccgcccgcccgccaagcuccugaaggagcggggguucuucggcgccaucgccggguuccuggagggcgggugggagggcaugaucgccggcuggcacggguauaccucgcacggcgcgcacgggguggccgucgccgccgaccucaaguccacccaggaggccaucaacaagaucaccaagaaccugaacagccuguccgagcucgaggugaagaaucugcagcgccugagcggcgcgauggacgagcuccacaacgagauccuggagcuggacgagaagguggacgaccuccgggccgacaccaucuccucgcagaucgagcuggccguccugcucuccaaugagggcaucaucaacagcgaggacgagcaccuccuggcccuggagcgcaagcugaagaagaugcuggggcccuccgcgguggacaucggcaacgggugcuucgagaccaagcacaaguguaaccagacgugccucgaccggaucgccgccggcaccuucaacgccggggaguucagccugcccaccuucgauucccugaacaucaccgccgcgucgcucaacgacgacggccuggacaaccacaccauccugcuguacuauuccacggccgccagcucccucgccgugacccugaugcuggccaucuucaucgucuacaugaucagccgcgacaacguguccugcagcaucugccucuga

SEQ ID NO: 15845 - RNA, 1758 nt, Artificial Sequence; identical to SEQ ID NO: 14423
  derived and/or modified CDS sequence (AUadapt) from InfluenzaB__AHL94005__HA

SEQ ID NO: 15846 - RNA, 1758 nt, Artificial Sequence; identical to SEQ ID NO: 14423
  derived and/or modified CDS sequence (AUadapt) from InfluenzaB__AHL94016__HA

SEQ ID NO: 15847 - RNA, 1758 nt, Artificial Sequence
  derived and/or modified CDS sequence (AUadapt) from InfluenzaB__AHL94027__HA
augaaggccaucaucgugcugcucauggucgugaccaguaacgccgaccgcaucugcaccggcaucacguccucgaacagcccccacaucgugaagaccgcgacccagggggaggucaacgugaccggcgugaucccgcugacgaccacccccaccaagucgcacuucgccaaccugaaggggacggagacccggggcaagcucugccccaagugccugaauugcaccgaccuggacgucgcccucgggcgccccaagugcaccggcaagaucccguccgcccgggugucgauccugcacgaggugcgccccgucacguccggcugcuuccccaucaugcacgaccggaccaagauccgccagcugcccaaccuccugcggggguacgagcacauccgccugagcacccacaaugugaucaacgccgagaacgcgccgggcgggcccuacaagaucggcaccuccgggucgugccccaacaucacgaacggcaacggcuucuucgccaccauggccugggccgugcccaagaacgacaagaacaagaccgcgaccaacccgcucacgaucgagguccccuacaucuguaccgagggggaggaccagaucaccguguggggcuuccacuccgacaacgagacccagauggccaagcuguacggggacagcaagccccagaaguucacguccucggccaacggcgugaccacccacuacgucucccagaucggcggguuccccaaccagaccgaggauggcgggcugccgcagucgggccggaucgugguggacuacaugguccagaaguccgggaagacgggcaccaucaccuaccagaugggcgugcuccugccccagaagguguggugcgccagcgggcgcuccaaggucaucaagggcucgcugccccucaucggggaggccgacugccugcacgagaaguacggcgggcugaacaagucgaagcccuacuacaccggcgagcaugcgaaggccaucggcaacugcccgaucugggugaagacgccccucaagcuggccaacgggaccaaguaccggccgcccgccaagcugcucaaggagcgcggcuucuucggggccaucgcgggcuuccuggagggcgggugggagggcaugaucgccggguggcacggcuacaccucccacggggcccacggcguggccgucgccgcggaccugaaguccacccaggaggccaucaacaagaucacgaagaaccucaacucccugagugagcuggaggugaagaaccuccagcggcuguccggcgccauggacgagcugcacaacgagauccucgagcuggacgagaaggucgacgaccugcgcgccgacaccaucucgucccagaucgagcucgccgugcugcugagcaacgaggggaucaucaacuccgaggacgagcaccuccuggcgcuggagcggaagcucaagaagaugcugggccccucggccguggagaucgggaauggcugcuucgagaccaagcacaagugcaaccagaccugccuggaccgcaucgccgccgggaccuucgacgcgggcgaguucucccuccccacguucgacucgcugaacaucaccgccgccucccugaacgaugacggccucgacaaccacaccauccugcuguacuacagcaccgccgccuccucgcuggcggucacgcucaugaucgccaucuucgugguguacauggucucccgggacaacgugagcugcuccaucugccuguga

SEQ ID NO: 15848 - RNA, 1758 nt, Artificial Sequence; identical to SEQ ID NO: 14118
  derived and/or modified CDS sequence (AUadapt) from InfluenzaB__AHL94038__HA

SEQ ID NO: 15849 - RNA, 1758 nt, Artificial Sequence; identical to SEQ ID NO: 14348
  derived and/or modified CDS sequence (AUadapt) from InfluenzaB__AHL94049__HA

SEQ ID NO: 15850 - RNA, 1758 nt, Artificial Sequence; identical to SEQ ID NO: 14423
  derived and/or modified CDS sequence (AUadapt) from InfluenzaB__AHL94060__HA

SEQ ID NO: 15851 - RNA, 1758 nt, Artificial Sequence
  derived and/or modified CDS sequence (AUadapt) from InfluenzaB__AHL94071__HA
augaaggccaucaucgugcugcucauggucgugaccaguaacgccgaccgcaucugcaccggcaucacguccucgaacagcccccacaucgugaagaccgcgacccagggggaggucaacgugaccggcgugaucccgcugacgaccacccccaccaagucgcacuucgccaaccugaaggggacggagacccggggcaagcucugccccaagugucugaacugcaccgaccuggacgucgcccucgggcgccccaagugcaccggcaagaucccguccgcccgggugagcauccugcacgaggugcgccccgucacguccggcugcuuccccaucaugcacgaccggaccaagauccgccagcugcccaaccuccugcggggguacgagcauauccgccugucgacccacaacgugaucaacgccgagaacgcgccgggcgggcccuacaagaucggcaccuccgggucgugccccaacaucacgaacggcaacggcuucuucgccaccauggccugggccgugcccaagaaugacaagaacaagaccgcgaccaacccgcucacgaucgagguccccuacaucugcaccgagggggaggaccagaucaccguguggggcuuccacuccgacaacgagacccagauggccaagcuguacggggacagcaagccccagaaguucacguccagugccaacggcgugaccacccacuacgucucccagaucggcggguuccccaaccagaccgaggacggcgggcugccgcagagcggccggaucgugguggacuacaugaugcagaaguccgggaagacgggcaccaucaccuaccagcgcggcauccuccugccccagaaggucuggugcgccucggggcgguccaaggugaucaagggcucgcugccccucaucggggaggccgauugccugcacgagaaguacggcgggcugaacaagagcaagcccuacuacaccggcgagcacgcgaaggccaucggcaacugcccgaucugggugaagacgccccucaagcuggccaacgggaccaaguaccgcccgcccgccaagcugcucaaggagcggggcuucuuuggggccaucgcgggcuuccuggagggcgggugggagggcaugaucgccggguggcacggcuacaccucccacggggcccacggcgucgccguggccgcggaccugaaguccacccaggaggccaucuccaagaucacgaagaaccucaacucgcuguccgagcuggaggugaagaaccuccagcgccugagcggcgccauggacgagcugcacaacgagauccucgagcuggaugagaaggucgacgaccugcgggccgacaccaucuccucgcagaucgagcucgccgugcugcuguccaacgaggggaucaucaacucggaggacgagcaccuccuggcgcuggagcgcaagcucaagaagaugcugggccccuccgccgucgagaucgggaacggcugcuucgagaccaagcacaaguguaaccagaccugccuggaccggaucgccgccgggaccuucgacgcgggcgaguucagccuccccacguucgacucccugaacaucaccgccgccucgcugaacgacgauggccucgacaaccacaccauccugcuguacuacuccaccgccgccagcucccuggcggugacgcucaugaucgccaucuucguggucuacauggugucgcgcgacaacguguccugcagcaucugccuguga

SEQ ID NO: 15852 - RNA, 1755 nt, Artificial Sequence
  derived and/or modified CDS sequence (AUadapt) from InfluenzaB__AHL94082__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuauuucgccaaccugaaggggacgcggacccgcggcaagcucugccccgacugccugaacugcaccgaccuggacguggcccucgggcggcccaugugugugggcaccacgccguccgccaaggccagcauccugcacgagauccgccccgucaccuccggcugcuuccccaucaugcacgaccggaccaagauccgccagcugcccaaccuccugcggggguacgagaacauccgccugaguacccagaacgugaucgacgcggagaaggccccgggcgggcccuaccggcucggcacguccgggagcugccccaacgccaccuccaagaucggcuucuucgccaccauggcgugggccgugcccaaggauaacuacaagaacgccaccaacccgcugacggucgaggugcccuacaucugcaccgagggcgaggaccagaucaccguguggggguuccacagugacaacaagacccagaugaagaaccuguacggcgacuccaacccccagaaguucacgagcuccgccaacggggucaccacccauuacgugucgcagaucggcgacuuccccgaccagaccgaggacggcgggcucccgcaguccggccgcaucguggucgacuacaugaugcagaagcccgggaagacgggcaccaucguguaucagcgcggggugcugcugccccagaaggucuggugcgccagcggccgguccaaggugaucaagggcagccucccccugaucggggaggcggacugccugcacgagaaguacggcgggcucaacaagagcaagccguauuacaccggcgagcacgccaaggccaucgggaacugccccaucugggugaagacgccccugaagcuggccaacggcaccaaguaccggcccccggccaagcuccugaaggagcgcggcuucuucggggcgaucgccggcuuccuggagggcgggugggaggggaugaucgccggcuggcauggcuacaccucccacggggcccacggcgucgccguggcggccgaccucaagucgacccaggaggccaucaacaagaucaccaagaaccugaacucccugagugagcucgaggucaagaaccugcagcggcuguccggggccauggacgagcuccacaacgagauccuggagcuggacgagaagguggacgaccuccgcgccgacacgaucagcucccagaucgagcuggcggugcugcucaguaacgagggcaucaucaacuccgaggacgagcaccuccuggcccuggagcggaagcugaagaagaugcugggccccucggccgucgacaucgggaacggcugcuucgagaccaagcauaagugcaaccagaccugccucgaccgcaucgccgcggggaccuucaacgccggcgaguucucccugcccaccuucgauagccugaacaucacggccgccucccucaacgacgacgggcuggacaaccacaccauccugcuguacuauagcaccgccgcguccagccucgccgugacccugaugcuggccaucuucaucguguacauggucucccgggacaacgugagcugcuccaucugccucuga

SEQ ID NO: 15853 - RNA, 1758 nt, Artificial Sequence; identical to SEQ ID NO: 14118
  derived and/or modified CDS sequence (AUadapt) from InfluenzaB__AHL94093__HA

SEQ ID NO: 15854 - RNA, 1758 nt, Artificial Sequence; identical to SEQ ID NO: 14423
  derived and/or modified CDS sequence (AUadapt) from InfluenzaB__AHL94102__HA

SEQ ID NO: 15855 - RNA, 1758 nt, Artificial Sequence
  derived and/or modified CDS sequence (AUadapt) from InfluenzaB__AHL94113__HA
augaaggccaucaucgugcugcucauggucgugaccaguaacgccgaccgcaucugcaccggcaucacguccucgaacagcccccacaucgugaagaccgcgacccagggggaggucaacgugaccggcgugaucccgcugacgaccacccccaccaagucccacuucgccaaccugaaggggacggagacccggggcaagcucugccccaagugccugaacuguaccgaccuggacgucgcccucgggcgccccaagugcaccggcaagaucccguccgcccgggugucgauccugcacgaggugcgccccgucacguccggcugcuuccccaucaugcacgaccggaccaagauccgccagcugcccaaccuccugcggggguacgagcacauccgccugucgacccacaacgugaucaaugccgagaacgcgccgggcgggcccuacaagaucggcaccuccgggagcugccucaacaucacgaacggcaacggcuucuucgccaccauggccugggccgugcccaagaacgacaagaacaagaccgcgaccaacccccugacgaucgaggucccguacaucugcaccgagggggaggaucagaucaccguguggggcuuccacuccgacaacgagacccagauggccaagcuguacggggacucgaagccccagaaguucacguccagcgccaacggcgugaccacccacuacgucucccagaucggcggguuccccaaccagaccgaggacggcgggcucccccagaguggccggaucgugguggacuacaugguccagaaguccgggaagacgggcaccaucaccuaccagcgcggcauccugcugccgcagaagguguggugcgccucggggcgguccaaggugaucaagggcagccucccccugaucggggaggccgacugccugcacgagaaguacggcgggcucaacaagucgaagcccuacuacaccggcgagcacgcgaaggccaucggcaauugccccaucugggucaagacgccgcugaagcuggccaacgggaccaaguaccgcccgcccgccaagcuccugaaggagcggggcuucuucggggccaucgcgggcuuccuggagggcgggugggagggcaugaucgccggguggcacggcuacaccucccacggggcccacggcguggccguggccgcggaccucaagucgacccaggaggccaucaacaagaucacgaagaaccugaacucccugagugagcucgaggucaagaaccugcagcgccuguccggcgccauggacgagcuccacaacgagauccuggagcuggacgagaagguggacgaccuccgggccgacaccaucucgucccagaucgagcuggccguccugcucagcaacgaggggaucaucaacuccgaggacgagcaccuccuggcgcuggagcgcaagcugaagaagaugcugggccccucggccguggagaucgggaauggcugcuucgagaccaagcacaagugcaaccagaccugccucgaccggaucgccgccgggaccuucgacgcgggcgaguucucccugcccacguucgacucgcugaacaucaccgccgccucccucaacgaugacggccuggacaaccacaccauccugcuguacuacagcaccgccgccuccucgcucgcggugacgcugaugaucgccaucuucgucguguacauggugucccgcgacaacgucagcugcuccaucugccuguga

SEQ ID NO: 15856 - RNA, 1758 nt, Artificial Sequence
  derived and/or modified CDS sequence (AUadapt) from InfluenzaB__AHL94124__HA
augaaggccaucaucgugcugcucauggucgugaccaguaacgccgaccgcaucugcaccggcaucacguccucgaacagcccccacaucgugaagaccgcgacccagggggaggucaacgugaccggcgugaucccgcugacgaccacccccaccaagucgcacuucgccaaccugaaggggacggagacccggggcaagcucugccccaagugccugaauugcaccgaccuggacgucgcccucgggcgccccaagugcaccggcaagaucccguccgcccgggugucgauccugcacgagauccgccccgugacguccggcugcuuccccaucaugcacgaccggaccaagauccgccagcugcccaaccuccugcggggguacgagcacauccgccugagcacccacaaugucaucaacgccgagaacgcgccgggcgggcccuacaagaucggcaccuccgggucgugccccaacaucacgaacggcaacggcuucuucgccaccauggccugggccgugcccaagaacgacaagaacaagaccgcgaccaacccgcucacgaucgaggugcccuacaucuguaccgagggggaggaccagaucaccgucuggggcuuccacuccgacaacgagacccagauggccaagcuguacggggacucgaagccccagaaguucacguccagcgccaacggcgugaccacccacuacgugucccagaucggcggguuccccaaccagaccgaggauggcgggcugccgcagucgggccggaucgucguggacuacauggugcagaaguccgggaagacgggcaccaucaccuaccagcgcggcauccuccugccccagaaggucuggugcgccucggggcgguccaaggugaucaagggcagccugccccucaucggggaggccgacugccugcacgagaaguacggcgggcugaacaagucgaagcccuacuacaccggcgagcaugcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagugagcuggaggugaagaaccuccagcgccuguccggcgccauggacgagcugcacaacgagauccucgagcuggacgagaaggucgacgaccugcgggccgacaccaucagcucccagaucgagcucgccgugcugcugucgaacgaggggaucaucaacuccgaggacgagcaccuccuggcgcuggagcgcaagcucaagaagaugcugggccccucggccgucgagaucgggaauggcugcuucgagaccaagcacaagugcaaccagaccugccuggaccggaucgccgccgggaccuucgacgcgggcgaguucucccuccccacguucgacagccugaacaucaccgccgccucccugaacgaugacggccucgacaaccacaccauccugcuguacuacucgaccgccgccuccucgcuggcggugacgcucaugaucgccaucuucguggucuacauggugucccgcgacaacgugagcugcuccaucugccuguga

SEQ ID NO: 15857 - RNA, 1758 nt, Artificial Sequence; identical to SEQ ID NO: 14348
  derived and/or modified CDS sequence (AUadapt) from InfluenzaB__AHL94135__HA

SEQ ID NO: 15858 - RNA, 1758 nt, Artificial Sequence; identical to SEQ ID NO: 14348
  derived and/or modified CDS sequence (AUadapt) from InfluenzaB__AHL94146__HA

SEQ ID NO: 15859 - RNA, 1758 nt, Artificial Sequence; identical to SEQ ID NO: 14423
  derived and/or modified CDS sequence (AUadapt) from InfluenzaB__AHL94157__HA

SEQ ID NO: 15860 - RNA, 1758 nt, Artificial Sequence; identical to SEQ ID NO: 14423
  derived and/or modified CDS sequence (AUadapt) from InfluenzaB__AHL94168__HA

SEQ ID NO: 15861 - RNA, 1758 nt, Artificial Sequence; identical to SEQ ID NO: 14348
  derived and/or modified CDS sequence (AUadapt) from InfluenzaB__AHL94179__HA

SEQ ID NO: 15862 - RNA, 1758 nt, Artificial Sequence; identical to SEQ ID NO: 14348
  derived and/or modified CDS sequence (AUadapt) from InfluenzaB__AHL94190__HA

SEQ ID NO: 15863 - RNA, 1758 nt, Artificial Sequence
  derived and/or modified CDS sequence (AUadapt) from InfluenzaB__AHL94201__HA
augaaggccaucaucgugcugcucauggucgugaccaguaacgccgaccgcaucugcaccggcaucacguccucgaacucgccccacaucgugaagaccgcgacccagggggaggucaacgugaccggcgugaucccgcugacgaccacccccaccaagagccacuucgccaaccugaaggggacggagacccggggcaagcucugccccaagugccugaacugcaccgaucuggacgucgcccucgggcgccccaagugcaccggcaagaucccguccgcccgggugucgauccugcacgaggugcgccccgucacguccggcugcuuccccaucaugcacgaccggaccaagauccgccagcugcccaaccuccugcggggguacgagcacauccgccugucgacccacaacgugaucaacgccgagaacgcgccgggcgggcccuacaagaucggcaccuccgggaguugccccaacaucacgaacggcaacggcuucuucgagaccauggccugggccgugcccaagaacgacaagaacaagaccgccaccaacccgcucacgaucgagguccccuacaucugcaccgagggggaggaccagaucaccguguggggcuuccacuccgacaacgagacccagauggcgaagcuguauggggacucgaagccccagaaguucacguccucggccaacggcgugaccacccacuacgucucccagaucggcggguuccccaaccagaccgaggacggcgggcugccgcagucgggccggaucgugguggacuacaugguccagaaguccgggaagacgggcaccaucaccuaccagcgcggcauccuccugccccagaagguguggugcgccagcgggcgguccaaggugaucaagggcucgcugccccucaucggggaggccgauugccugcacgagaaguacggcgggcugaacaagucgaagcccuacuacaccggcgagcacgccaaggcgaucggcaacugcccgaucugggucaagacgccccucaagcuggccaacgggaccaaguaccgcccgcccgccaagcugcucaaggagcggggcuucuucggggccaucgccggcuuccuggagggcgggugggagggcaugaucgcgggguggcacggcuacaccucccauggggcccacggcguggccguggccgccgaccugaaguccacccaggaggcgaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucucgucccagaucgagcucgccguccugcugucgaacgaggggaucaucaauuccgaggacgagcaccuccuggcccuggagcgcaagcucaagaagaugcugggccccucggcgguggagaucgggaacggcugcuucgagaccaagcacaagugcaaccagaccugccuggaccggaucgccgccgggaccuucgacgccggcgaguucucccuccccacguucgacagccugaauaucaccgcggccucccugaacgacgacggccucgacaaccacaccauccugcuguacuacucgaccgccgccuccucgcuggccgugacgcucaugaucgcgaucuucgucguguacauggugucccgcaacaacgucagcugcuccaucugccuguga

SEQ ID NO: 15864 - RNA, 1758 nt, Artificial Sequence
  derived and/or modified CDS sequence (AUadapt) from InfluenzaB__AHL94212__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccacuuugccaaccugaaggggacggagacccggggcaagcucugccccaagugccugaacugcaccgaccuggacguggcccucgggcgccccaagugcaccggcaagaucccguccgcccgggugucgauccugcacgagguccgccccgugacguccggcuguuuccccaucaugcacgaccggaccaagauccgccagcugcccaaccuccugcggggguacgagcacauccgccugagcacccacaacgugaucaacgccgagaaugcgccgggcgggcccuacaagaucggcaccuccgggucgugccccaacgucacgaacggcaacggcuucuucgccaccauggccugggccgugcccaagaacgacaagaauaagaccgcgaccaacccgcucacgaucgaggugcccuacaucugcaccgagggggaggaccaggucaccguguggggcuuccacuccgacaacgagacccagauggccaagcuguacggggacaguaagccccagaaguucacguccucggccaacggcgugaccacccacuacgucucccagaucggcggguuccccaaccagaccgaggacggcgggcugccgcagagcggccggaucgugguggacuauaugguccagaaguccgggaagacgggcaccaucaccuaccagcgcggcauccuccugccccagaagguguggugcgccucggggcgguccaaggugaucaagggcagccugccccucaucggggaggccgacugccugcacgagaaguacggcgggcugaacaagucgaagcccuauuacaccggcgagcacgcgaaggccaucggcaacugcccgaucugggucaagacgccccucaagcuggccaacgggaccaaguaccgcccgcccgccaagcugcucaaggagcggggcuucuucggggccaucgcgggcuuccuggagggcgggugggagggcaugaucgccggguggcacggcuauaccucccacggggcccacggcguggccgucgccgcggaccugaaguccacccaggaggccaucaacaagaucacgaagaaccucaacucccugagcgagcuggaggugaagaaccuccagcgccuguccggcgccauggacgagcugcacaaugagauccucgagcuggacgagaagguggacgaccugcgggccgacaccaucucgucccagaucgagcucgccguccugcugagcaacgaggggaucaucaacuccgaggacgagcaccuccuggcgcuggagcgcaagcucaagaagaugcugggccccagugccguggagaucgggaacggcugcuucgagaccaagcacaagugcaaccagaccugccuggaccggaucgccgccgggaccuucgacgcgggcgaguuuucccuccccacguucgacagccugaacaucaccgccgccucccugaacgacgacggccucgacaaccacaccauccugcuguauuacucgaccgccgccuccagccuggcggugacgcucaugaucgccaucuucgucguguacauggugucccgcgacaacgucagcugcuccaucugccuguga

SEQ ID NO: 15865 - RNA, 1758 nt, Artificial Sequence; identical to SEQ ID NO: 14423
  derived and/or modified CDS sequence (AUadapt) from InfluenzaB__AHL94220__HA

SEQ ID NO: 15866 - RNA, 1758 nt, Artificial Sequence; identical to SEQ ID NO: 14423
  derived and/or modified CDS sequence (AUadapt) from InfluenzaB__AHL94231__HA

SEQ ID NO: 15867 - RNA, 1758 nt, Artificial Sequence
  derived and/or modified CDS sequence (AUadapt) from InfluenzaB__AHL94242__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucccacuucgccaaccugaaggggacggagacccggggcaagcucugccccaagugucugaacugcaccgaccuggacguggcccucgggcgccccaagugcaccggcaagaucccguccgcccgggugucgauccugcacgagguccgccccgugacguccggcugcuuccccaucaugcacgaccggaccaagauccgccagcugcccaaccuccugcggggguaugagcacauccgccugucgacccacaacgugaucaacgccgagaacgcgccgggcgggcccuacaagaucggcaccuccgggagcugccccaacgucacgaacggcaacggcuuuuucgccaccauggccugggccgugcccaagaacgacaagaacaagaccgcgaccaacccgcucacgaucgaggugcccuacaucugcaccgagggggaggaccagaucaccgucuggggcuuccacuccgacaacgagacccagauggccaagcuguauggggacucgaagccccagaaguucacguccagcgccaacggcgugaccacccacuacgugucccagaucggcggguuccccaaccagaccgaggacggcgggcugccgcagucgggccggaucgucguggacuauauggugcagaaguccgggaagacgggcaccaucaccuaccagcgcggcauccuccugccccagaaggucuggugcgccaacgggcggucgaaggugaucaagggcucccugccccucaucggggaggccgacugccugcacgagaaguacggcgggcugaacaagagcaagcccuacuacaccggcgagcaugcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucgcacggggcccacggcgucgccguggccgcggaucugaaguccacccaggaggccaucaacaagaucacgaagaaccucaacucgcuguccgagcuggaggucaagaaccuccagcgccugagcggcgccauggacgagcugcacaacgagauccucgagcuggacgagaagguggacgaccugcgggccgauaccaucuccucgcagaucgagcucgccgugcugcuguccaacgaggggaucaucaacagcgaggacgagcaccuccuggcgcuggagcgcaagcucaagaagaugcugggccccuccgccgucgagaucgggaacggcugcuucgagaccaagcacaagugcaaccagaccugucuggaccggaucgccgccgggaccuucgacgcgggcgaguucucgcuccccacguucgacucccugaacaucaccgccgccucgcugaacgacgacggccucgauaaccacaccauccugcuguacuacuccaccgccgccagcucccuggcggugacgcucaugaucgccaucuucguggucuacauggugucgcgcgacaacguguccugcagcaucugccuguga

SEQ ID NO: 15868 - RNA, 1758 nt, Artificial Sequence; identical to SEQ ID NO: 14118
  derived and/or modified CDS sequence (AUadapt) from InfluenzaB__AHL94253__HA

SEQ ID NO: 15869 - RNA, 1755 nt, Artificial Sequence; identical to SEQ ID NO: 14093
  derived and/or modified CDS sequence (AUadapt) from InfluenzaB__AHL94274__HA

SEQ ID NO: 15870 - RNA, 1755 nt, Artificial Sequence; identical to SEQ ID NO: 14093
  derived and/or modified CDS sequence (AUadapt) from InfluenzaB__AHL94295__HA

SEQ ID NO: 15871 - RNA, 1755 nt, Artificial Sequence
  derived and/or modified CDS sequence (AUadapt) from InfluenzaB__AHL94306__HA
augaaggccaucaucgugcugcucauggucgugaccaguaacgccgaccgcaucugcaccggcaucacguccagcaacagcccccacguggucaagaccgcgacccagggggaggugaaugugaccggcgccaucccgcugacgaccacccccaccaagagcuacuucgccaaccugaaggggacgcggacccgcggcaagcucugccccgacugccugaauugcaccgaccuggacgucgcccucgggcggcccaugugcgugggcaccacgccguccgccaaggcgagcauccugcacgaggugcgccccgucaccuccggcugcuuucccaucaugcacgaccggaccaagauccgccagcugcccaaccuccugcggggguacgagaacauccgccugucgacccagaacgugaucgaugccgagaaggccccgggcgggcccuaccggcucggcacguccgggagcugccccaacgccaccuccaagaucggcuucuucgcgaccauggccugggccgugcccaaggacaauuacaagaacgccaccaacccgcagacggucgaggugcccuacaucugcaccgagggcgaggaccagaucaccguguggggguuccauagcgacaacaagacccagaugaagaaccuguacggcgacuccaacccccagaaguuuacgagcuccgccaacggggucaccacccacuacgugagccagaucggcgacuuccccgaucagaccgaggacggcgggcugccgcaguccggccgcaucguggucgacuacauggugcagaagcccgggaagacgggcaccaucguguaccagcgcgggguccuccugccccagaagguguggugcgcgucgggccgguccaaggugaucaagggcagccugccccucaucggggaggccgauugccugcacgagaaguacggcgggcugaacaagagcaagccguacuacaccggcgagcaugccaaggccaucgggaacugccccaucugggucaagacgccccucaagcuggccaacggcaccaaguaccggcccccggcgaagcugcucaaggagcgcggcuucuucggggccaucgccggcuuccuggagggcgggugggaggggaugaucgccggcuggcauggcuacaccucccacggggcccacggcguggcggucgccgccgaccugaaguccacccaggaggccaucaacaagaucaccaagaaccucaacucccugagugagcuggaggugaagaaccuccagcggcuguccggggccauggacgagcugcacaacgagauccucgagcuggacgagaagguggacgaccugcgcgcggauacgaucagcucccagaucgagcucgccguccugcugucgaacgagggcaucaucaacuccgaggacgagcaccuccuggcccuggagcggaagcucaagaagaugcugggccccagcgccguggauaucgggaacggcugcuucgagaccaagcacaagugcaaccagaccugccuggaucgcaucgcggccgggaccuucaacgccggcgaguucucccuccccaccuucgacagccugaacaucacggccgccucccugaaugacgacgggcucgacaaccacaccauccugcuguacuacaguaccgcggccuccagccuggccgugacccucaugcuggccaucuucaucgucuacauggugucccgggacaacgugagcugcuccaucugccuguga

SEQ ID NO: 15872 - RNA, 1755 nt, Artificial Sequence
  derived and/or modified CDS sequence (AUadapt) from InfluenzaB__AHL94317__HA
augaaggccaucaucgugcugcucauggucgugaccaguaacgccgaccgcaucugcaccggcaucacguccagcaacagcccccauguggucaagaccgcgacccagggggaggugaacgugaccggcgccaucccgcugacgaccacccccaccaagagcuacuucgccaaccugaaggggauccggacgcgcggcaagcucugccccgacugucugaacugcaccgaccuggacgucgcccucgggcggcccaugugcgugggcaccaccccguccgccaaggcgagcauccugcaugaggugcgccccgucacguccggcugcuuccccaucaugcacgaccggaccaagauccgccagcugcccaaccuccugcggggguacgagaacauccgccugaguacccagaacgugaucgacgccgagaaggccccgggcgggcccuaccggcucggcaccuccgggagcugccccaacgccacguccaagaucggcuucuuugcgaccauggccugggccgugccccgcgacaacuacaagaacgccaccaacccgcagaccgucgaggugcccuacaucuguacggagggcgaggaccagaucaccguguggggguuccacagcgacaacaagacccagaugaagaaccuguauggcgacuccaacccccagaaguucaccagcuccgccaacggggucacgacccacuacgugagucagaucggcgacuuccccgaccagaccgaggacggcgggcugccgcaguccggccggaucguggucgacuacauggugcagaagcccgggaagaccggcacgaucguguaucagcgcgggguccuccugccccagaagguguggugcgcgucgggccgguccaaggugaucaagggcagccugccccucaucggggaggccgacugccugcacgagaaguacggcgggcugaauaagagcaagccguacuacaccggcgagcacgccaaggccaucgggaacugccccaucugggucaagacgccccucaagcuggccaauggcaccaaguaccggcccccggcgaagcugcucaaggagcgcggcuucuucggggccaucgccggcuuccuggagggcgggugggaggggaugaucgccggcuggcacggcuacaccucccacggggcccauggcguggcggucgccgccgaccugaaguccacccaggaggccaucaacaagaucaccaagaaccucaacucccugagcgagcuggaggugaagaaccuccagcgccuguccggggccauggacgagcugcauaacgagauccucgagcuggacgagaagguggacgaccugcgggcggacaccaucagcucccagaucgagcucgccguccugcugaguaacgagggcaucaucaacuccgaggacgagcaccuccuggcccuggagcgcaagcucaagaagaugcugggccccagcgccguggacaucgggaacggcuguuucgagacgaagcacaagugcaaccagaccugccuggaccggaucgcggccgggaccuucaaugccggcgaguucucccuccccaccuucgacagccugaacaucaccgccgccucccugaacgaugacgggcucgacaaccacacgauccugcuguacuacagcaccgcggccuccagucuggccgugacccucaugcuggccaucuucaucgucuacauggugucccgcgacaacgugagcugcuccaucugccuguga

SEQ ID NO: 15873 - RNA, 1755 nt, Artificial Sequence; identical to SEQ ID NO: 15871
  derived and/or modified CDS sequence (AUadapt) from InfluenzaB__AHL94328__HA

SEQ ID NO: 15874 - RNA, 1755 nt, Artificial Sequence; identical to SEQ ID NO: 14093
  derived and/or modified CDS sequence (AUadapt) from InfluenzaB__AHL94339__HA

SEQ ID NO: 15875 - RNA, 1758 nt, Artificial Sequence
  derived and/or modified CDS sequence (AUadapt) from InfluenzaB__AHL94350__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugccccaagugucugaacugcaccgaccuggacguggcccucgggcgccccaagugcaccggcaagaucccguccgcccgggugucgauccugcacgagguccgccccgugacguccggcugcuuccccaucaugcacgaccggaccaagauccgccagcugcccaaccuccugcggggguacgagcauauccgccugagcacccacaacgugaucaacgccgagaacgcgccgggcgggcccuacaagaucggcaccuccgggucgugccccaacgucacgaacggcaacggcuucuucgccaccauggccugggccgugcccaagaacgauaagaacaagaccgcgaccaacccgcucacgaucgaggugcccuacaucugcaccgagggggaggaccagaucaccgucuggggcuuccacuccgacaacgagacccagauggccaagcuguacggggacagcaacccccagaaguuuacguccucggccaacggcgugaccacccacuacgugucccagaucggcggguuccccaaccagaccgaggacggcgggcugccgcagucgggccggaucgucguggacuacauggugcagaaguccgggaagacgggcaccaucaccuaccagcgcggcauccuccugccccagaaggucuggugcgccagcgggcgguccaaggugaucaagggcucgcugccccucaucggggaggccgauugccugcacgagaaguacggcgggcugaacaagucgaagcccuacuacaccggcgagcacgcgaaggccaucggcaacugcccgaucugggugaagacgccccucaagcuggccaacgggaccaaguaccgcccgcccgccaagcugcucaaggagcggggcuucuuuggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagcgagcuggaggucaagaaccuccagcgccuguccggcgccauggacgagcugcacaaugagauccucgagcuggacgagaagguggacgaccugcgggccgacaccaucucgucccagaucgagcucgccgugcugcugagcaacgaggggaucaucaacuccgaggacgagcaccuccuggcgcuggagcgcaagcucaagaagaugcugggccccucggccgucgagaucgggaacggcugcuucgagaccaagcauaagugcaaccagaccugccuggaccggaucgccgccgggaccuucgacgcgggcgaguucucccuccccacguucgacucgcugaacaucaccgccgccucccugaacgacgauggccucgacaaccacaccauccugcuguacuacagcaccgccgccuccucgcuggcggugacgcucaugaucgccaucuucguggucuacaugguguccaaggacaacgugagcugcuccaucugccuguga

SEQ ID NO: 15876 - RNA, 1758 nt, Artificial Sequence
  derived and/or modified CDS sequence (AUadapt) from InfluenzaB__AHL94361__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccauuucgccaaccugaaggggacggagacccggggcaagcucugccccaagugccugaacugcaccgaccuggacguggcccucgggcgccccaagugcaccggcaagaucccguccgcccgggugaguauccugcacgagguccgccccgugacguccggcugcuuccccaucaugcacgaccggaccaagauccgccagcugcccaaccuccugcggggguacgagcacauccgccugagcacccauaacgugaucaacgccgagaacgcgccgggcgggcccuacaagaucggcaccuccgggagcugccccaacgucacgaacggcaacggcuucuuugccaccauggccugggccgugcccaagaacgacaagaacaagaccgcgaccaacccgcucacgaucgaggugcccuacaucugcaccgagggggaggaccagaucaccgucuggggcuuccacuccgauaacgagacccagauggccaagcuguacggggacucgaacccccagaaguucacguccagcgccaacggcgugaccacccacuaugugucccagaucggcggguuccccaaccagaccgaggacggcgggcugccgcagucgggccggaucgucguggacuacauggugcagaaguccgggaagacgggcaccaucgccuaccagcgcggcauccuccugccccagaaggucuggugcgccagcgggcgguccaaggugaucaagggcagccugccccucaucggggaggcggauugccugcacgagaaguacggcgggcugaacaagucgaagcccuacuacaccggcgagcacgccaaggccaucggcaacuguccgaucugggugaagacgccccucaagcuggccaacgggaccaaguaccgcccgcccgccaagcugcucaaggagcggggcuucuucggggcgaucgccggcuuccuggagggcgggugggagggcaugaucgccggguggcacggcuacaccucccacggggcccacggcgucgccguggcggccgaucugaaguccacccaggaggccaucaacaagaucaccaagaaccucaacucccugagcgagcuggaggucaagaaccuccagcgccuguccggcgccauggacgagcugcacaacgagauccucgagcuggacgagaagguggaugaccugcgggccgacacgaucucgucccagaucgagcucgcggugcugcugagcaacgaggggaucaucaacuccgaggacgagcaccuccuggcccuggagcgcaagcucaagaagaugcugggccccagcgccgucgagaucgggaacggcuguuucgagaccaagcacaagugcaaccagaccugccuggaccggaucgccgcggggaccuucgacgccggcgaguucucccuccccaccuuugacucgcugaacaucacggccgccucccugaacgacgacggccucgacaaccacaccauccugcuguauuacagcaccgccgcguccucgcuggccgugacccucaugaucgccaucuucguggucuacauggugucccgcgacagcguguccugcagcaucugccuguga

SEQ ID NO: 15877 - RNA, 1758 nt, Artificial Sequence
  derived and/or modified CDS sequence (AUadapt) from InfluenzaB__AHL94383__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugucccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaucuccugcggggguacgagcacauccgccugucgacccacaacgugaucaacgccgagaacgcgccgggcgggcccuacaagaucggcaccuccgggagcugccccaacgucacgaacggcaauggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaaugagacccagauggagaagcuguacggggacucgaagccccagaaguucacguccucggccaacggcgugaccacccacuacgugucccagaucggcggguuccccaaccagaccgaggacggcgggcugccgcagagcggccggaucgucguggauuacauggugcagaaguccgggaagacgggcaccaucaccuaccagcgcggcauccuccugccccagaaggucuggugcgccucggggcgguccaaggugaucaagggcagccugccccucaucggggaggccgacugccugcacgagaaguacggcgggcugaacaagucgaagcccuacuauaccggcgagcacgccaaggcgaucggcaacugcccgaucugggugaagacgccccucaagcuggccaacgggaccaaguaccgcccgcccgccaagcugcucaaggagcggggcuucuucggggccaucgccggcuuccuggagggcgggugggagggcaugaucgcgggguggcacggcuacaccucccacggggcccacggcgucgccguggccgccgaucugaaguccacccaggaggcgaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucaguucccagaucgagcucgccgugcugcugucgaacgaggggaucaucaacuccgaggacgagcaccuccuggcccuggagcgcaagcucaagaagaugcugggccccagcgcggucgagaucgggaacggcugcuucgagaccaagcacaagugcaaccagaccugucuggaccggaucgccgccgggaccuucgacgccggcgaguucucccuccccacguucgacucgcugaacaucaccgcggccucccugaacgacgacggccucgacaaucacaccauccugcuguacuacagcaccgccgccuccucgcuggccgugacgcucaugaucgcgaucuucguggucuacauggugucccgcgacaacgugagcugcuccaucugccuguga

SEQ ID NO: 15878 - RNA, 1758 nt, Artificial Sequence; identical to SEQ ID NO: 14118
  derived and/or modified CDS sequence (AUadapt) from InfluenzaB__AHL94394__HA

SEQ ID NO: 15879 - RNA, 1758 nt, Artificial Sequence
  derived and/or modified CDS sequence (AUadapt) from InfluenzaB__AHL94405__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugucccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaucuccugcggggguacgagcacauccgccugucgacccacaacgugaucaacgccgagaacgcgccgggcgggcccuacaagaucggcaccuccgggagcugccccaacgucacgaacggcaauggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaaugagacccagauggccaagcuguacggggacucgaagccccagaaguucacguccucggccaacggcgugaccacccacuacgugucccagaucggcggguuccccaaccagaccgaggacggcgggcugccgcagagcggccggaucgucguggauuacauggugcagaaguccgggaagacgggcaccaucaccuaccagcgcggcauccuccugccccagaaggucuggugcgccucggggcgguccaaggugaucaagggcagccugccccucaucggggaggccgacugccugcacgagaaguacggcgggcugaacaagucgaagcccuacuauaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaucugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucaguucccagaucgagcucgccgugcugcugucgaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugucuggaccggaucgccgccgggaccuucaacgcgggcgaguucucccuccccacguucgacucgcugaacaucaccgccgccucccugaacgacgacggccucgacaaucacaccauccugcuguacuacagcaccgccgccuccucgcuggcggugacgcucaugaucgccaucuucguggucuacauggugucccgcgacaacgugagcugcuccaucugccuguga

SEQ ID NO: 15880 - RNA, 1758 nt, Artificial Sequence; identical to SEQ ID NO: 14118
  derived and/or modified CDS sequence (AUadapt) from InfluenzaB__AHL94416__HA

SEQ ID NO: 15881 - RNA, 1755 nt, Artificial Sequence; identical to SEQ ID NO: 14116
  derived and/or modified CDS sequence (AUadapt) from InfluenzaB__AHL94427__HA

SEQ ID NO: 15882 - RNA, 1755 nt, Artificial Sequence
  derived and/or modified CDS sequence (AUadapt) from InfluenzaB__AHL94438__HA
augaaggccaucaucgugcugcucauggucgugaccaguaacgccgaccgcaucugcaccggcaucacguccagcaacagcccccacguggucaagaccgcgacccagggggaggugaaugugaccggcgccaucccgcugacgaccacccccaccaagagcuacuucgccaaccugaaggggacgcggacccgcggcaagcucugccccgacugccugaacuguaccgaccuggacgucgcccucgggcggcccaugugcgugggcaccacgccguccgccaaggcgucgauccugcacgaggugcgccccgucaccuccggcugcuuccccaucaugcaugaccggaccaagauccgccagcugcccaaccuccugcggggguacgagaacauccgccugagcacccagaacgugaucgacgccgagaaggccccgggcgggcccuaccggcucggcacguccgggaguugccccaacgccaccuccaagaucggcuucuucgagaccauggcgugggccgugcccaaggacaacuacaagaaugccaccaacccgcagacggucgaggugcccuacaucugcaccgagggcgaggaccagaucaccguguggggguuccacagcgacaauaagacccagaugaagaaccuguacggcgacuccaacccccagaaguucacgucguccgccaacggggucaccacccauuacgugagccagaucggcgacuuccccgaccagaccgaggacggcgggcugccgcaguccggccgcaucguggucgacuacauggugcagaagcccgggaagacgggcaccaucguguaucagcgcgggguccuccugccccagaagguguggugcgccagcggccgguccaaggugaucaagggcagccugccccucaucggggaggcggacugccugcacgagaaguacggcgggcugaauaagucgaagccguacuacaccggcgagcacgccaaggccaucgggaacugccccaucugggucaagacgccccucaagcuggccaacggcaccaaguaccggcccccggccaagcugcucaaggagcgcggcuuuuucggggcgaucgccggcuuccuggagggcgggugggaggggaugaucgccggcuggcacggcuacaccucccacggggcccacggcguggccgucgcggccgaccugaaguccacccaggaggccaucaauaagaucaccaagaaccucaacucccugagcgagcuggaggugaagaaccuccagcggcuguccggggccauggacgagcugcacaacgagauccucgagcuggacgagaagguggaugaccugcgcgccgacacgaucagcucccagaucgagcucgcgguccugcugagcaacgagggcaucaucaacuccgaggacgagcaucuccuggcccuggagcggaagcucaagaagaugcugggccccucggccguggacaucgggaacggcugcuucgagaccaagcacaagugcaaccagaccugucuggaccgcaucgccgcggggaccuucaacgccggcgaguucucccuccccaccuucgacagccugaauaucacggccgccucccugaacgacgacgggcucgacaaccacaccauccugcuguacuacaguaccgccgcguccagccuggccgugacccucaugcuggccaucuucaucgucuacauggugucccgggacaacgugagcugcuccaucugccuguga

SEQ ID NO: 15883 - RNA, 1755 nt, Artificial Sequence
  derived and/or modified CDS sequence (AUadapt) from InfluenzaB__AHL94460__HA
augaaggccaucaucgugcugcucauggucgugaccaguaacgccgaccgcaucugcaccggcaucacguccagcaacagcccccacguggucaagaccgcgacccagggggaggugaaugugaccggcgccaucccgcugacgaccacccccaccaagagcuacuucgccaaccugaaggggacgcggacccgcggcaagcucugccccgacugccugaacuguaccgaccuggacgucgcccucgggcggcccaugugcgugggcaccacgccguccgccaaggcgucgauccugcacgaggugcgccccgucaccuccggcugcuuccccaucaugcaugaccggaccaagauccgccagcugcccaaccuccugcggggguacgagaacauccgccugagcacccagaacgugaucgacgccgagaaggccccgggcgggcccuaccggcucggcacguccgggaguugccccaacgccaccuccaagaucggcuucuucgcgaccauggccugggccgugcccaaggacaacuacaagaaugccaccaacccgcagacggucgaggugcccuacaucugcaccgaggaggaggaccagaucaccguguggggcuuccacagcgacaauaagacccagaugaagaaccuguacggggacuccaacccccagaaguucacgucguccgccaacggcgucaccacccauuacgugagccagaucggggacuuccccgaccagaccgaggacggcggccugccgcaguccgggcgcaucguggucgacuacauggugcagaagcccggcaagacggggaccaucguguaucagcggggcguccuccugccccagaagguguggugcgcgagcgggcgcuccaaggugaucaagggcagccugccccucaucggcgaggccgacugccugcacgagaaguacgggggccugaauaagucgaagccguacuacaccggggagcacgccaaggccaucggcaacugccccaucugggucaagacgccccucaagcuggccaacgggaccaaguaccggcccccggcgaagcugcucaaggagcgcggcuuuuucggcgccaucgccggguuccuggagggcgggugggagggcaugaucgccggguggcacggcuacaccucccacggcgcccacgggguggcggucgccgccgaccugaaguccacccaggaggccaucaauaagaucaccaagaaccucaacucccugagcgagcuggaggugaagaaccuccagcggcuguccggcgccauggacgagcugcacaacgagauccucgagcuggacgagaagguggaugaccugcgcgcggacacgaucagcucccagaucgagcucgccguccugcugagcaacgaggggaucaucaacuccgaggacgagcaucuccuggcccuggagcggaagcucaagaagaugcugggccccucggccguggacaucggcaacgggugcuucgagaccaagcacaagugcaaccagaccugucuggaccgcaucgcggccggcaccuucaacgccggggaguucucccuccccaccuucgacagccugaauaucacggccgccucccugaacgacgacggccucgacaaccacaccauccugcuguacuacaguaccgcggccuccagccuggccgugacccucaugcuggccaucuucaucgucuacauggugucccgggacaacgugagcugcuccaucugccuguga

SEQ ID NO: 15884 - RNA, 1755 nt, Artificial Sequence
  derived and/or modified CDS sequence (AUadapt) from InfluenzaB__AHL94471__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuauuucgccaaccugaaggggacgcggacccgcggcaagcucugccccgacugccugaacugcaccgaccuggauguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguaugagaagauccgccugagcacccagaacgugaucgacgcggagaaggccccgggcgggcccuaccggcucggcacguccgggucgugccccaacgccaccuccaagaucggcuucuuugccaccauggcgugggccguccccaaggacaacuacaagaacgccaccaacccgcugacgguggaggugcccuacaucugcaccgagggcgaggaccagaucaccgucuggggguuucacagcgacaacaagacccagaugaagucccuguacggcgacagcaacccccagaaguuuacguccagcgccaacggggugaccacccacuacgugucccagaucggcgacuuccccgaccagaccgaggacggcgggcucccgcagaguggccgcaucgucguggacuacaugaugcagaagcccgggaagacgggcaccaucguguaccagcgcgggguccugcugccccagaagguguggugcgccuccggccggagcaaggugaucaagggcucgcucccccugaucggggaggcggacugccugcaugaggaguacggcgggcucaacaaguccaagccguacuacaccggcaagcacgccaaggccaucgggaacugccccaucugggucaagacgccccugaagcuggccaacggcaccaaguaucggcccccggccaagcuccugaaggagcgcggcuucuucggggcgaucgccggcuuccuggagggcgggugggaggggaugaucgccggcuggcacggcuacaccagccacggggcccacggcguggccgucgcggccgaucucaaguccacccaggaggccaucaacaagaucaccaagaaccugaacagccuguccgagcucgaggugaagaaccugcagcggcugagcggggccauggacgagcuccacaaugagauccuggagcuggacgagaagguggacgaccuccgcgccgacacgaucuccagccagaucgagcuggcgguccugcucuccaacgagggcaucaucaacucggaggaugagcaccuccuggcccuggagcggaagcugaagaagaugcugggccccuccgccguggacaucgggaacggcugcuucgagaccaagcacaagugcaaccagaccugucucgaccgcaucgccgcggggaccuucaacgccggcgaguucagccugcccaccuucgacucccugaacaucacggccgccagucucaacgacgacgggcuggacaaccacaccauccugcuguacuacuccaccgccgcgaguucccucgccgugacccugaugcuggccaucuucaucgucuacauggugagccgggacaacaucuccugcagcaucugccucuga

SEQ ID NO: 15885 - RNA, 1758 nt, Artificial Sequence
  derived and/or modified CDS sequence (AUadapt) from InfluenzaB__AHL94482__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugucccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaucuccugcggggguacgagcacauccgccugucgacccacaacgugaucaacgccgagaacgcgccgggcgggcccuacaagaucggcaccuccgggagcugccccaacgucacgaacggcaauggcuucuucaccaccauggccugggccgugcccaagaacgacaagaacaagaccgccacgaacccgcucaccaucgaggugcccuacaucugcaccgagggggaggaccagaucaccgucuggggcuuccacuccgacaaugagacgcagauggcgaagcuguacggggacucgaagccccagaaguucaccuccucggccaacggcgugaccacccacuacgugucccagaucggcggguuccccaaccagacggaggacggcgggcugccgcagagcggccggaucgucguggauuacauggugcagaaguccgggaagaccggcaccaucaccuaccagcgcggcauccuccugccccagaaggucuggugcgccucggggcgguccaaggugaucaagggcagccugccccucaucggggaggccgacugccugcacgagaaguacggcgggcugaacaagucgaagcccuacuauacgggcgagcacgccaaggcgaucggcaacugcccgaucugggugaagacgccccucaagcuggccaacgggaccaaguaccgcccgcccgccaagcugcucaaggagcggggcuucuucggggccaucgccggcuuccuggagggcgggugggagggcaugaucgcgggguggcacggcuacaccucccacggggcccacggcgucgccguggccgccgaucugaaguccacccaggaggcgaucaacaagaucaccaagaaccucaacucccugagcgagcuggaggucaagaaccuccagcgccuguccggcgccauggacgagcugcacaacgagauccucgagcuggacgagaagguggacgaccugcgggccgacaccaucaguucccagaucgagcucgccgugcugcugucgaacgaggggaucaucaacuccgaggacgagcaccuccuggcccuggagcgcaagcucaagaagaugcugggccccagcgcggucgagaucgggaacggcugcuucgagaccaagcacaagugcaaccagaccugucuggaccggaucgccgccgggacguucgacgccggcgaguucucccuccccaccuucgacucgcugaacaucaccgcggccucccugaacgacgacggccucgacaaucacaccauccugcuguacuacagcacggccgccuccucgcuggccgugacccucaugaucgcgaucuucguggucuacauggugucccgcgacaacgugagcugcuccaucugccuguga

SEQ ID NO: 15886 - RNA, 1755 nt, Artificial Sequence; identical to SEQ ID NO: 14093
  derived and/or modified CDS sequence (AUadapt) from InfluenzaB__AHL94493__HA

SEQ ID NO: 15887 - RNA, 1755 nt, Artificial Sequence; identical to SEQ ID NO: 15871
  derived and/or modified CDS sequence (AUadapt) from InfluenzaB__AHL94504__HA

SEQ ID NO: 15888 - RNA, 1758 nt, Artificial Sequence
  derived and/or modified CDS sequence (AUadapt) from InfluenzaB__AHL94515__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugucccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaucuccugcggggguacgagcacauccgccugucgaccuacaacgugaucaacgccgaggacgcgccgggcgggcccuacaagaucggcaccuccgggagcugccccaacgucacgaacggcaauggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaaugagacccagauggagaagcuguacggggacucgaagccccagaaguucacguccagcgccaacggcgugaccacccacuacgugucccagaucggcggguuccccaaccagaccgaggacggcgggcugccgcagucgggccggaucgucguggauuacauggugcagaaguccgggaagacgggcaccaucaccuaccagcgcggcauccuccugccccagaaggucuggugcgccagcgggcgguccaaggugaucaagggcucgcugccccucaucggggaggccgacugccugcacgagaaguacggcgggcugaacaagagcaagcccuacuauaccggcgagcacgccaaggcgaucggcaacugcccgaucugggugaagacgccccucaagcuggccaacgggaccaaguaccgcccgcccgccaagcugcucaaggagcggggcuucuucggggccaucgccggcuuccuggagggcgggugggagggcaugaucgcgggguggcacggcuacaccucccacggggcccacggcgucgccguggccgccgaucugaaguccacccaggaggcgaucaacaagaucacgaagaaccucaacucccugucggagcuggaggucaagaaccuccagcgccuguccggcgccauggacgagcugcacaacgagauccucgagcuggacgagaagguggacgaccugcgggccgacaccaucaguucccagaucgagcucgccgugcugcugucgaacgaggggaucaucaacuccgaggacgagcaccuccuggcccuggagcgcaagcucaagaagaugcugggccccagcgcggucgagaucgggaacggcugcuucgagaccaagcacaagugcaaccagaccugucuggaccggaucgccgccgggaccuucgacgccggcgaguucucccuccccacguucgacucgcugaacaucaccgcggccucccugaacgacgacggccucgacaaucacaccauccugcuguacuacagcaccgccgccuccucgcuggccgugacgcucaugaucgcgaucuucguggucuacauggugucccgcgacaacgugagcugcuccaucugccuguga

SEQ ID NO: 15889 - RNA, 1755 nt, Artificial Sequence; identical to SEQ ID NO: 15871
  derived and/or modified CDS sequence (AUadapt) from InfluenzaB__AHL94526__HA

SEQ ID NO: 15890 - RNA, 1758 nt, Artificial Sequence
  derived and/or modified CDS sequence (AUadapt) from InfluenzaB__AHL94537__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugucccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaucuccugcggggguacgagcacauccgccugucgacccacaacgugaucaacgccgagaacgcgccgggcgggcccuacaagaucggcaccuccgggagcugccccaacgucacgaacggcaauggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaaugagacccagauggccaagcuguacggggacucgaacccccagaaguucacguccucggccaacggcgugaccacccacuacaucucccagaucggcggguuccccaaccagaccgaggacggcgggcugccgcagaguggccggaucguggucgacuacauggugcagaaguccgggaagacgggcaccaucaccuaccagcgcggcauccuccugccccagaagguguggugcgccucggggcgguccaaggucaucaagggcagccugccccucaucggggaggccgacugccugcacgagaaguacggcgggcugaacaagucgaagcccuauuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccauggcguggccgucgccgcggaccugaaguccacccaggaggccaucaacaagaucacgaagaaccucaacucccugagcgagcuggaggugaagaaccuccagcgccuguccggcgccauggacgagcugcacaacgagauccucgagcuggacgagaaggucgacgaccugcgggccgauaccaucucgucccagaucgagcucgccgugcugcugucgaacgaggggaucaucaacuccgaggacgagcaccuccuggcgcuggagcgcaagcucaagaagaugcugggccccagcgccguggagaucgggaacggcugcuucgagaccaagcacaagugcaaucagaccugccuggaccggaucgccgccgggaccuucgacgcgggcgaguucucccuccccacguucgacucgcugaacaucaccgccgccucccugaacgacgacggccucgauaaccacaccauccugcuguacuacagcaccgccgccuccucgcuggcggucacgcucaugaucgccaucuucgugguguacauggucucccgcgacaacgugagcugcuccaucugccuguga

SEQ ID NO: 15891 - RNA, 1755 nt, Artificial Sequence
  derived and/or modified CDS sequence (AUadapt) from InfluenzaB__AHL94548__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaucaaguccuacuucgccaaccugaaggggaccaagacgcggggcaagcucugccccgacugccugaacuguaccgaccuggacguggcccucgggcgccccaugugcgugggcaccaccccguccgccaaggccagcauccugcacgagguccggcccgugacguccggcugcuuccccaucaugcaugaccgcaccaagauccggcagcuggcgaaccuccugcgcggguacgagaacauccggcugagcacccagaacgugaucgacgccgagcgcgcccccggcgggccguaucggcucggcaccuccgggagcugccccaacgccacguccaagagcggcuucuucgcgaccauggccugggccguccccaaggacaauaacaagaacgccaccaacccccugaccguggaggugccguacaucugcgccgagggcgaggaccagaucacggucuggggguuccauuccgacaacaagacccagaugaagaaccuguacggcgacucgaacccccagaaguuuaccuccagcgcgaacggggugaccacgcacuacgugucccagaucggcggcuuccccgaccagaccgaggacgggggccucccccagagugggcgcaucgucguggacuacaugaugcagaagccgggcaagaccgggaccaucguguaccagcggggcguccugcugccccagaagguguggugcgccuccggccgcagcaaggugaucaaggggagccucccccugaucggcgaggccgacugucugcacgagaaguacgggggccucaacaaguccaagcccuacuacacgggggagcacgccaaggccaucggcaacuguccgaucugggucaagacgccccugaagcuggcgaacggcaccaaguaccggccgcccgccaagcuccugaaggagcgcggguucuucggcgccaucgccggguuccuggagggcgggugggagggcaugaucgccggcuggcacggguacaccagucacggcgcgcacgggguggccgucgccgccgaccucaaguccacccaggaggccaucaacaagaucaccaagaaccugaacagccuguccgagcucgaggugaagaaucugcagcggcugucgggcgcgauggacgagcuccacaacgagauccuggagcuggacgagaagguggacgaccuccgcgccgauaccaucuccagccagaucgagcuggccguccugcucuccaacgagggcaucaucaacagcgaggacgagcaccuccuggcccuggagcggaagcugaagaagaugcuggggcccuccgcgguggacaucggcaaugggugcuucgagaccaagcacaagugcaaccagacgugccucgaccgcaucgccgccggcaccuuuaacgccggggaguucagccugcccaccuucgacucccugaacaucaccgccgcgagccucaaugacgacggccuggacaaccacaccauccugcuguacuacuccacggccgccaguucccucgccgugacccugaugcuggccaucuucaucgucuacauggugagccgggacaacguguccugcagcaucugccucuga

SEQ ID NO: 15892 - RNA, 1755 nt, Artificial Sequence; identical to SEQ ID NO: 14093
  derived and/or modified CDS sequence (AUadapt) from InfluenzaB__AHL94559__HA

SEQ ID NO: 15893 - RNA, 1755 nt, Artificial Sequence; identical to SEQ ID NO: 14116
  derived and/or modified CDS sequence (AUadapt) from InfluenzaB__AHL94570__HA

SEQ ID NO: 15894 - RNA, 1755 nt, Artificial Sequence; identical to SEQ ID NO: 14116
  derived and/or modified CDS sequence (AUadapt) from InfluenzaB__AHL94581__HA

SEQ ID NO: 15895 - RNA, 1755 nt, Artificial Sequence; identical to SEQ ID NO: 14116
  derived and/or modified CDS sequence (AUadapt) from InfluenzaB__AHL94592__HA

SEQ ID NO: 15896 - RNA, 1758 nt, Artificial Sequence
  derived and/or modified CDS sequence (AUadapt) from InfluenzaB__AHL94603__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugucccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaucuccugcggggguacgagaacauccgccugucgacccacaacgugaucaacgccgagaacgcgccgggcgggcccuacaagaucggcaccuccgggagcugccccaacgucacgaacggcaauggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaaugagacccagauggccaagcuguacggggacucgaagccccagaaguucacguccucggccaacggcgugaccacccacuacgugucccagaucggcggguuccccaaccagaccgaggacggcgggcugccgcagagcggccggaucgucguggauuacauggugcagaaguccgggaagacgggcaccaucaccuaccagcgcggcauccuccugccccagaaggucuggugcgccucggggcgguccaaggugaucaagggcagccugccccucaucggggaggccgacugccugcacgagaaguacggcgggcugaacaagucgaagcccuacuauaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaucugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucaguucccagaucgagcucgccgugcugcugucgaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugucuggaccggaucgccgccgggaccuucgacgcgggcgaguucucccuccccacguucgacucgcugaacaucaccgccgccucccugaacgacgacggccucgacaaucacaccauccugcuguacuacagcaccgccgccuccucgcuggcggugacgcucaugaucgccaucuucguggucuacauggugucccgcgacaacgugagcugcuccaucugccuguga

SEQ ID NO: 15897 - RNA, 1758 nt, Artificial Sequence
  derived and/or modified CDS sequence (AUadapt) from InfluenzaB__AHL94614__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugucccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaucuccugcggggguacgagcacauccgccugucgacccacaacgugaucaacgccgagaacgcgccgggcgggcccuacaagaucggcaccuccgggagcugccccaacgucacgaacggcaauggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaaugagacccagauggccaagcuguacggggacucgaagccccagaaguucacguccagcgccaacggcgugaccacccacuacgugucccagaucggcggguuccccaaccagaccgaggacggcgggcugccgcagucgggccggaucgucguggauuacauggugcagaaguccgggaagacgggcaccaucaccuaccagcgcggcauccuccugccccagaaggucuggugcgccagcgggcgguccaaggugaucaagggcucgcugccccucaucggggaggccgacugccugcacgagaaguacggcgggcugaacaagagcaagcccuacuauaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaucucccacggggcccacggcgucgccguggccgcggaucugaaguccacccaggaggccaucaacaagaucaccaagaaccucaacucccugucggagcuggaggucaagaaccuccagcgccuguccggcgccauggacgagcugcacaacgagauccucgagcuggacgagaagguggacgaccugcgggccgacacgaucaguucccagaucgagcucgccgugcugcugucgaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugucuggaccggaucgccgccgggaccuucgacgcgggcgaguucucccuccccaccuucgacucgcugaacaucacggccgccucccugaacgacgacggccucgacaaucacaccauccugcuguacuacagcaccgccgccuccucgcuggcggugacccucaugaucgccaucuucguggucuacauggugucccgcgacaacgugagcugcuccaucugccuguga

SEQ ID NO: 15898 - RNA, 1755 nt, Artificial Sequence; identical to SEQ ID NO: 15871
  derived and/or modified CDS sequence (AUadapt) from InfluenzaB__AHL94624__HA

SEQ ID NO: 15899 - RNA, 1758 nt, Artificial Sequence
  derived and/or modified CDS sequence (AUadapt) from InfluenzaB__AHL94646__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucccacuucgccaaccugaaggggacggagacccggggcaagcucugccccaagugucugaacugcaccgaccuggacguggcccucgggcgccccaagugcaccggcaagaucccguccgcccgggugucgauccugcacgagguccgccccgugacguccggcugcuuccccaucaugcacgaccggaccaagauccgccagcugcccaaccuccugcggggguaugagcacauccgccugagcacccacaacgugaucaacgccgagaacgcgccgggcgggcccuacaagaucggcaccuccgggucgugccucaacgucacgaacggcaacggcuuuuucgccaccauggccugggccgugcccaagaacgacaagaacaagaccgcgaccaacccccugacgaucgaggugccguacaucugcaccgagggggaggaccagaucaccgucuggggcuuccacuccgacaacgagacccagauggccaagcuguauggggacagcaagccccagaaguucacguccucggccaacggcgugaccacccacuacgugucccagaucggcggguuccccaaccagaccgaggacggcgggcucccccagagcggccggaucgucguggacuauauggugcagaaguccgggaagacgggcaccaucaccuaccagcgcggcauccugcugccgcagaaggucuggugcgccucggggcgguccaaggugaucaagggcagccucccccugaucggggaggccgacugccugcacgagaaguacggcgggcucaacaagucgaagcccuacuacaccggcgagcaugcgaaggccaucggcaacugccccaucugggugaagacgccgcugaagcuggccaacgggaccaaguaccgcccgcccgccaagcuccugaaggagcggggcuucuucggggccaucgcgggcuuccuggagggcgggugggagggcaugaucgccggguggcacggcuacaccucccacggggcccacggcgucgccguggccgcggaccucaagaguacccaggaggccaucaacaagaucacgaagaaccugaacucccugucggagcucgaggucaagaaccugcagcgccuguccggcgccauggacgagcuccacaacgagauccuggagcuggacgagaagguggacgaccuccgggccgacaccaucaguucccagaucgagcuggccgugcugcucucgaacgaggggaucaucaacuccgaggacgagcaccuccuggcgcuggagcgcaagcugaagaagaugcugggccccagcgccgucgagaucgggaacggcugcuucgagaccaagcacaagugcaaccagaccugucucgaccggaucgccgccgggaccuucgacgcgggcgaguucucccugcccacguucgacucgcugaacaucaccgccgccucccucaacgacgacggccuggacaaucacaccauccugcuguacuacagcaccgccgccuccucgcucgcggugacgcugaugaucgccaucuucguggucuacauggugucccgcgacaacgugagcugcuccaucugccuguga

SEQ ID NO: 15900 - RNA, 1758 nt, Artificial Sequence
  derived and/or modified CDS sequence (AUadapt) from InfluenzaB__AHL94657__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagucacuucgccaaccugaaggggacggagacccggggcaagcucugccccaagugccccaacugcaccgaccuggacguggcccuggggcgcccgaaguguaccggcaagauccccuccgcccgggugucgauccuccacgagguccgccccgugacguccggcugcuuccccaucaugcacgaccggaccaagauccgccagcugccgaaccugcuccggggguacgagcauauccgccugagcacccacaacgugaucaacgccgaguccgcgcccggcgggcccuacaagaucggcaccagcggguccugccccaacgucacgaacggcaauggcuucuucgccaccauggccugggccgugccgaagaacgacaagaacaagaccgcgaccgacccccugacgaucgaggugcccuacaucugcaccgagggggaggaucagaucaccgucuggggcuuccacucggacaacgagacccagauggccaagcucuacggggacuccaagccccagaaguucacgagcuccgccaauggcgugaccacccacuacgugucgcagaucggcggguucccgaaccagaccgaggacggcgggcugccccaguccggccggaucgucguggacuacauggugcagaaguccgggaagacgggcaccaucaccuaucagcgcggcauccugcucccccagaaggucuggugcgccuccgggcggagcaaggugaucaagggcagccugccccugaucggggaggccgacugccuccacgagaaguacggcgggcugaacaaguccaagccguacuauaccggcgagcacgcgaaggccaucggcaacugccccaucugggugaagacgccccugaagcucgccaacgggaccaaguaccggcccccggccaagcugcugaaggagcgcggcuucuucggggccaucgcgggcuuccucgagggcgggugggagggcaugaucgccggguggcauggcuacaccucgcacggggcccacggcgucgccguggccgcggaccugaaguccacccaggaggccaucaacaagaucacgaagaaccugaacagccucuccgagcuggaggucaagaaucugcagcgccucucgggcgccauggacgagcugcacaacgagauccuggagcucgacgagaagguggacgaccugcgggccgacaccaucuccagucagaucgagcuggccgugcuccuguccaacgaggggaucaucaacagcgaggacgagcaccuccuggcgcuggagcgcaagcugaagaagaugcucggccccuccgccgucgagaucgggaacggcugcuucgagaccaagcacaaguguaaccagaccugccuggaccggaucgccgccgggaccuucgacgcgggcgaguucucgcugcccacguucgauucccucaacaucaccgccgccagccugaacgacgacggccuggacaaccacaccauccuccuguacuauuccaccgccgccucgucccuggcggugacgcugaugaucgccaucuucguggucuacauggugagccgcgacaacguguccugcagcaucugccucuga

SEQ ID NO: 15901 - RNA, 1755 nt, Artificial Sequence; identical to SEQ ID NO: 15871
  derived and/or modified CDS sequence (AUadapt) from InfluenzaB__AHL94668__HA

SEQ ID NO: 15902 - RNA, 1755 nt, Artificial Sequence; identical to SEQ ID NO: 15871
  derived and/or modified CDS sequence (AUadapt) from InfluenzaB__AHL94679__HA

SEQ ID NO: 15903 - RNA, 1758 nt, Artificial Sequence; identical to SEQ ID NO: 15896
  derived and/or modified CDS sequence (AUadapt) from InfluenzaB__AHL94690__HA

SEQ ID NO: 15904 - RNA, 1758 nt, Artificial Sequence
  derived and/or modified CDS sequence (AUadapt) from InfluenzaB__AHL94701__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccugaccaagucgcacuucgccaaccucaaggggacggagacccggggcaagcugugccccaagugucugaacugcaccgaccucgacguggcccuggggcgccccaagugcaccggcaagauccccuccgcccgggugagcauccugcacgagguccgcccggugacguccggcugcuuccccaucaugcacgaccggaccaagauccgccagcuccccaaccugcugcggggguacgagcauauccgccucucgacccacaacgugaucaacgccgagaacgcgcccggcgggccguacaagaucggcaccuccgggagcugccugaacgucacgaacggcaacggcuucuucgccaccauggccugggccgugcccaagaaugacaagaacaagaccgcgaccaacccccugacgaucgaggugcccuacaucugcaccgagggggaggaccagaucaccgucuggggcuuccacuccgacaacgagacccagauggccaagcucuacggggacucgaagccgcagaaguucacguccagugccaacggcgugaccacccacuacgugucccagaucggcggguuccccaaccagaccgaggacggcgggcugccccagucgggccggaucgucguggacuacauggugcagaaguccgggaagacgggcaccaucaccuaccagcgcggcauccugcucccccagaaggucuggugcgccagcgggcgguccaaggugaucaagggcucgcugccgcugaucggggaggccgauugccuccacgagaaguacggcgggcugaacaagagcaagcccuacuacaccggcgagcacgcgaaggccaucggcaacugccccaucugggugaagacgccccugaagcucgccaacgggaccaaguaccgcccgcccgccaagcugcugaaggagcggggcuucuuuggggccaucgcgggcuuccucgagggcgggugggagggcaugaucgccggguggcacggcuacaccucccacggggcccacggcgucgccguggccgcggaccugaaguccacccaggaggccaucaacaagaucacgaagaaccugaacucccucucggagcuggaggucaagaaccugcagcgccucuccggcgccauggacgagcugcacaacgagauccuggagcucgaugagaagguggacgaccugcgggccgacaccaucagcucccagaucgagcuggccgugcuccugucgaacgaggggaucaucaacuccgaggacgagcaccuccuggcgcuggagcgcaagcugaagaagaugcucggccccagcgccgucgagaucgggaacggcugcuucgagaccaagcauaagugcaaccagaccugccuggaccggaucgccgccgggaccuucgacgcgggcgaguucucccugcccacguucgacucgcucaacaucaccgccgccucccugaacgacgauggccuggacaaccacaccauccugcucuacuacagcaccgccgccuccucgcuggcggugacgcugaugaucgccaucuucguggucuacauggugucccgcgacaacgugagcugcuccaucugccucuga

SEQ ID NO: 15905 - RNA, 1755 nt, Artificial Sequence; identical to SEQ ID NO: 14093
  derived and/or modified CDS sequence (AUadapt) from InfluenzaB__AHL94712__HA

SEQ ID NO: 15906 - RNA, 1758 nt, Artificial Sequence; identical to SEQ ID NO: 15900
  derived and/or modified CDS sequence (AUadapt) from InfluenzaB__AHL94723__HA

SEQ ID NO: 15907 - RNA, 1755 nt, Artificial Sequence; identical to SEQ ID NO: 14093
  derived and/or modified CDS sequence (AUadapt) from InfluenzaB__AHL94734__HA

SEQ ID NO: 15908 - RNA, 1758 nt, Artificial Sequence
  derived and/or modified CDS sequence (AUadapt) from InfluenzaB__AHL94745__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagucccacuucgccaaucugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcaugaccggaccaagauccgccagcugcccaaccuccugcggggguacgagcacauccgccugucgacccacaacgugaucaacgccgagaacgcgccgggcgggcccuacaagaucggcaccuccgggagcugucucaacgucacgaacggcaacggcuucuucgccaccauggccugggccgugcccaagaacgacaagaacaagaccgcgaccaacccccugacgaucgaggugccguacaucugcaccgagggggaggaucagaucaccgucuggggcuuccacuccgacaacgagacccagauggccaagcuguacggggacucgaagccccagaaguucacguccagcgccaacggcgugaccacccacuaugugucccagaucggcggguuccccaaccagaccgaggacggcgggcucccccagucgggccggaucgucguggacuacauggugcagaaguccgggaagacgggcaccaucaccuaccagcgcggcauccugcugccgcagaaggucuggugcgccagcgggcgguccaaggugaucaagggcucgcucccccugaucggggaggccgacugucugcacgagaaguacggcgggcucaacaagagcaagcccuacuacaccggcgagcacgcgaaggccaucggcaacugccccaucugggugaagacgccgcugaagcuggccaacgggaccaaguaucgcccgcccgccaagcuccugaaggagcggggcuucuucggggccaucgcgggcuuccuggagggcgggugggagggcaugaucgccggguggcacggcuacaccucccacggggcccacggcgucgccguggccgcggaccucaagucgacccaggaggccaucaacaagaucacgaagaaccugaauucccugagcgagcucgaggucaagaaccugcagcgccuguccggcgccauggacgagcuccacaacgagauccuggagcuggacgagaagguggacgaccuccgggccgacaccaucucgucccagaucgagcuggccgugcugcucagcaaugaggggaucaucaacuccgaggacgagcaccuccuggcgcuggagcgcaagcugaagaagaugcugggccccucggccgucgagaucgggaacggcugcuucgagaccaagcacaagugcaaccagaccugccucgaucggaucgccgccgggaccuucgacgcgggcgaguucucccugcccacguucgacagccugaacaucaccgccgccucccucaacggcgacgggcuggacaaccauaccauccugcuguacuacucgaccgccgccuccagccucgcggugacgcugaugaucgccaucuucguggucuacauggugucccgcgacaacgugagcugcuccaucugccuguga

SEQ ID NO: 15909 - RNA, 1755 nt, Artificial Sequence; identical to SEQ ID NO: 14116
  derived and/or modified CDS sequence (AUadapt) from InfluenzaB__AHL94756__HA

SEQ ID NO: 15910 - RNA, 1758 nt, Artificial Sequence; identical to SEQ ID NO: 15899
  derived and/or modified CDS sequence (AUadapt) from InfluenzaB__AHL94766__HA

SEQ ID NO: 15911 - RNA, 1755 nt, Artificial Sequence
  derived and/or modified CDS sequence (AUadapt) from InfluenzaB__AHL94777__HA
augaaggccaucaucgugcugcucauggucgugaccaguaacgccgaccgcaucugcaccggcaucacguccagcaacagcccccacguggucaagaccgcgacccagggggaggugaaugugaccggcgccaucccgcugacgaccacccccaccaagagcuacuucgccaaccugaaggggacgcggacccgcggcaagcucugccccgacugcuuuaacugcaccgaccuggacgucgcccuggggcggcccaugugcgugggcaccacgccguccgccaaggcgagcauccuccacgaggugcgccccgucaccuccggcuguuuccccaucaugcacgaccggaccaagauccgccagcugcccaaccugcuccggggguacgagaacauccgccugucgacccagaaugccaucgacgccgagaaggccccgggcgggcccuaccggcugggcacguccgggagcugccccaacgcgaccuccaagaucggcuucuucgccaccauggccugggccgugcccaaggauaacuacaagaacgccaccaacccgcagacgguggagguccccuacaucugcaccgagggcgaggaccagaucaccguguggggguuucacagcgacaacaagacccagaugaagaaccucuacggcgacuccaauccccagaaguucacgagcuccgcgaacggggugaccacccacuacgucagccagaucggcgacuuucccgaccagaccgaggacggcgggcugccgcaguccggccgcaucgugguggacuacaugguccagaagcccgggaagacgggcaccaucguguaccagcgcggggugcugcucccccagaaggucuggugcgccucgggccgguccaaggugaucaagggcagccugccccugaucggggaggccgauugccuccacgagaaguacggcgggcugaacaagagcaagccguacuacaccggcgagcaugccaaggccaucgggaacugccccaucugggugaagacgccccugaagcucgcgaacggcaccaaguaccggcccccggccaagcugcugaaggagcgcggcuucuucggggccaucgccggcuuccucgagggcgggugggaggggaugaucgccggcuggcauggcuacaccucccacggggcgcacggcgucgccguggccgccgaccugaaguccacccaggaggccaucaacaagaucaccaagaaccugaacucccucagugagcuggaggucaagaaccugcagcggcucuccggggcgauggacgagcugcacaacgagauccuggagcucgacgagaagguggacgaccugcgcgccgauacgaucagcucccagaucgagcuggccgugcuccugucgaacgagggcaucaucaacuccgaggacgagcaccuccuggcccuggagcggaagcugaagaagaugcucggccccagcgcggucgauaucgggaacggcugcuucgagaccaagcacaagugcaaccagaccugccuggaucgcaucgccgccgggaccuucaacgccggcgaguucucccugcccaccuucgacagccucaacaucacggccgcgucccugaaugacgacgggcuggacaaccacaccauccuccuguacuacaguaccgccgccuccagccuggccgugacccugaugcucgccaucuucaucguguacauggucucccgggacaacgugagcugcuccaucugccuguga

SEQ ID NO: 15912 - RNA, 1758 nt, Artificial Sequence; identical to SEQ ID NO: 15896
  derived and/or modified CDS sequence (AUadapt) from InfluenzaB__AHL94797__HA

SEQ ID NO: 15913 - RNA, 1755 nt, Artificial Sequence
  derived and/or modified CDS sequence (AUadapt) from InfluenzaB__AHL94808__HA
augaaggccaucaucgugcugcucauggucgugaccaguaacgccgaccgcaucugcaccggcaucacguccagcaacagcccccacguggucaagaccgcgacccagggggaggugaaugugaccggcgccaucccgcugacgaccacccccaccaagagcuacuucgccaaccugaaggggauccggacgcgcggcaagcucugccccgacugccugaacuguaccgaccuggacgucgcccucgggcggcccaugugcgugggcaccaccccguccgccaaggcgagcauccugcacgaggugcgccccgucacguccggcugcuuccccaucaugcaugaccggaccaagauccgccagcugcccaaccuccugcggggguacgagaacauccgccugucgacccagaacgugaucgacgccgagaaggccccgggcgggcccuaccggcucggcaccuccgggaguugccccaacgccacguccaagaucggcuucuucgcgaccauggccugggccgugcccaaggacaacuacaagaaugccaccaacccgcagaccgucgaggugcccuacaucugcacggagggcgaggaccagaucaccguguggggguuccacagcgacaauaagacccagaugaagaaccuguacggcgacuccaacccccagaaguucaccagcuccgccaacggggucacgacccauuacgugagccagaucggcgacuuccccgaccagaccgaggacggcgggcugccgcaguccggccgcaucguggucgacuacauggugcagaagcccgggaagaccggcacgaucguguaucagcgcgggguccuccugccccagaagguguggugcgcgucgggccgguccaaggugaucaagggcagccugccccucaucggggaggccgacugccugcacgagaaguacggcgggcugaauaagagcaagccguacuacaccggcgagcacgccaaggccaucgggaacugccccaucugggucaagacgccccucaagcuggccaacggcaccaaguaccggcccccggcgaagcugcucaaggagcgcggcuuuuucggggccaucgccggcuuccuggagggcgggugggaggggaugaucgccggcuggcacggcuacaccucccacggggcccacggcguggcggucgccgccgaccugaaguccacccaggaggccaucaauaagaucaccaagaaccucaacucccugagcgagcuggaggugaagaaccuccagcggcuguccggggccauggacgagcugcacaacgagauccucgagcuggacgagaagguggaugaccugcgcgcggacaccaucagcucccagaucgagcucgccguccugcugucgaacgagggcaucaucaacuccgaggacgagcaucuccuggcccuggagcggaagcucaagaagaugcugggccccagcgccguggacaucgggaacggcugcuucgagacgaagcacaagugcaaccagaccugucuggaccgcaucgcggccgggaccuucaacgccggcgaguucucccuccccaccuucgacagccugaauaucaccgccgccucccugaacgacgacgggcucgacaaccacacgauccugcuguacuacaguaccgcggccuccagccuggccgugacccucaugcuggccaucuucaucgucuacauggugucccgggacaacgugagcugcuccaucugccuguga

SEQ ID NO: 15914 - RNA, 1755 nt, Artificial Sequence
  derived and/or modified CDS sequence (AUadapt) from InfluenzaB__AHL94817__HA
augaaggccaucaucgugcugcucauggucgugaccaguaacgccgaccgcaucugcaccggcaucacguccagcaacagcccccacguggucaagaccgcgacccagggggaggugaaugugaccggcgccaucccgcugacgaccacccccaccaagagcuacuucgccaaccugaaggggacgcggacccgcggcaagcucugccccgacugccugaacuguaccgaccuggacgucgcccucgggcggcccaugugcgugggcaccacgccguccgccaaggcgucgauccugcacgaggugcgccccgucaccuccggcugcuuccccaucaugcaugaccggaccaagauccgccagcugcccaaccuccugcggggguacgagaacauccgccugagcacccagaacgugaucgacgccgagaaggccccgggcgggcccuaccggcucggcacguccgggaguugccccaacgccaccuccaagaucggcuucuucgcgaccauggccugggccgugcccaaggacaacuacaagaaugccaccaacccgcagacggucgaggugcccuacaucugcaccgagggcgaggaccagaucaccguguggggguuccacagcgacaauaagacccagaugaagaaccuguacggcgacuccaacccccagaaguucacgucguccgccaacggggucaccacccauuacgugagccagaucggcgacuuccccgaccagaccgaggacggcgggcugccgcaguccggccgcaucguggucgacuacauggugcagaagcccgggaagacgggcaccaucguguaucagcgcgggguccuccugccccagaagguguggugcgcgagcggccgguccaaggugaucaagggcagccugccccucaucggggaggccgacugccugcacgagaaguacggcgggcugaauaagucgaagccguacuacaccggcgagcacgccaaggccaucgggaacugccccaucugggucaagacgccccucaagcuggccaacggcaccaaguaccggcccccggcgaagcugcucaaggagcgcggcuuuuucggggccaucgccggcuuccuggagggcgggugggaggggaugaucgccggcuggcacggcuacaccucccacggggcccacggcguggcggucgccgccgaccugaaguccacccaggaggccaucaauaagaucaccaagaaccucaacucccugagcgagcuggaggugaagaaccuccagcggcuguccggggccauggacgagcugcacaacgagaucaucgagcucgacgagaagguggaugaccugcgcgcggacacgaucagcucccagaucgagcuggccguccuccugagcaacgagggcaucaucaacuccgaggacgagcaucuccuggcccuggagcggaagcugaagaagaugcucggccccucggccguggacaucgggaacggcugcuucgagaccaagcacaagugcaaccagaccugucuggaccgcaucgcggccgggaccuucaacgccggcgaguucucccugcccaccuucgacagccucaauaucacggccgccucccugaacgacgacgggcuggacaaccacaccauccuccuguacuacaguaccgcggccuccagccuggccgugacccugaugcucgccaucuucaucgucuacauggugucccgggacaacgugagcugcuccaucugccuguga

SEQ ID NO: 15915 - RNA, 1758 nt, Artificial Sequence; identical to SEQ ID NO: 15605
  derived and/or modified CDS sequence (AUadapt) from InfluenzaB__AHL94827__HA

SEQ ID NO: 15916 - RNA, 1755 nt, Artificial Sequence
  derived and/or modified CDS sequence (AUadapt) from InfluenzaB__AHL94837__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccgccaaguccuacuuugccaaccugaaggggacccggacgcgcggcaagcucugccccgacugccugaacugcaccgaccuggacguggcccucgggcggcccaugugcgugggcaccaccccguccgccaaggcgaguauccugcacgagguccgccccgugacguccggcugcuuccccaucaugcacgaccggaccaagauccgccagcugcccaaccuccugcggggguacgagaacauccgccugagcacccagaacgugaucgaugccgagaaggccccgggcgggcccuacaagcucggcaccuccgggagcugccccaacgccacguccaagaucggcuucuucgcgaccauggccugggccguccccaaggacaacuacaagaaugccaccaacccgcugaccguggaggugcccuacaucugcaaggagggcgaggaccagaucacggucuggggguuccacagcgacaacaagacccagaugaagaaucuguacggcgacuccaacccccagaaguucaccucguccgccaacggggugaccacgcacuacgugagccagaucggcgacuuucccgaccagaccgaggacggcgggcucccgcaguccggccggaucgucguggacuacaugaugcagaagcccgggaagaccggcaccaucguguaccagcgcgggguccugcugccccagaagguguggugcgcgagcggccgguccaaggugaucaagggcucgcucccccugaucggggaggccgacugucugcacgaggaguacggcgggcucaacaagagcaagccguacuacacgggcaagcacgccaaggccaucgggaacugccccaucugggucaagacgccccugaagcuggccaauggcaccaaguaccggcccccggcgaagcuccugaaggagcgcggcuucuucggggccaucgccggcuuccuggagggcgggugggaggggaugaucgccggcuggcacggcuacaccucccacggggcccacggcguggcggucgccgccgaccucaagagcacccaggaggccaucaauaagaucaccaagaaccugaacucccugagcgagcucgaggugaagaaccugcagcgccuguccggggccauggacgagcuccacaacgagauccuggagcuggacgagaagguggacgaucuccgggcggacaccaucucgucccagaucgagcuggccguccugcucagcaacgagggcaucaucaacuccgaggacgagcaccuccuggcccuggagcgcaagcugaagaagaugcugggccccagcgccguggacaucgggaauggcugcuucgagaccaagcacaagugcaaccagacgugccucgaccggaucgcggccgggaccuucaacgccggcgaguucucccugcccaccuuugacucgcugaacaucaccgccgccucccucaacgacgacgggcuggacaaccacaccauccugcuguauuacagcacggcggccuccagccucgccgugacccugaugcuggccaucuucaucgucuacauggugucccgcgacaacgugagcugcuccaucugccucuga

SEQ ID NO: 15917 - RNA, 1755 nt, Artificial Sequence; identical to SEQ ID NO: 14116
  derived and/or modified CDS sequence (AUadapt) from InfluenzaB__AHL94847__HA

SEQ ID NO: 15918 - RNA, 1758 nt, Artificial Sequence
  derived and/or modified CDS sequence (AUadapt) from InfluenzaB__AHL94858__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccacuucgccaaucugaaggggacggagacccggggcaagcucugccccaagugccugaacugcaccgaccuggacguggcccucgggcgccccaagugcaccggcaacaucccguccgcccgggugucgauccugcacgagguccgccccgugacguccggcugcuuucccaucaugcacgaccggaccaagauccgccagcugcccaaccuccugcggggguacgagcacauccgccugagcacccacaacgugaucaacgccgagaacgcgccgggcgggcccuacaagaucggcaccuccgggaguugccccaacgucacgaacggcaacggcuucuucgccaccauggccugggccgugcccaagaacgacaacaacaagaccgcgaccaacucccucacgaucgaggugccguauaucugcaccgagggggaggaccagaucaccgucuggggcuuccacagcgacaacgagacccagauggccaagcuguacggggacuccaagccccagaaguucacgucguccgccaauggcgugaccacccacuacgugagccagaucggcggguuccccaaccagaccgaggacggcgggcugccccaguccggccggaucgucguggacuacauggugcagaaguccgggaaggccggcacgaucaccuaccagcgcggcauccuccugccgcagaaggucuggugcgccuccgggcggucgaaggugaucaagggcagccugccccucaucggggaggcggauugccugcacgagaaguacggcgggcugaacaaguccaagcccuacuacaccggcgagcacgccaaggccaucggcaacugccccaucugggugaagaccccgcucaagcuggccaacgggacgaaguaccgcccgcccgccaagcugcucaaggagcggggcuuuuucggggcgaucgccggcuuccuggagggcgggugggagggcaugaucgccggguggcacggcuacaccucgcacggggcccacggcgucgccguggcggccgaccugaaguccacccaggaggccaucaacaagaucaccaagaaccucaacagucuguccgagcuggaggucaagaaccuccagcgccugucgggcgccauggacgagcugcacaacgagauccucgagcuggacgagaagguggacgaccugcgggccgacacgaucuccagccagaucgagcucgcggugcugcuguccaacgaggggaucaucaauucggaggacgagcaccuccuggcccuggagcgcaagcucaagaagaugcugggccccuccgccgucgagaucgggaacggcugcuucgagaccaagcacaagugcaaccagaccugccuggaccggaucgccgcggggaccuuugacgccggcgaguucagccuccccaccuucgacucccugaacaucacggccgccucgcugaacgacgacggccucgacaaucacaccauccugcuguacuacuccaccgccgcgagcucccuggccgugacccucaugaucgccaucuucguggucuacauggugucgcgcgacaacguguccugcagcaucugccuguga

SEQ ID NO: 15919 - RNA, 1755 nt, Artificial Sequence; identical to SEQ ID NO: 14117
  derived and/or modified CDS sequence (AUadapt) from InfluenzaB__AHL94869__HA

SEQ ID NO: 15920 - RNA, 1758 nt, Artificial Sequence; identical to SEQ ID NO: 14085
  derived and/or modified CDS sequence (AUadapt) from InfluenzaB__AHL94880__HA

SEQ ID NO: 15921 - RNA, 1758 nt, Artificial Sequence; identical to SEQ ID NO: 15062
  derived and/or modified CDS sequence (AUadapt) from InfluenzaB__AHL94889__HA

SEQ ID NO: 15922 - RNA, 1758 nt, Artificial Sequence; identical to SEQ ID NO: 14085
  derived and/or modified CDS sequence (AUadapt) from InfluenzaB__AHL94900__HA

SEQ ID NO: 15923 - RNA, 1758 nt, Artificial Sequence
  derived and/or modified CDS sequence (AUadapt) from InfluenzaB__AHL94911__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagucacuucgccaaccugaaggggacggagacccggggcaagcucugccccaagugccccaacugcaccgaccuggacguggcccuggggcgcccgaaguguaccggcaagauccccuccgcccgggugucgauccuccacgagguccgccccgugacguccggcugcuuccccaucaugcacgaccggaccaagauccgccagcugccgaaccugcuccggggguacgagcauauccgccugagcacccacaacgugaucaacgccgagaacgcgcccggcgggcccuacaagaucggcaccuccgggagcugccccaacgucacgaauggcaacggcuucuucgccaccauggccugggccgugccgaagaacgacaagaacaagaccgcgaccaacccccugacgaucgaggugcccuacaucuguaccgagggggaggaccagaucaccgucuggggcuuccacuccgacaacgagacccagauggccaagcucuacggggacucgaagccccagaaguucacguccagugccaacggcgugaccacccacuacgugucccagaucggcggguucccgaaccagaccgaggacggcgggcugccccagucgggccggaucgucguggacuauauggugcagaaguccgggcgcacgggcaccaucaccuaccagcggggcauccugcucccccagaaggucuggugcgccagcgggcgcuccaaggugaucaagggcucgcugccccugaucggggaggccgacugccuccacgagaaguacggcgggcugaacaagaguaagccguacuacaccggcgagcacgcgaaggccaucggcaacugccccaucugggugaagacgccccugaagcucgccaacgggaccaaguaccggcccccggccaagcugcugaaggagcgcggcuucuuuggggccaucgcgggcuuccucgagggcgggugggagggcaugaucgccggguggcacggcuacaccucccacggggcccacggcgucgccguggccgcggaccugaaguccacccaggaggccaucaacaagaucacgaagaaccugaacucccucagugagcuggaggucaagaaccugcagcggcucuccggcgccauggacgagcugcacaacgagauccuggagcucgacgagaagguggacgaccugcgcgccgacaccaucaguucccagaucgagcuggccgugcuccugagcaacgaggggaucaucaacuccgaggacgagcaccuccuggcgcuggagcggaagcugaagaagaugcucggccccucggccgucgagaucgggaacggcugcuucgagaccaagcauaagugcaaccagaccugccuggaccgcaucgccgccgggaccuucgacgcgggcgaguucucccugcccacguucgauagccucaacaucaccgccgccucccugaacgacgacggccuggacaaccacaccauccuccuguacuauucgaccgccgccuccagccuggcggugacgcugaugaucgccaucuucguggucuacauggugucccgggacaacgugagcugcuccaucugccucuga

SEQ ID NO: 15924 - RNA, 1758 nt, Artificial Sequence; identical to SEQ ID NO: 14085
  derived and/or modified CDS sequence (AUadapt) from InfluenzaB__AHL94922__HA

SEQ ID NO: 15925 - RNA, 1758 nt, Artificial Sequence
  derived and/or modified CDS sequence (AUadapt) from InfluenzaB__AHL94933__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuuugccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuucccaucaugcacgaccggaccaagauccgccagcugcccaaccuccugcggggguacgagcacauccgccugucgacccacaacgugaucaacgccgagaacgcgccgggcgggcccuacaagaucggcaccuccgggaguugccccaacaucacgaacggcaacggcuucuucgccaccauggccugggccguccccaagaacgacaagaacaagaccgcgaccaacccgcucacgaucgaggugcccuacaucuguaccgagggggaggaccagaucaccguguggggcuuccacuccgacaacgagacccagauggccaagcuguacggggacucgaagccccagaaguucacguccagcgccaacggcgucaccacccauuacgugucccagaucggcggguuccccaaccagaccgaggacggcgggcugccgcagucgggccggaucguggucgacuacauggugcagaaguccgggaaggccggcacgaucaccuaccagcgcggcauccuccugccccagaagguguggugcgccagcgggcgguccaaggucaucaagggcucgcugccccucaucggggaggcggauugccugcacgagaaguacggcgggcugaacaagagcaagcccuacuacaccggcgagcacgccaaggccaucggcaacugcccgaucugggugaagacgccccucaagcuggccaacgggaccaaguaucgcccgcccgccaagcugcucaaggagcggggcuucuucggggcgaucgccggcuuccuggagggcgggugggagggcaugaucgccggguggcacggcuacaccucccacggggcccacggcguggccgucgcggccgaccugaaguccacccaggaggccaucaacaagaucaccaagaaccucaacucccugagugagcuggaggugaagaaccuccagcgccuguccggcgccauggacgagcugcacaacgagauccucgagcuggacgagaaggucgacgaccugcgggccgacacgaucagcucccagaucgagcucgcggugcugcugucgaacgaggggaucaucaauuccgaggacgagcaccuccuggcccuggagcgcaagcucaagaagaugcugggccccagcgccguggagaucgggaacggcugcuucgagaccaagcacaagugcaaccagaccugccuggaccggaucgccgcggggaccuuugacgccggcgaguucucccuccccaccuucgacucgcugaacaucacggccgccucccugaacgacgacggccucgacaaccauaccauccugcuguacuacagcaccgccgcguccucgcuggccgucacccucaugaucgccaucuucgugguguacauggucucccgcgacaacgugagcugcuccaucugccuguga

SEQ ID NO: 15926 - RNA, 1758 nt, Artificial Sequence; identical to SEQ ID NO: 15810
  derived and/or modified CDS sequence (AUadapt) from InfluenzaB__AHL94944__HA

SEQ ID NO: 15927 - RNA, 1758 nt, Artificial Sequence; identical to SEQ ID NO: 14423
  derived and/or modified CDS sequence (AUadapt) from InfluenzaB__AHL94955__HA

SEQ ID NO: 15928 - RNA, 1758 nt, Artificial Sequence; identical to SEQ ID NO: 14423
  derived and/or modified CDS sequence (AUadapt) from InfluenzaB__AHL94965__HA

SEQ ID NO: 15929 - RNA, 1758 nt, Artificial Sequence; identical to SEQ ID NO: 14423
  derived and/or modified CDS sequence (AUadapt) from InfluenzaB__AHL94975__HA

SEQ ID NO: 15930 - RNA, 1755 nt, Artificial Sequence; identical to SEQ ID NO: 14116
  derived and/or modified CDS sequence (AUadapt) from InfluenzaB__AHM00986__HA

SEQ ID NO: 15931 - RNA, 1758 nt, Artificial Sequence; identical to SEQ ID NO: 14124
  derived and/or modified CDS sequence (AUadapt) from InfluenzaB__AHM00997__HA

SEQ ID NO: 15932 - RNA, 1758 nt, Artificial Sequence
  derived and/or modified CDS sequence (AUadapt) from InfluenzaB__AHM01008__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuuugccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuucccaucaugcacgaccggaccaagauccgccagcugcccaaccuccugcggggguacgagcacauccgccugucgacccacaacgugaucaacgccgaggacgcgccgggcgggcccuacaagaucggcaccuccgggaguugccccaacgucacgaacggcaacggcuucuucgccaccauggccuggaccgugcccaagaacgacaagaacaagaccgccacgaacccgcucaccaucgaggugcccuacaucuguaccgagggggaggaccagaucaccgucuggggcuuccacuccgacaacgagacgcagauggcgaagcuguacggggacucgaagccccagaaguucaccuccagcgccaacggcgugaccacccauuacgugucccagaucggcggguuccccaaccagacggaggacggcgggcugccgcagucgggccggaucgucguggacuacauggugcagaaguccgggaagaccggcaccaucaccuaccagcgcggcauccuccugccccagaaggucuggugcgccagcgggcgguccaaggugaucaagggcucgcugccccucaucggggaggccgauugccugcacgagaaguacggcgggcugaacaagagcaagcccuacuacacgggcgagcacgccaaggcgaucggcaacugcccgaucugggugaagacgccccucaagcuggccaacgggaccaaguaucgcccgcccgccaagcugcucaaggagcggggcuucuucggggccaucgccggcuuccuggagggcgggugggagggcaugaucgcgggguggcacggcuacaccucccacggggcccacggcgucgccguggccgccgaccugaaguccacccaggaggcgaucaacaagaucaccaagaaccucaacucccugagugagcuggaggucaagaaccuccagcgccuguccggcgccauggacgagcugcacaacgagauccucgagcuggacgagaagguggacgaccugcgggccgacaccaucagcucccagaucgagcucgccgugcugcugucgaacgaggggaucaucaauuccgaggacgagcaccuccuggcccuggagcgcaagcucaagaagaugcugggccccagcgcggucgagaucgggaacggcugcuucgagaccaagcacaagugcaaccagaccugccuggaccggaucgccgccgggacguuugacgccggcgaguucucccuccccaccuucgacucgcugaacaucaccgcggccucccugaacgacgacggccucgacaaccauaccauccugcuguacuacagcacggccgccuccucgcuggccgugacccucaugaucgcgaucuucguggucuacauggugucccgcgacaacgugagcugcuccaucugccuguga

SEQ ID NO: 15933 - RNA, 1758 nt, Artificial Sequence; identical to SEQ ID NO: 14124
  derived and/or modified CDS sequence (AUadapt) from InfluenzaB__AHM01019__HA

SEQ ID NO: 15934 - RNA, 1758 nt, Artificial Sequence; identical to SEQ ID NO: 14124
  derived and/or modified CDS sequence (AUadapt) from InfluenzaB__AHM01030__HA

SEQ ID NO: 15935 - RNA, 1758 nt, Artificial Sequence
  derived and/or modified CDS sequence (AUadapt) from InfluenzaB__AHM01041__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuuugccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuucccaucaugcacgaccggaccaagauccgccagcugcccaaccuccugcggggguacgagcacauccgccugucgacccacaacgugaucaacgccgaggacgcgccgggcgggcccuacaagaucggcaccuccgggaguugccccaacgucacgaacggcaacggcuucuucgccaccauggccugggccgugcccaagaacgacaagaacaagaccgcgaccaacccgcucacgaucgaggugcccuacaucuguaccgagggggaggaccagaucaccgucuggggcuuccacuccgacaacgagacccagauggccaagcuguacggggacucgaagccccagaaguucacguccagcgccaacggcgugaccacccauuacgugucccagaucggcggguuccccaaccagaccgaggacggcgggcugccgcagucgggccggaucgucguggacuacauggugcagaaguccgagaagacggggaccaucaccuaccagcgcggcauccuccugccccagaaggucuggugcgccagcggccgguccaaggugaucaaggggucgcugccccucaucggcgaggccgauugccugcacgagaaguacgggggccugaacaagagcaagcccuacuacaccggggagcacgcgaaggccaucggcaacugcccgaucugggugaagacgccccucaagcuggccaacggcaccaaguaucgcccgcccgccaagcugcucaaggagcggggguucuucggcgccaucgcgggguuccuggagggcgggugggagggcaugaucgccggcuggcacggguacaccucccacggcgcccacggggucgccguggccgcggaccugaaguccacccaggaggccaucaacaagaucacgaagaaccucaacucccugagugagcuggaggucaagaaccuccagcgccuguccggcgccauggacgagcugcacaacgagauccucgagcuggacgagaagguggacgaccugcgggccgacaccaucagcucccagaucgagcucgccgugcugcugucgaacgagggcaucaucaauuccgaggacgagcaccuccuggcgcuggagcgcaagcucaagaagaugcuggggcccagcgccgucgagaucggcaacgggugcuucgagaccaagcacaagugcaaccagaccugccuggaccggaucgccgccggcaccuuugacgcgggggaguucucccuccccacguucgacucgcugaacaucaccgccgccucccugaacgacgacggccucgacaaccauaccauccugcuguacuacagcaccgccgccuccucgcuggcggugacgcucaugaucgccaucuucguggucuacauggugucccgcgacaacgugagcugcuccaucugccuguga

SEQ ID NO: 15936 - RNA, 1758 nt, Artificial Sequence
  derived and/or modified CDS sequence (AUadapt) from InfluenzaB__AHM01052__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugucccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaucuccugcggggguacgagcacauccgccugucgacccacaacgugaucaacgccgagaacgcgccgggcgggcccuacaagaucggcaccuccgggagcugccccaacgucacgaacggcaauggcuucuucgccaccauggccugggccgugcccaagaacgacaagaacaagaccgcgaccaacccgcucacgaucgaggugcccuacaucugcaccgagggggaggaccagaucaccgucuggggcuuccacuccgacaaugagacccagauggccaagcuguacggggacucgaagccccagaaguucacguccucggccaacggcgugaccacccacuacgugucccagaucggcggguuccccaaccagaccgaggacggcgggcugccgcagagcggccggaucgucguggauuacauggugcagaaguccgggaagacgggcaccaucaccuaccagcgcggcauccuccugccccagaaggucuggugcgccucggggcgguccaaggugaucaagggcagccugccccucaucggggaggccgacugccugcacgagaaguacggcgggcugaacaagucgaagcccuacuauaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaucugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaccugcgggccgacaccaucaguucccagaucgagcucgccgugcugcugucgaacgaggggaucaucaacuccgaggacgagcaccuccuggcgcuggagcgcaagcucaagaagaugcugggccccagcgccgucgagaucgggaacggcugcuucgagaccaagcacaagugcaaccagaccugucuggaccggaucgccgccgggaccuucgacgcgggcgaguucucccuccccacguucgacucgcugaacaucaccgccgccucccugaacgacgacggccucgacaaucacaccaucaugcuguacuacagcaccgccgccuccucgcuggcggugacgcugaugaucgccaucuucguggucuacauggugucccgcgacaacgugagcugcuccaucugccucuga

SEQ ID NO: 15937 - RNA, 1758 nt, Artificial Sequence; identical to SEQ ID NO: 14124
  derived and/or modified CDS sequence (AUadapt) from InfluenzaB__AHM01063__HA

SEQ ID NO: 15938 - RNA, 1755 nt, Artificial Sequence; identical to SEQ ID NO: 14116
  derived and/or modified CDS sequence (AUadapt) from InfluenzaB__AHM01074__HA

SEQ ID NO: 15939 - RNA, 1755 nt, Artificial Sequence
  derived and/or modified CDS sequence (AUadapt) from InfluenzaB__AHM01096__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuauuucgccaaccugaaggggacgaagacccggggcaagcucugccccgacugccugaacugcaccgaccuggauguggcccucgggcgccccaugugcgugggcaccacgccguccgccaaggccucgauccugcacgagguccggcccgugaccuccggcugcuuccccaucaugcacgaccgcaccaagauccggcagcuggcgaaccuccugcgcggguaugagaacauccggcugagcacccagaacgugaucgacgccgagaaggcccccggcgggccguaccgccucggcacguccgggagcugccccaacgccaccuccaagaguggcuucuucgcgaccauggccugggccguccccaaggacaacaacaagaacgccaccaacccccugacgguggaggugccguacaucugugccgagggcgaggaccagaucaccgucuggggguuccacuccgacaacaagacccagaugaagaaccuguacggcgacaguaacccccagaaguucaccuccagcgcgaacggggugacgacccacuacgugucccagaucggcggcuuccccgaccagaccgaggaugggggccucccccagagcgggcggaucgucguggacuacaugaugcagaagccgggcaagaccgggacgaucguguaccagcgcggcauccugcugccccagaaggucuggugcgccuccggccggagcaaggugaucaaggggucgcucccccugaucggcgaggccgacugucugcacgagaaguacgggggccucaacaaguccaagcccuacuacaccggggagcacgccaaggccaucggcaacugcccgaucugggugaagacgccccugaagcuggcgaauggcaccaaguaccgcccgcccgccaagcuccugaaggagcggggguucuucggcgccaucgccggguuccuggagggcgggugggagggcaugaucgccggcuggcacggguacaccagccacggcgcgcauggggucgccguggccgccgaccucaaguccacccaggaggccaucaacaagaucaccaagaaccugaacagccuguccgagcucgaggucaagaaccugcagcgccugucgggcgcgauggacgagcuccauaacgagauccuggagcuggacgagaagguggacgaccuccgggccgacaccaucuccagccagaucgagcuggccgugcugcucuccaacgagggcaucaucaacagugaggacgagcaccuccuggcccuggagcgcaagcugaagaagaugcuggggcccuccgcggucgacaucggcaacgggugcuucgagacgaagcacaagugcaaucagaccugccucgaccggaucgccgccggcaccuucaacgccggggaguucagccugcccaccuucgacucccugaauaucaccgccgcgucgcucaacgacgacggccuggacaaccacacgauccugcuguacuauuccaccgccgccagcucccucgccgugacccugaugcuggccaucuucaucguguacauggucagccgcgacaacguguccugcagcaucugccucuga

SEQ ID NO: 15940 - RNA, 1758 nt, Artificial Sequence; identical to SEQ ID NO: 14124
  derived and/or modified CDS sequence (AUadapt) from InfluenzaB__AHM01107__HA

SEQ ID NO: 15941 - RNA, 1758 nt, Artificial Sequence
  derived and/or modified CDS sequence (AUadapt) from InfluenzaB__AHM01118__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccacuuugccaaccugaaggggacggagacccggggcaagcucugccccaagugccugaacugcaccgaccuggacguggcccucgggcgccccaagugcaccggcaagaucccguccgcccgggugucgauccugcacgagguccgccccgugacguccggcugcuuucccaucaugcacgaccggaccaagauccgccagcugcccaaccuccugcggggguacgagcacauccgccugagcacccacaacgugaucaacgccgaggacgcgccgggcgggcccuacaagaucggcaccuccgggaguugccccaacgucacgaacggcaacggcuucuucgccaccauggccugggccgugcccaagaacgacaagaacaagaccgcgaccaacccgcucacgaucgaggugcccuacaucuguaccgagggggaggaccagaucaccgucuggggcuuccacuccgacaacgagacccagauggccaagcuguacggggacagcaagccccagaaguucacguccucggccaacggcgugaccacccauuacgugucccagaucggcggguuccccaaccagaccgaggacggcgggcugccgcagagcggccggaucgucguggacuacauggugcagaaguccgggaagacgggcaccaucaccuaccagcgcggcauccuccugccccagaaggucuggugcgccucggggcgguccaaggugaucaagggcagccugccccucaucggggaggccgauugccugcacgagaaguacggcgggcugaacaagucgaagcccuacuacaccggcgagcacgcgaaggccaucggcaacugcccgaucugggugaagacgccccucaagcuggccaacgggaccaaguaucgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagugagcuggaggucaagaaccuccagcgccuguccggcgccauggacgagcugcacaacgagauccucgagcuggacgagaagguggacgaccugcgggccgacaccaucucgucccagaucgagcucgccgugcugcugagcaacgaggggaucaucaauuccgaggacgagcaccuccuggcgcuggagcgcaagcucaagaagaugcugggccccucggccgucgagaucgggaacggcugcuucgagaccaagcacaagugcaaccagaccugccuggaccggaucgccgccgggaccuuugacgcgggcgaguucucccuccccacguucgacagccugaacaucaccgccgugucccugaacgacgacggccucgacaaccauaccauccugcuguacuacucgaccgccgccuccagccuggccgugacgcucaugaucgcgaucuucgucguguacauggugucccgcgacaacgucagcugcuccaucugccuguga

SEQ ID NO: 15942 - RNA, 1758 nt, Artificial Sequence; identical to SEQ ID NO: 14124
  derived and/or modified CDS sequence (AUadapt) from InfluenzaB__AHM01129__HA

SEQ ID NO: 15943 - RNA, 1758 nt, Artificial Sequence
  derived and/or modified CDS sequence (AUadapt) from InfluenzaB__AHM01140__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccacuuugccaaccugaaggggacggagacccggggcaagcucugccccaagugccugaacugcaccgaccuggacguggcccucgggcgccccaagugcaccggcaagaucccguccgcccgggugucgauccugcacgagguccgccccgugacguccggcuguuuccccaucaugcacgaccggaccaagauccgccagcugcccaaccuccugcggggguacgagcacauccgccugagcgcccacaacgugaucaacgcggagaaugccccgggcgggcccuacaagaucggcaccuccgggucgugccccaacgucaccaacggcaacggcuucuucgccacgauggccugggcggugcccaagaacgacaagaauaagaccgccaccaacccgcucaccaucgaggugcccuacaucugcacggagggggaggaccagaucaccgucuggggcuuccacuccgacaacgagacccagauggccaagcuguacggggacaguaagccccagaaguucaccuccucggccaacggcgugacgacccacuacgugucccagaucggcggguuccccaaccagaccgaggacggcgggcugccgcagagcggccggaucgucguggacuauauggugcagaaguccgggaagaccggcacgaucaccuaccagcgcggcauccuccugccccagaaggucuggugcgccucggggcgguccaaggugaucaagggcagccugccccucaucggggaggcggacugccugcacgagaaguacggcgggcugaacaagucgaagcccuauuacaccggcgagcacgccaaggccaucggcaacugcccgaucugggugaagacgccccucaagcuggccaacgggaccaaguaccgcccgcccgccaagcugcucaaggagcggggcuucuucggggcgaucgccggcuuccuggagggcgggugggagggcaugaucgccggguggcacggcuauaccucccacggggcccacggcgucgccguggcggccgaccugaaguccacccaggaggccaucaacaagaucaccaagaaccucaacucccugagcgagcuggaggucaagaaccuccagcgccuguccggcgccauggacgagcugcacaaugagauccucgagcuggacgagaagguggacgaccugcgggccgacacgaucucgucccagaucgagcucgcggugcugcugagcaacgaggggaucaucaacuccgaggacgagcaccuccuggcccuggagcgcaagcucaagaagaugcugggccccagugccgucgagaucgggaacggcugcuucgagaccaagcacaagugcaaccagaccugccuggaccggaucgccgcggggaccuucgacgccggcgaguuuucccuccccaccuucgacagccugaacaucacggccgccucccugaacgacgacggccucgacaaccacaccauccugcuguauuacucgaccgccgcguccagccuggccgugacccucaugaucgccaucuucguggucuacauggugucccgcgacaacgugagcugcuccaucugccuguga

SEQ ID NO: 15944 - RNA, 1758 nt, Artificial Sequence; identical to SEQ ID NO: 14612
  derived and/or modified CDS sequence (AUadapt) from InfluenzaB__AHM01151__HA

SEQ ID NO: 15945 - RNA, 1758 nt, Artificial Sequence
  derived and/or modified CDS sequence (AUadapt) from InfluenzaB__AHM01162__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuuugccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuucccaucaugcacgaccggaccaagauccgccagcugcccaaccuccugcggggguacgagcacauccgccugucgacccacaacgugaucaacgccaaggacgcgccgggcgggcccuacaagaucggcaccuccgggaguugccccaacgucacgaacggcaacggcuucuucgccaccauggccugggccgugcccaagaacgacaagaacaagaccgcgaccaacccgcucacgaucgaggugcccuacaucuguaccgagggggaggaccagaucaccgucuggggcuuccacuccgacaacgagacccagauggccaagcuguacggggacucgaagccccagaaguucacguccagcgccaacggcgugaccacccauuacgugucccagaucggcggguuccccaaccagaccgaggacggcgggcugccgcagucgggccggaucgucguggacuacauggugcagaaguccgggaagacgggcaccaucaccuaccagcgcggcauccuccugccccagaaggucuggugcgccagcgggcgguccaaggugaucaagggcucgcugccccucaucggggaggccgauugccugcacgagaaguacggcgggcugaacaagagcaagcccuacuacaccggcgagcacgcgaaggccaucggcaacugcccgaucugggugaagacgccccucaagcuggccaacgggaccaaguaucgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagugagcuggaggucaagaaccuccagcgccuguccggcgccauggacgagcugcacaacgagauccucgagcuggacgagaagguggacgaccugcgggccgacaccaucagcucccagaucgagcucgccgugcugcugucgaacgaggggaucaucaauuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuuugacgcgggcgaguucucccuccccacguucgacucgcugaacaucaccgccgccucccugaacgacgacggccucgacaaccauaccauccugcuguacuacagcaccgccgccuccucgcuggcggugacgcucaugaucgccaucuucguggucuacauggugucccgcgacaacgugagcugcuccaucugccuguga

SEQ ID NO: 15946 - RNA, 1755 nt, Artificial Sequence; identical to SEQ ID NO: 14116
  derived and/or modified CDS sequence (AUadapt) from InfluenzaB__AHM01173__HA

SEQ ID NO: 15947 - RNA, 1758 nt, Artificial Sequence
  derived and/or modified CDS sequence (AUadapt) from InfluenzaB__AHM01184__HA
augaaggccaucaucgugcugcucauggucgugaccaguaacgccgaccgcaucugcaccggcaucacguccucgaacagcccccacguggucaagaccgcgacccagggggaggugaacgugaccggcgucaucacgcugaccaccaccccgacgaagucccacuucgccaaucugaaggggaccgagacccggggcaagcucugccccaagugccugaacugcaccgaccuggacguggcccucgggcgccccaagugcacgggcaagauccccuccgcccgggugucgauccugcacgagguccgcccggugaccuccggcugcuuccccaucaugcaugaccggaccaagauccgccagcugcccaaccuccugcggggguacgagcacauccgccugagcacccacaacgugaucaacgccgaggacgcgcccggcgggccguacaagaucggcacguccgggucgugucccaacgucaccaacggcaacggcuucuucgccaccauggccugggccgugcccaagaacgacaagaacaagaccgcgacgaacccccucaccaucgaggugccguacaucugcaccgagggggaggaucagaucaccgucuggggcuuccacuccgacaacgagacgcagauggccaagcuguacggggacagcaagccccagaaguucaccuccucggccaacggcgugaccacccacuaugugucccagaucggcggguuccccaaccagacggaggacggcgggcugccccagagcggccggaucgucguggacuacauggugcagaaguccgggaagaccggcaccaucaccuaccagcgcggcauccuccugccgcagaaggucuggugcgccucggggcgguccaaggugaucaagggcagccugccccucaucggggaggccgacugucugcacgagaaguacggcgggcugaacaagucgaagcccuacuacacgggcgagcacgcgaaggccaucggcaacugccccaucugggugaagaccccgcucaagcuggccaacgggaccaaguaccgcccgcccgccaagcugcucaaggagcggggcuuuuucggggccaucgcgggcuuccuggagggcgggugggagggcaugaucgccggguggcacggcuacaccucccacggggcccacggcgucgccguggccgcggaccucaagagcacgcaggaggccaucaacaagaucaccaagaaccugaacucccugagugagcuggaggucaagaaccuccagcgccuguccggcgccauggacgagcugcacaacgagauccucgagcuggacgagaagguggacgaccugcgggccgacaccaucagcucccagaucgagcucgccgugcugcugucgaacgaggggaucaucaauuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggacguuugacgcgggcgaguucucccuccccaccuucgacucgcugaacaucaccgccgccucccugaacgacgacggccucgacaaccauaccauccugcuguacuacagcacggccgccuccucgcuggcggugacccucaugaucgccaucuucguggucuacauggugucccgcgacaacgugagcugcuccaucugccuguga

SEQ ID NO: 15948 - RNA, 1758 nt, Artificial Sequence; identical to SEQ ID NO: 15943
  derived and/or modified CDS sequence (AUadapt) from InfluenzaB__AHM01195__HA

SEQ ID NO: 15949 - RNA, 1758 nt, Artificial Sequence
  derived and/or modified CDS sequence (AUadapt) from InfluenzaB__AHM01206__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccauuucgccaaccugaaggggacggagacccggggcaagcucugccccaagugccugaacugcaccgaccuggacguggcccucgggcgccccaagugcaccggcaagaucccguccgcccgggugucgauccugcaugagguccgccccgugacguccggcugcuuccccaucaugcacgaccggaccaagauccgccagcugcccaaccuccugcggggguacgagcacauccgccugagcacccacaacgugaucaaugccgaggacgcgccgggcgggcccuacaagaucggcaccuccgggucgugccccaacgucacgaacggcaacggcuucuucgccaccauggccugggccgugcccaagaacgauaagaacaagaccgcgaccaacccgcucacgaucgaggugcccuacaucugcaccgagggggaggaccagaucaccgucuggggcuuccacuccgacaacgagacccagauggccaagcuguacggggauagcaagccccagaaguucacguccucggccaacggcgugaccacccacuacgugucccagaucggcggguuccccaaccagaccgaggacggcgggcugccgcagagcggccggaucgucguggauuacauggugcagaaguccgagaagacggggaccaucaccuaccagcgcggcauccuccugccccagaaggucuggugcgccucgggccgguccaaggugaucaaggggagccugccccucaucggcgaggccgacugccugcacgagaaguacgggggccugaacaagaguaagcccuacuacaccggggagcacgcgaaggccaucggcaacugcccgaucugggugaagacgccccucaagcuggccaacggcaccaaguaccgcccgcccgccaagcugcucaaggagcggggguucuucggcgccaucgcgggguuccuggagggcgggugggagggcaugaucgccggcuggcauggguacaccucccacggcgcccacggggucgccguggccgcggaccugaaguccacccaggaggccaucaacaagaucacgaagaaccucaacucccugagcgagcuggaggucaagaaccuccagcgccuguccggcgccauggacgagcugcauaacgagauccucgagcuggacgagaagguggacgaccugcgggccgacaccaucucgucccagaucgagcucgccgugcugcugagcaacgagggcaucaucaacuccgaggacgagcaucuccuggcgcuggagcgcaagcucaagaagaugcuggggcccucggccgucgagaucggcaacgggugcuucgagaccaagcacaagugcaaccagaccugccuggaccggaucgccgccggcaccuucgaugcgggggaguucucccuccccacguucgacagccugaacaucaccgccgccucccugaacgacgacggccucggcaaccacaccauccugcuguauuacucgaccgccgccuccagccuggcggugacgcucaugaucgccaucuucguggucuacauggugucccgcgacaacgugagcugcuccaucugccuguga

SEQ ID NO: 15950 - RNA, 1758 nt, Artificial Sequence; identical to SEQ ID NO: 14612
  derived and/or modified CDS sequence (AUadapt) from InfluenzaB__AHM01217__HA

SEQ ID NO: 15951 - RNA, 1755 nt, Artificial Sequence; identical to SEQ ID NO: 14116
  derived and/or modified CDS sequence (AUadapt) from InfluenzaB__AHM01228__HA

SEQ ID NO: 15952 - RNA, 1758 nt, Artificial Sequence; identical to SEQ ID NO: 14124
  derived and/or modified CDS sequence (AUadapt) from InfluenzaB__AHM01239__HA

SEQ ID NO: 15953 - RNA, 1758 nt, Artificial Sequence; identical to SEQ ID NO: 14124
  derived and/or modified CDS sequence (AUadapt) from InfluenzaB__AHM01250__HA

SEQ ID NO: 15954 - RNA, 1758 nt, Artificial Sequence
  derived and/or modified CDS sequence (AUadapt) from InfluenzaB__AHM01261__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucccacuucgccaaccugaaggggacggagacccggggcaagcucugucccaagugccugaacugcaccgaccuggacguggcccucgggcgccccaagugcaccggcaagaucccguccgcccgggugucgauccugcacgagguccgccccgugacguccggcugcuuccccaucaugcacgaucggaccaagauccgccagcugcccaaccuccugcggggguacgagcacauccgccugagcacccacaacgugaucaacgccgagaacgcgccgggcgggcccuacaagaucggcaccuccgggucgugccccaaugucacgaacggcaacggcuucuucgccaccauggccugggccgugcccaagaacgacaagaacaagaccgcgaccaacccgcucacgaucgaggugcccuacaucugcaccgagggggaggaccagaucaccaucuggggcuuucacuccgacaacgagacccagauggccaagcuguacggggacagcaacccccagaaguucacguccucggccaacggcgucaccacccacuaugugucccagaucggcggguuccccaaccagaccgaggacggcgggcugccgcagucgggccggaucguggucgacuacauggugcagaaguccgggaagacgggcaccaucaccuaccagcgcggcauccuccugccccagaagguguggugcgccgggggccggagcaaggucaucaaggggucccugccccucaucggcgaggccgacugccugcaugagaaguacgggggccugaacaagucgaagcccuacuacaccggcgagcacgcgaaggccaucgggaacugcccgaucugggugaagacgccccucaagcuggccaacggcaccaaguaccgcccgcccgccaagcugcucaaggagcggggguucuuuggcgccaucgcgggguuccuggagggcggcugggaggggaugaucgccggcuggcacggguacaccagccacggcgcccacggcguggccgucgccgcggaccugaaguccacccaggaggccaucaacaagaucacgaagaaccucaacucgcuguccgagcuggaggugaagaaucuccagcgccugagcggggccauggacgagcugcacaacgagauccucgagcuggacgagaaggucgacgaccugcgggccgacaccaucuccucgcagaucgagcucgccgugcugcuguccaacgagggcaucaucaacagugaggacgagcaccuccuggcgcuggagcgcaagcucaagaagaugcuggggcccuccgccguggagaucggcaacgggugcuucgagaccaagcacaagugcaaccagaccugccuggaccggaucgccgccggcaccuucgaugcgggcgaguucagccuccccacguucgacucccugaacaucaccgccgccucgcugaacgacgacgggcucgacaaccauaccauccugcuguacuacuccaccgccgccagcucccuggcggucacgcucaugaucgccaucuucgugguguacauggucucgcgcgacaacguguccugcagcaucugccuguga

SEQ ID NO: 15955 - RNA, 1755 nt, Artificial Sequence; identical to SEQ ID NO: 14116
  derived and/or modified CDS sequence (AUadapt) from InfluenzaB__AHM01272__HA

SEQ ID NO: 15956 - RNA, 1758 nt, Artificial Sequence; identical to SEQ ID NO: 15943
  derived and/or modified CDS sequence (AUadapt) from InfluenzaB__AHM01283__HA

SEQ ID NO: 15957 - RNA, 1758 nt, Artificial Sequence; identical to SEQ ID NO: 15943
  derived and/or modified CDS sequence (AUadapt) from InfluenzaB__AHM01294__HA

SEQ ID NO: 15958 - RNA, 1755 nt, Artificial Sequence; identical to SEQ ID NO: 14116
  derived and/or modified CDS sequence (AUadapt) from InfluenzaB__AHM01305__HA

SEQ ID NO: 15959 - RNA, 1758 nt, Artificial Sequence; identical to SEQ ID NO: 14124
  derived and/or modified CDS sequence (AUadapt) from InfluenzaB__AHM01316__HA

SEQ ID NO: 15960 - RNA, 1758 nt, Artificial Sequence; identical to SEQ ID NO: 15943
  derived and/or modified CDS sequence (AUadapt) from InfluenzaB__AHM01327__HA

SEQ ID NO: 15961 - RNA, 1758 nt, Artificial Sequence; identical to SEQ ID NO: 14124
  derived and/or modified CDS sequence (AUadapt) from InfluenzaB__AHM01338__HA

SEQ ID NO: 15962 - RNA, 1758 nt, Artificial Sequence; identical to SEQ ID NO: 14124
  derived and/or modified CDS sequence (AUadapt) from InfluenzaB__AHM01349__HA

SEQ ID NO: 15963 - RNA, 1758 nt, Artificial Sequence
  derived and/or modified CDS sequence (AUadapt) from InfluenzaB__AHM01360__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugucccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaucuccugcggggguacgagcacauccgccugucgacccacaacgugaucaacgccgagaacgcgccgggcgggcccuacaagaucggcaccuccgggagcugccccaacgucacgaacggcaauggcuucuucgccaccauggccugggccgugcccaagaacgacaagaacaagaccgcgaccaacccgcucacgaucgaggugcccuacaucugcaccaagggggaggaccagaucaccgucuggggcuuccacuccgacaaugagacccagauggccaagcuguacggggacucgaacccccagaaguucacguccucggccaacggcgugaccacccacuacgugucccagaucggcggguuccccaaccagaccgaggacggcgggcugccgcagaguggccggaucgucguggacuacauggugcagaaguccgggaagacgggcaccaucaccuaccagcgcggcauccuccugccccagaaggucuggugcgccucggggcgguccaaggugaucaagggcagccugccccucaucggggaggccgacugccugcacgagaaguacggcgggcugaacaagucgaagcccuauuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccauggcgucgccguggccgcggaccugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaccugcgggccgauaccaucucgucccagaucgagcucgccgugcugcugucgaacgaggggaucaucaacuccgaggacgagcaccuccuggcgcuggagcgcaagcucaagaagaugcugggccccagcgccgucgagaucgggaacggcugcuucgagaccaagcacaagugcaaucagaccugccuggaccggaucgccgccgggaccuucgacgcgggcgaguucucccuccccacguucgacucgcugaacaucaccgccgccucccugaacgacgacggccucgauaaccacaccauccugcuguacuacagcaccgccgccuccucgcuggcggugacgcucaugaucgccaucuucguggucuacauggugucccgcgacaacgugagcugcuccaucugccuguga

SEQ ID NO: 15964 - RNA, 1755 nt, Artificial Sequence
  derived and/or modified CDS sequence (AUadapt) from InfluenzaB__AHM01371__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgaagacccggggcaagcucugccccgacugccugaacugcaccgaucuggacguggcccucgggcgccccaugugcgugggcaccacgccguccgccaaggccagcauccugcacgagguccggcccgugaccuccggcugcuuccccaucaugcacgaucgcaccaagauccggcagcuggcgaaccuccugcgcggguacgagaacauccggcugucgacccagaacgugaucgacgccgagaaggcccccggcgggccguaccgccucggcacguccgggagcugucccaacgccaccuccaagaacggcuucuucgcgaccauggccugggccguccccaaggacaacaacaagaaugccaccaacccccugacgguggaggugccguacaucugcgccgagggcgaggaccagaucgcggucuggggguuccacagcgacaauaagacccagaugaagaaccuguacggcgacuccaacccccagaaguucaccagcuccgccaacggggugaccacgcauuacgugucgcagaucggcggcuuccccgaccagaccgaggacgggggccucccccaguccgggcggaucgucguggacuacaugaugcagaagccgggcaagaccgggaccaucguguaccagcgcggcguccugcugccccagaagguguggugugccagcggccgguccaaggugaucaaggggagccucccccugaucggcgaggccgacugccugcacgagaaguacgggggccucaacaagaguaagcccuacuacacgggggagcacgccaaggcgaucggcaacugcccgaucugggucaagacgccccugaagcuggccaacggcaccaaguaccgcccgcccgccaagcuccugaaggagcggggguucuuuggcgccaucgccggguuccuggagggcgggugggagggcaugaucgcgggcuggcacggguacaccucccacggcgcccacgggguggccgucgccgccgaccucaagucgacccaggaggcgaucaauaagaucaccaagaaccugaacucccugagcgagcucgaggugaagaaccugcagcgccuguccggcgccauggacgagcuccacaacgagauccuggagcuggacgagaagguggaugaccuccgggccgacaccaucagcucccagaucgagcuggccguccugcucagcaacgagggcaucaucaacuccgaggacgagcaucuccuggcgcuggagcgcaagcugaagaagaugcuggggcccucggccguggacaucggcaacgggugcuucgagaccaagcacaagugcaaccagacgugucucgaccggaucgccgccggcaccuucaacgccggggaguucucccugcccaccuucgacagccugaauaucaccgcggccucccucaacgacgacggccuggacaaccacaccauccugcuguacuacaguacggccgccuccagccucgccgugacccugaugcuggcgaucuucaucgucuacauggugucccgcgacaacgugagcugcuccaucugccucuga

SEQ ID NO: 15965 - RNA, 1755 nt, Artificial Sequence; identical to SEQ ID NO: 14116
  derived and/or modified CDS sequence (AUadapt) from InfluenzaB__AHM01382__HA

SEQ ID NO: 15966 - RNA, 1758 nt, Artificial Sequence
  derived and/or modified CDS sequence (AUadapt) from InfluenzaB__AHM01393__HA
augaaggccaucaucgugcugcucauggucgugaccaguaacgccgaccgcaucugcaccggcaucacguccucgaacagcccccacaucgugaagaccgcgacccagggggaggucaacgugaccggcgugaucccgcugacgaccacccccaccaagucgcacuucgccaaccugaaggggacggagacccggggcaagcucugucccaagugccugaacugcaccgaccuggacgucgcccucgggcgccccaagugcaccggcaagaucccguccgcccgggugagcauccugcacgaggugcgccccgucacguccggcugcuuccccaucaugcacgaccggaccaagauccgccagcugcccaaucuccugcggggguacgagcacauccgccugucgacccacaacgugaucaacgccgagaacgcgccgggcgggcccuacaagaucggcaccuccgggagcugccccaacgugacgaacggcaauggcuucuucgccaccauggccugggccguccccaagaacgacaagaacaagaccgcgaccaacccgcucacgaucgaggugcccuacaucugcaccgagggggaggaccagaucaccguguggggcuuccacuccgacaaugagacccagauggccaagcuguacggggacucgaagccccagaaguucacguccucggccaacggcgucaccacccacuacgugucccagaucggcggguuccccaaccagaccgaggacggcgggcugccgcagagcggccggaucguggucgauuacauggugcagaaguccgggaagacgggcaccaucaccuaccagcgcggcauccuccugccccagaagguguggugcgccucggggcgguccaaggucaucaagggcagccugccccucaucggggaggccgacugccugcacgagaaguacggcgggcugaacaagucgaagcccuacuauaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcguggccgucgccgcggaucugaaguccacccaggaggccaucaacaagaucacgaagaaccucaacucccugagcgagcuggaggugaagaaccuccagcgccuguccggcgccauggacgagcugcacaacgagauccucgagcuggacgagaaggucgacgaccugcgggccgacaccaucaguucccagaucgagcucgccgugcugcugucgaacgaggggaucaucaacuccgaggacgagcaccuccuggcgcuggagcgcaagcucaagaagaugcugggccccagcgccguggagaucgggaacggcugcuucgagaccaagcacaagugcaaccagaccugucuggaccggaucgccgccgggaccuucgacgcgggcgaguucucccuccccacguucgacucgcugaacaucaccgccgccucccugaacgacgacggccucgacaaucacaccauccugcuguacuacagcaccgccgccuccucgcuggcggucacgcucaugaucgccaucuucgugguguacauggucucccgcgacaacgugagcugcuccaucugccuguga

SEQ ID NO: 15967 - RNA, 1758 nt, Artificial Sequence; identical to SEQ ID NO: 14124
  derived and/or modified CDS sequence (AUadapt) from InfluenzaB__AHM01404__HA

SEQ ID NO: 15968 - RNA, 1758 nt, Artificial Sequence
  derived and/or modified CDS sequence (AUadapt) from InfluenzaB__AHM01415__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuuugccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuucccaucaugcacgaccggaccaagauccgccagcugcccaaccuccugcggggguacgagcacauccgccugucgacccacaacgugaucaacgccgaggacgcgccgggcgggcccuacaagaucggcaccuccgggaguugccccaacgucacgaacggcaacggcuucuucgccaccauggccugggccgugcccaagaacgacaagaacaagaccgcgaccaacccgcucacgaucgaggugcccuacaucuguaccgagggggaggaccagaucaccgucuggggcuuccacuccgacaacgagacccagauggccaagcuguacggggacucgaagccccagaaguucacguccagcgccaacggcgugaccacccauuacgugucccagaucggcggguuccccaaccagaccgaggacggcgggcugccgcagucgggccggaucgucaucgacuacauggugcagaaguccgggaagacgggcaccaucaccuaccagcgcggcauccuccugccccagaagguguggugcgccagcgggcgguccaaggucaucaagggcucgcugccccucaucggggaggccgauugccugcacgagaaguacggcgggcugaacaagagcaagcccuacuacaccggcgagcacgcgaaggccaucggcaacugcccgaucugggugaagacgccccucaagcuggccaacgggaccaaguaucgcccgcccgccaagcugcucaaggagcggggcuucuucggggccaucgcgggcuuccuggagggcgggugggagggcaugaucgccggguggcacggcuacaccucccacggggcccacggcguggccgucgccgcggaccugaaguccacccaggaggccaucaacaagaucacgaagaaccucaacucccugagugagcuggaggugaagaaccuccagcgccuguccggcgccauggacgagcugcacaacgagauccucgagcuggacgagaaggucgacgaccugcgggccgacaccaucagcucccagaucgagcucgccgugcugcugucgaacgaggggaucaucaauuccgaggacgagcaccuccuggcgcuggagcgcaagcucaagaagaugcugggccccagcgccguggagaucgggaacggcugcuucgagaccaagcacaagugcaaccagaccugccuggaccggaucgccgccgggaccuuugacgcgggcgaguucucccuccccacguucgacucgcugaacaucaccgccgccucccugaacgacgacggccucgacaaccauaccauccugcuguacuacagcaccgccgccuccucgcuggcggucacgcucaugaucgccaucuucgugguguacauggucucccgcgacaacgugagcugcuccaucugccuguga

SEQ ID NO: 15969 - RNA, 1758 nt, Artificial Sequence
  derived and/or modified CDS sequence (AUadapt) from InfluenzaB__AHM01426__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugucccaagugccugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaucuccugcggggguacgagcacauccgccugucgacccacaacgugaucaacgccgagaacgcgccgggcgggcccuacaagaucggcaccuccgggagcugccccaacgucacgaacggcaauggcuucuucgccaccauggccugggccgugcccaagaacgacaagaacaagaccgcgaccaacccgcucacgaucgaggugcccuacaucugcaccgagggggaggaccagaucaccaucuggggcuuccacuccgacaaugagacccagauggccaagcuguacggggacucgaacccccagaaguucacguccucggccaacggcgucaccacccacuacgugucccagaucggcggguuccccaaccagaccgaggacggcgggcugccgcagaguggccggaucguggucgacuacauggugcagaaguccgggaagacgggcaccaucaccuaccagcgcggcauccuccugccccagaagguguggugcgccucggggcgguccaaggucaucaagggcagccugccccucaucggggaggccgacugccugcacgagaaguacggcgggcugaacaagucgaagcccuauuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccauggcguggccgucgccgcggaccugaaguccacccaggaggccaucaacaagaucacgaagaaccucaacucccugagcgagcuggaggugaagaaccuccagcgccuguccggcgccauggacgagcugcacaacgagauccucgagcuggacgagaaggucgacgaccugcgggccgauaccaucucgucccagaucgagcucgccgugcugcugucgaacgaggggaucaucaacuccgaggacgagcaccuccuggcgcuggagcgcaagcucaagaagaugcugggccccagcgccguggagaucgggaacggcugcuucgagaccaagcacaagugcaaucagaccugccuggaccggaucgccgccgggaccuucgacgcgggcgaguucucccuccccacguucgacucgcugaacaucaccgccgccucccugaacgacgacggccucgauaaccacaccauccugcuguacuacagcaccgccgccuccucgcuggcggucacgcucaugaucgccaucuucgugguguacauggucucccgcgacaacgugagcugcuccaucugccuguga

SEQ ID NO: 15970 - RNA, 1755 nt, Artificial Sequence
  derived and/or modified CDS sequence (AUadapt) from InfluenzaB__AHM01437__HA
augaaggccgugaucguccugcucaugguggugaccaguaacgccgaccgcaucugcaccggcaucacguccagcaacagcccccacgucgugaagaccgcgacccagggggaggugaaugucaccggcgugaucccgcugacgaccacccccaccaaguccuacuucgccaaccugaaggggacgaagacccggggcaagcucugccccgacugccugaacugcaccgaucuggacguggcccucgggcgccccaugugcgucggcaccacgccguccgccaaggccagcauccugcacgaggugcggcccgugaccuccggcugcuuccccaucaugcacgaucgcaccaagauccggcagcuggcgaaccuccugcgcggguacgagaacauccggcugucgacccagaacgucaucgacgccgagaaggcccccggcgggccguaccgccucggcacguccgggagcugucccaacgccaccuccaagagcggcuucuucgcgaccauggccugggccgugcccaaggacaacaacaagaaugccaccaacccccugacgguggaggucccguacaucugcgccgaggaggaggaccagaucaccguguggggcuuccacuccgacaacaagacccagaugaagaaucuguacggggacagcaacccccagaaguucaccuccucggcgaacggcgugacgacccauuacgucucccagaucgggggcuuccccgaccagaccgaggacggcgggcucccccagagcggccggaucgugguggacuacaugaugcagaagccggggaagaccggcacgaucgucuaccagcgcggggugcugcugccccagaagguguggugugccuccggccggagcaaggucaucaagggcagccucccccugaucggggaggccgacugccugcacgagaaguacggcgggcucaacaaguccaagcccuauuacaccggcgagcacgccaaggccaucgggaacugcccgaucugggugaagacgccccugaagcuggcgaacggcaccaaguaccgcccgcccgccaagcuccugaaggagcggggcuucuucggggccaucgccggcuuucuggagggcgggugggaggggaugaucgccggcuggcacggcuacaccagccacggggcgcacggcgucgccguggccgccgaccucaaguccacccaggaggccaucaacaagaucaccaagaaucugaacucgcuguccgagcucgaggugaagaaccugcagcgccugagcggggcgauggacgagcuccacaacgagauccuggagcuggacgagaaggucgaugaccuccgggccgacaccaucuccagccagaucgagcuggccgugcugcucuccaacgagggcaucaucaacagcgaggacgagcaucuccuggcccuggagcgcaagcugaagaagaugcugggccccuccgcgguggacaucgggaacggcugcuucgagacgaagcacaagugcaaccagaccugccucgaucggaucgccgccgggaccuucaacgccggcgaguucucgcugcccaccuucgacucccugaacaucaccgccgcgagucucaacgacgacgggcuggacaaccacacgauccugcuguacuacuccaccgccgccaguucccucgccgucacccugaugcuggccaucuucaucguguacauggugagccgcgacaacgucuccugcagcaucugccucuga

SEQ ID NO: 15971 - RNA, 1755 nt, Artificial Sequence
  derived and/or modified CDS sequence (AUadapt) from InfluenzaB__AHM01448__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgaagacccggggcaagcucugccccgacugccugaacuguaccgaccuggacguggcccucgggcgccccaugugcgugggcaccacgccguccgccaaggccagcauccugcacgagguccggcccgugaccuccggcugcuuccccaucaugcaugaccgcaccaagauccggcagcuggcgaaccuccugcgcggguacgagaacauccggcugucgacccagaacgugaucgacgccgagaaggcccccggcgggccguaucgccucggcacguccgggagcugccccaacgccaccuccaagagcggcuucuucgcgaccauggccugggccguccccaaggacaauaacaagaacgccaccaacccccugacggccgaggugccguacaucugcgcggagggcgaggaccagaucaccguguggggguuccauuccgacaacaagacccagaugaagaaccuguacggcgacagcaacccccagaaguuuaccuccucggccaacggggucacgacccacuacgugucccagaucggcggcuuccccgaccagaccgaggacgggggccucccccagagugggcggaucguggucgacuacaugaugcagaagccgggcaagaccgggacgaucguguaccagcgcggcgugcugcugccccagaaggucuggugcgccuccggccggagcaaggugaucaaggggagccucccccugaucggcgaggccgacugucugcacgagaaguacgggggccucaacaaguccaagcccuacuacaccggggagcacgccaaggcgaucggcaacuguccgaucugggugaagacgccccugaagcuggccaacggcaccaaguaccgcccgcccgccaagcuccugaaggagcggggguucuucggcgccaucgccggguuccuggagggcgggugggagggcaugaucgcgggcuggcacggguacaccagucacggcgcccacggggucgccguggccgccgaccucaaguccacccaggaggcgaucaacaagaucaccaagaaccugaacucgcuguccgagcucgaggucaagaaucugcagcgccugagcggcgccauggacgagcuccacaacgagauccuggagcuggacgagaagguggacgaccuccgggccgauaccaucuccagccagaucgagcuggccgugcugcucuccaacgagggcaucaucaacagcgaggacgagcaccuccuggcgcuggagcgcaagcugaagaagaugcuggggcccuccgccgucgacaucggcaaugggugcuucgagacgaagcacaagugcaaccagaccugccucgaccggaucgccgccggcaccuuuaacgccggggaguucucgcugcccaccuucgacucccugaacaucaccgcggccagccucaaugacgacggccuggacaaccacacgauccugcuguacuacuccaccgccgccaguucccucgccgugacccugaugcuggcgaucuucaucguguacauggucagccgcgacaacguguccugcagcaucugccucuga

SEQ ID NO: 15972 - RNA, 1758 nt, Artificial Sequence; identical to SEQ ID NO: 14118
  derived and/or modified CDS sequence (AUadapt) from InfluenzaB__AHM01459__HA

SEQ ID NO: 15973 - RNA, 1755 nt, Artificial Sequence
  derived and/or modified CDS sequence (AUadapt) from InfluenzaB__AHM01470__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgaagacccggggcaagcucugccccgacugccugaacuguaccgaccuggacguggcccucgggcgccccaugugcgugggcaccacgccguccgccaaggccagcauccugcacgagguccggcccgugaccuccggcugcuuccccaucaugcaugaccgcaccaagauccggcagcuggcgaaccuccugcgcggguacgagaacauccggcugagcacccagaacgugaucgacgccgagaaggcccccggcgggccguaucgccucggcacguccgggucgugccccaacgccaccuccaagagcggcuucuucgcgaccauggccugggccguccccaaggacaauaacaagaacgccaccaacccccugacgguggaggugccguacaucugcaccgagggcgaggaccagaucgccgucuggggguuccauuccgacaacaagacccagaugaagaaccuguacggcgacagcaacccccagaaguuuaccuccagcgcgaacggggugacgacccacuacgugucccagaucggcggcuuccccgaccagaccgaggacgggggccucccccagagugggcggaucgucguggacuacaugaugcagaagccgggcaagaccgggacgaucguguaccagcgcggcguccugcugccccagaagguguggugcgccuccggccggagcaaggugaucaaggggucgcucccccugaucggcgaggccgacugucugcacgagaaguacgggggccucaacaaguccaagcccuacuacaccggggagcacgccaaggccaucggcaacuguccgaucugggucaagacgccccugaagcuggcgaacggcaccaaguaccgcccgcccgccaagcuccugaaggagcggggguucuucggcgccaucgccggguuccuggagggcgggugggagggcaugaucgccggcuggcacggguacaccagucacggcgcgcacgggguggccgucgccgccgaccucaaguccacccaggaggccgugaacaagaucaccaagaaccugaacagccuguccgagcucgaggugaagaaucugcagcgccugagcggcgcgauggacgagcuccacaacgagauccuggagcuggacgagaaggucgacgaccuccgggccgauaccaucuccagccagaucgagcuggccgugcugcucuccaacgagggcaucaucaacucggaggacgagcaccuccuggcccuggagcgcaagcugaagaagaugcuggggcccuccgcgguggacaucggcaaugggugcuucgagacgaagcacaagugcaaccagaccugccucgaccggaucgccgccggcaccuuuaacgccggggaguucagccugcccaccuucgacucccugaacaucaccgccgcgagccucaaugacgacggccuggacaaccacacgauccugcuguacuacuccaccgccgccaguucccucgccgucacccugaugcuggccaucuucaucguguacauggugagccgcgacaacgucuccugcagcaucugccucuga

SEQ ID NO: 15974 - RNA, 1755 nt, Artificial Sequence
  derived and/or modified CDS sequence (AUadapt) from InfluenzaB__AHM01481__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaaguccuacuucgccaaccugaaggggacgaagacccggggcaagcucugccccgacugccugaauugcaccgaccuggacguggcccucgggcgccccaugugcgugggcaccacgccguccgccaaggccagcauccugcacgagguccggcccgugaccuccggcuguuuccccaucaugcacgaccgcaccaagauccggcagcuggcgaaccuccugcgcggguacgagaacauccggcugagcacccagaaugugaucgacgccgagaaggcccccggcgggccguaccgccucggcacguccgggagcugccccaacgccaccuccaagagcggcuucuuugcgaccauggccugggccguccccaaggacaacaacaagaacgccaccaacccccugacgguggaggugccguacaucugugccgagggcgaggaccagaucaccgucuggggguuccacuccgacaacaagacccagaugaagaaccuguacggcgauucgaacccccagaaguucaccuccagcgcgaacggggugacgacccacuacgugucccagaucggcggcuuucccgaccagaccgaggacgggggccucccccagagcgggcggaucgucguggacuacaugaugcagaagccgggcaagaccgggacgaucguguaccagcgcggcguccugcugccccagcggguguggugugccuccggccgcagcaaggugaucaaggggagccucccccugaucggcgaggccgacugccugcacgagaaguacgggggccucaacaaguccaagcccuauuacaccggggagcacgccaaggccaucggcaacugcccgaucugggucaagacgccccugaagcuggcgaacggcaccaaguaccggccgcccgccaagcuccugaaggagcgcggguuuuucggcgccaucgccggguuccuggagggcgggugggagggcaugaucgccggcuggcacggguacaccagccacggcgcgcacgggguggccgucgccgccgaucucaaguccacccaggaggccaucaacaagaucaccaagaaccugaacagccuguccgagcucgaggugaagaaccugcagcggcugucgggcgcgauggacgagcuccauaacgagauccuggagcuggacgagaagguggacgaccuccgcgccgacaccaucuccagccagaucgagcuggccguccugcucuccaaugagggcaucaucaacagcgaggacgagcaccuccuggcccuggagcggaagcugaagaagaugcuggggcccuccgcgguggacaucggcaacgggugcuuugagacgaagcacaagugcaaccagaccugccucgaccgcaucgccgccggcaccuucaacgccggggaguuuagccugcccaccuucgacucccugaacaucaccgccgcgagccucaacgaugacggccuggacaaccacacgauccugcuguacuacuccaccgccgccagcucccucgccgugacccugaugcuggccaucuuuaucgucuacauggugagccgggacaacguguccugcagcaucugccucuga

SEQ ID NO: 15975 - RNA, 1755 nt, Artificial Sequence; identical to SEQ ID NO: 14639
  derived and/or modified CDS sequence (AUadapt) from InfluenzaB__AHM01492__HA

SEQ ID NO: 15976 - RNA, 1755 nt, Artificial Sequence; identical to SEQ ID NO: 14116
  derived and/or modified CDS sequence (AUadapt) from InfluenzaB__AHM01503__HA

SEQ ID NO: 15977 - RNA, 1755 nt, Artificial Sequence; identical to SEQ ID NO: 14116
  derived and/or modified CDS sequence (AUadapt) from InfluenzaB__AHM01514__HA

SEQ ID NO: 15978 - RNA, 1755 nt, Artificial Sequence
  derived and/or modified CDS sequence (AUadapt) from InfluenzaB__AHM01525__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgaagacccggggcaagcucugccccgacugccugaacugcaccgaucuggacguggcccucgggcgccccaugugcgugggcaccacgccguccgccaaggccagcauccugcacgagguccggcccgugaccuccggcugcuuccccaucaugcacgaucgcaccaagauccggcagcuggcgaaccuccugcgcggguacgagaacauccggcugucgacccagaacgugaucgacgccgagaaggcccccggcgggccguaccgccucggcacguccgggagcugucccaacgccaccuccaagagcggcuucuucgcgaccauggccugggccguccccaaggacaacaacaagaaugccaccaacccccugacgguggaggugccguacaucugcgccgagggcgaggaccagaucaccgucuggggguuccacuccgacaacaagacccagaugaagaaucuguacggcgacagcaacccccagaaguucaccuccucggcgaacggggugacgacccauuacgugucccagaucggcggcuuccccgaccagaccgaggacgggggccucccccagagcgggcggaucgucguggacuacaugauccagaagccgggcaagaccgggacgaucguguaccagcgcggcguccugcugccccagaagguguggugugccuccggccggagcaaggugaucaaggggagccucccccugaucggcgaggccgacugccugcacgagaaguacgggggccucaacaaguccaagcccuauuacaccggggagcacgccaaggccaucggcaacugcccgaucugggucaagacgccccugaagcuggcgaacggcaccaaguaccgcccgcccgccaagcuccugaaggagcggggguucuucggcgccaucgccggguuucuggagggcgggugggagggcaugaucgccggcuggcacggguacaccagccacggcgcgcacgggguggccgucgccgccgaccucaaguccacccaggaggccaucaacaagaucaccaagaaucugaacucgcuguccgagcucgaggugaagaaccugcagcgccugagcggcgcgauggacgagcuccacaacgagauccuggagcuggacgagaagguggaugaccuccgggccgacaccaucuccagccagaucgagcuggccguccugcucuccaacgagggcaucaucaacagcgaggacgagcaucuccuggcccuggagcgcaagcugaagaagaugcuggggcccuccgcgguggacaucggcaacgggugcuucgagacgaagcacaagugcaaccagaccugccucgaucggaucgccgccggcaccuucaacgccggggaguucucgcugcccaccuucgacucccugaacaucaccgccgcgagucucaacgacgacggccuggacaaccacacgauccugcuguacuacuccaccgccgccaguucccucgccgugacccugaugcuggccaucuucaucgucuacauggugagccgcgacaacguguccugcagcaucugccucuga

SEQ ID NO: 15979 - RNA, 1755 nt, Artificial Sequence
  derived and/or modified CDS sequence (AUadapt) from InfluenzaB__AHM01536__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuauuucgccaaccugaaggggacgaagacccggggcaagcucugccccgacugccugaacugcaccgaccuggauguggcccucgggcgccccaugugcgugggcaccacgccguccgccaaggccagcauccugcacgagguccggcccgugaccuccggcugcuuccccaucaugcacgaccgcaccaagauccggcagcuggcgaaccuccugcgcggguaugagaacauccggcugucgacccagaacgugaucgacgccgagaaggcccccggcgggccguaccgccucggcacguccgggagcugccccaacgccaccuccaagaguggcuucuucgcgaccauggccugggccguccccaaggacaacaacaagaacgccaccaacccccugacgguggaggugccguacaucugugccgagggcgaggaccagaucaccgucuggggguuccacuccgacaacaagacccagaugaagaaccuguacggcgacaguaacccccagaaguucaccuccucggcgaacggggugacgacccacuacgugucccagaucggcggcuuccccgaccagaccgaggaugggggccucccccagagcgggcggaucgucguggacuacaugaugcagaagccgggcaagaccgggacgaucguguaccagcgcggcguccugcugccccagaagguguggugcgccuccggccggagcaaggugaucaaggggagccucccccugaucggcgaggccgacugucugcacgagaaguacgggggccucaacaaguccaagcccuacuacaccggggagcacgccaaggccaucggcaacugcccgaucugggucaagacgccccugaagcuggcgaauggcaccaaguaccgcccgcccgccaagcuccugaaggagcggggguucuucggcgccaucgccggguuccuggagggcgggugggagggcaugaucgccggcuggcacggguacaccagccacggcgugcauggggucgcgguggccgccgaccucaaguccacccaggaggccaucaacaagaucaccaagaaccugaacucgcuguccgagcucgaggugaagaaccugcagcgccugagcggcgccauggacgagcuccauaacgagauccuggagcuggacgagaaggucgacgaccuccgggcggacaccaucuccagccagaucgagcuggccgugcugcucuccaacgagggcaucaucaacagugaggacgagcaccuccuggcccuggagcgcaagcugaagaagaugcuggggcccuccgccguggacaucggcaacgggugcuucgagacgaagcacaagugcaaucagaccugccucgaccggaucgcggccggcaccuucaacgccggggaguucucgcugcccaccuucgacucccugaauaucaccgccgccagccucaacgacgacggccuggacaaccacacgauccugcuguacuauuccaccgcggccagcucccucgccgucacccugaugcuggccaucuucaucguguacauggugagccgcgacaacgucuccugcagcaucugccucuga

SEQ ID NO: 15980 - RNA, 1755 nt, Artificial Sequence; identical to SEQ ID NO: 14116
  derived and/or modified CDS sequence (AUadapt) from InfluenzaB__AHM01547__HA

SEQ ID NO: 15981 - RNA, 1755 nt, Artificial Sequence; identical to SEQ ID NO: 14639
  derived and/or modified CDS sequence (AUadapt) from InfluenzaB__AHM01558__HA

SEQ ID NO: 15982 - RNA, 1758 nt, Artificial Sequence; identical to SEQ ID NO: 14090
  derived and/or modified CDS sequence (AUadapt) from InfluenzaB__AHV83951__HA

SEQ ID NO: 15983 - RNA, 1755 nt, Artificial Sequence; identical to SEQ ID NO: 14093
  derived and/or modified CDS sequence (AUadapt) from InfluenzaB__AHV83952__HA

SEQ ID NO: 15984 - RNA, 1758 nt, Artificial Sequence; identical to SEQ ID NO: 14423
  derived and/or modified CDS sequence (AUadapt) from InfluenzaB__AHZ36697__HA

SEQ ID NO: 15985 - RNA, 1758 nt, Artificial Sequence
  derived and/or modified CDS sequence (AUadapt) from InfluenzaB__AHZ36708__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucccacuucgccaaccugaaggggacggagacccggggcaagcucugccccaagugccugaauugcaccgaccuggacguggcccucgggcgccccaagugcaccggcaagaucccguccgcccgggugucgauccugcacgagguccgccccgugacguccggcugcuuccccaucaugcacgaccggaccaagauccgccagcugcccaaccuccugcggggguacgagcacauccgccugaguacccacaacgugaucaacgccgagaacgcgccgggcgggcccuacaagaucggcaccuccgggucgugccucaacgucacgaacggcaacggcuucuucgccaccauggccugggccgugcccaagaacgauaagaacaagaccgcgaccaacccccugacgaucgaggugccguacaucugcaccgagggggaggaccagaucaccgucuggggcuuccacuccgacaacgagacccagauggccaagcuguacggggacagcaagccccagaaguucacguccucggccaauggcgugaccacccacuacgugucccagaucggcggguuccccaaccagaccgaggacggcgggcucccccagucgggccggaucgucguggacuacauggugcagaaguccgggaagacgggcaccaucaccuaccagcgcggcauccugcugccgcagaaggucuggugcaccagcgggcgguccaaggugaucaagggcucgcucccccugaucggggaggccgacugucugcacgagaaguacggcgggcucaacaagagcaagcccuacuacacgggcgagcacgccaaggcgaucggcaacugccccaucugggugaagaccccgcugaagcuggccaacgggaccaaguaccgcccgcccgccaagcuccugaaggagcggggcuucuucggggccaucgccggcuuucuggagggcgggugggagggcaugaucgcgggguggcacggcuacaccucccacggggcccacggcgucgccguggccgccgaccucaagucgacgcaggaggcgaucaacaagaucaccaagaaccugaacucccugagcgagcucgaggucaagaaccugcagcgccuguccggcgccauggacgagcuccacaacgagauccuggagcuggaugagaagguggacgaccuccgggccgacaccaucucgucccagaucgagcuggccgugcugcucucgaacgaggggaucaucaacuccgaggacgagcaccuccuggcccuggagcgcaagcugaagaagaugcugggccccagcgcggucgagaucgggaacggcugcuucgagaccaagcauaagugcaaccagaccugccucgaccggaucgccgccgggacguucgacgccggcgaguucucccugcccaccuucgacucgcugaacaucaccgcggccucccucaacgacgauggccuggacaaccacaccauccugcuguacuacagcacggccgccuccucgcucgccgugacccugaugaucgcgaucuucguggucuacauggugucccgcgacaacgugagcugcuccaucugccuguga

SEQ ID NO: 15986 - RNA, 1758 nt, Artificial Sequence
  derived and/or modified CDS sequence (AUadapt) from InfluenzaB__AHZ36719__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccacuuugccaaccugaaggggacggagacccggggcaagcucugccccaagugccugaacugcaccgaccuggacguggcccucgggcgccccaagugcaccggcaagaucccguccgcccgggugucgauccugcacgagguccgccccgugacguccggcuguuuccccaucaugcacgaccggaccaagauccgccagcugcccaaccuccugcggggguacgagcacauccgccugagcacccacaacgugaucaacgccgagaaugcgccgggcgggcccuacaagaucggcaccuccgggucgugccccaacgucacgaacggcaacggcuucuucgccaccauggccugggccgugcccaagaacgacaagaauaagaccgcgaccaacccgcucacgaucgaggugcccuacgucugcaccgagggggaggaccagaucaccguguggggcuuccacuccgacaacgagacccagauggccaagcuguacggggacaguaagccccagaaguucacguccucggccaacggcgugaccacccacuacgucucccagaucggcggguuccccaaccagaccgaggacggcgggcugccgcagagcggccggaucgugguggacuauaugguccagaaguccgggaagacgggcaccaucaccuaccagcgcggcauccuccugccccagaagguguggugcgccucggggcgguccaaggugaucaagggcagccugccccucaucggggaggccgacugccugcacgagaaguacggcgggcugaacaagucgaagcccuauuacaccggcgagcacgcgaaggccaucggcaacugcccgaucugggucaagacgccccucaagcuggccaacgggaccaaguaccgcccgcccgccaagcugcucaaggagcggggcuucuucggggccaucgcgggcuuccuggagggcgggugggagggcaugaucgccggguggcacggcuauaccucccacggggcccacggcguggccgucgccgcggaccugaaguccacccaggaggccaucaacaagaucacgaagaaccucaacucccugagcgagcuggaggugaagaaccuccagcgccuguccggcgccauggacgagcugcacaaugagauccucgagcuggacgagaagguggacgaccugcgggccgacaccaucucgucccagaucgagcucgccguccugcugagcaacgaggggaucaucaacuccgaggacgagcaccuccuggcgcuggagcgcaagcucaagaagaugcugggccccagugccguggagaucgggaacggcugcuucgagaccaagcacaagugcaaccagaccugccuggaccggaucgccgccgggaccuucgacgcgggcgaguuuucccuccccacguucgacagccugaacaucaccgccgccucccugaacgacgacggccucgacaaccacaccauccugcuguauuacucgaccgccgccuccagccuggcggugacgcucaugaucgccaucuucgucguguacauggugucccgcgacaacgucagcugcuccaucugccuguga

SEQ ID NO: 15987 - RNA, 1758 nt, Artificial Sequence; identical to SEQ ID NO: 14423
  derived and/or modified CDS sequence (AUadapt) from InfluenzaB__AHZ36730__HA

SEQ ID NO: 15988 - RNA, 1758 nt, Artificial Sequence; identical to SEQ ID NO: 14423
  derived and/or modified CDS sequence (AUadapt) from InfluenzaB__AHZ36752__HA

SEQ ID NO: 15989 - RNA, 1758 nt, Artificial Sequence; identical to SEQ ID NO: 14118
  derived and/or modified CDS sequence (AUadapt) from InfluenzaB__AHZ36763__HA

SEQ ID NO: 15990 - RNA, 1758 nt, Artificial Sequence
  derived and/or modified CDS sequence (AUadapt) from InfluenzaB__AHZ36774__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagucacuucgccaaccugaaggggacggagacccggggcaagcucugccccaagugccccaacugcaccgaccuggacguggcccuggggcgcccgaaguguaccggcaagauccccuccgcccgggugucgauccuccacgagguccgccccgugacguccggcugcuuccccaucaugcacgaccggaccaagauccgccagcugccgaaccugcuccggggguacgagcauauccgccugagcacccacaacgugaucaacgccgaguccgcgcccggcgggcccuacaagaucggcaccagcggguccugccccaacgucacgaacggcaauggcuucuucgccaccauggccugggccgugccgaagaacgacaagaacaagaccgcgaccgacccccugacgaucgaggugcccuacaucugcaccgaggaggaggaucagaucaccgucuggggguuccacucggacaacgagacccagauggccaagcucuacggcgacuccaagccccagaaguucacgagcuccgccaauggggugaccacccacuacgugucgcagaucggcggcuucccgaaccagaccgaggacgggggccugccccaguccgggcggaucgucguggacuacauggugcagaaguccggcaagacggggaccaucaccuaucagcgcggcauccugcucccccagaaggucuggugcgccuccggccggagcaaggugaucaaggggagccugccccugaucggcgaggccgacugccuccacgagaaguacgggggccugaacaaguccaagccguacuauaccggggagcacgcgaaggccaucggcaacugccccaucugggugaagacgccccugaagcucgccaacggcaccaaguaccggcccccggccaagcugcugaaggagcgcggguucuucggcgccaucgcgggguuccucgagggcgggugggagggcaugaucgccggcuggcauggguacaccucgcacggcgcccacggggucgccguggccgcggaccugaaguccacccaggaggccaucaacaaggucacgaagaaccugaacagccucuccgagcuggaggugaagaaucugcagcgccucucgggcgccauggacgagcugcacaacgagauccuggagcucgacgagaagguggacgaccugcgggccgacaccaucuccagucagaucgagcuggccguccuccuguccaacgagggcaucaucaacagcgaggacgagcaccuccuggcgcuggagcgcaagcugaagaagaugcucgggcccuccgccguggagaucggcaacgggugcuucgagaccaagcacaaguguaaccagaccugccuggaccggaucgccgccggcaccuucgacgcgggggaguucucgcugcccacguucgauucccucaacaucaccgccgccagccugaacgacgacggccuggacaaccacaccauccuccuguacuauuccaccgccgccucgucccuggcggugacgcugaugaucgccaucuucgucguguacauggugagccgcgacaacgucuccugcagcaucugccucuga

SEQ ID NO: 15991 - RNA, 1758 nt, Artificial Sequence; identical to SEQ ID NO: 15899
  derived and/or modified CDS sequence (AUadapt) from InfluenzaB__AHZ36785__HA

SEQ ID NO: 15992 - RNA, 1758 nt, Artificial Sequence; identical to SEQ ID NO: 15899
  derived and/or modified CDS sequence (AUadapt) from InfluenzaB__AHZ36796__HA

SEQ ID NO: 15993 - RNA, 1755 nt, Artificial Sequence
  derived and/or modified CDS sequence (AUadapt) from InfluenzaB__AHZ36807__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuauuucgccaaccugaaggggacgaagacccggggcaagcucugccccgacugccugaacugcaccgaccuggauguggcccucgggcgccccaugugcgugggcaccacgccguccgccaaggccucgauccugcacgagguccggcccgugaccuccggcugcuuccccaucaugcacgaccgcaccaagauccggcagcuggcgaaccuccugcgcggguaugagaacauccggcugagcacccagaacgugaucgacgccgagaaggcccccggcgggccguaccgccucggcacguccgggagcugccccaacgccaccuccaagaguggcuucuucgcgaccauggccugggccguccccaaggacaacaacaagaacgccaccaacccccugacgguggaggugccguacaucugugccgagggcgaggaccagaucaccgucuggggguuccacuccgacaacaagacccagaugaagaaccuguacggcgacaguaacccccagaaguucaccuccagcgcgaacggggugacgacccacuacgugucccagaucggcggcuuccccgaccagaccgaggaugggggccucccccagagcgggcggaucgucguggacuacaugaugcagaagccggagaagaccggcacgaucguguaccagcgcgggguccugcugccccagaagguguggugcgccuccggccggagcaaggugaucaagggcucgcucccccugaucggggaggccgacugucugcacgagaaguacggcgggcucaacaaguccaagcccuacuacaccggcgagcacgccaaggccaucgggaacugcccgaucugggucaagacgccccugaagcuggcgaauggcaccaaguaccgcccgcccgccaagcuccugaaggagcggggcuucuucggggccaucgccggcuuccuggagggcgggugggaggggaugaucgccggcuggcacggcuacaccagccacggggcgcauggcguggccgucgccgccgaccucaaguccacccaggaggccaucaacaagaucaccaagaaccugaacagccuguccgagcucgaggugaagaaccugcagcgccugucgggggcgauggacgagcuccauaacgagauccuggagcuggacgagaagguggacgaccuccgggccgacaccaucuccagccagaucgagcuggccguccugcucuccaacgagggcaucaucaacagugaggacgagcaccuccuggcccuggagcgcaagcugaagaagaugcugggccccuccgcgguggacaucgggaacggcugcuucgagacgaagcacaagugcaaucagaccugccucgaccggaucgccgccgggaccuucaacgccggcgaguucagccugcccaccuucgacucccugaauaucaccgccgcgucgcucaacgacgacgggcuggacaaccacacgauccugcuguacuauuccaccgccgccagcucccucgccgugacccugaugcuggccaucuucaucgucuacauggugagccgcgacaacguguccugcagcaucugccucuga

SEQ ID NO: 15994 - RNA, 1758 nt, Artificial Sequence; identical to SEQ ID NO: 14423
  derived and/or modified CDS sequence (AUadapt) from InfluenzaB__AHZ36818__HA

SEQ ID NO: 15995 - RNA, 1758 nt, Artificial Sequence; identical to SEQ ID NO: 14118
  derived and/or modified CDS sequence (AUadapt) from InfluenzaB__AHZ36829__HA

SEQ ID NO: 15996 - RNA, 1758 nt, Artificial Sequence; identical to SEQ ID NO: 14118
  derived and/or modified CDS sequence (AUadapt) from InfluenzaB__AHZ36840__HA

SEQ ID NO: 15997 - RNA, 1758 nt, Artificial Sequence; identical to SEQ ID NO: 15899
  derived and/or modified CDS sequence (AUadapt) from InfluenzaB__AHZ36851__HA

SEQ ID NO: 15998 - RNA, 1758 nt, Artificial Sequence; identical to SEQ ID NO: 14423
  derived and/or modified CDS sequence (AUadapt) from InfluenzaB__AHZ36862__HA

SEQ ID NO: 15999 - RNA, 1758 nt, Artificial Sequence; identical to SEQ ID NO: 14118
  derived and/or modified CDS sequence (AUadapt) from InfluenzaB__AHZ36873__HA

SEQ ID NO: 16000 - RNA, 1758 nt, Artificial Sequence
  derived and/or modified CDS sequence (AUadapt) from InfluenzaB__AHZ36884__HA
augaaggccaucaucgugcugcucauggucgugaccaguaacgccgaccgcaucugcaccggcaucacguccucgaacagcccccacaucgugaagaccgcgacccagggggaggucaacgugaccggcgugaucccgcugacgaccacccccaccaagucgcacuucgccaaccugaaggggacggagacccggggcaagcucugccccaagugccugaauugcaccgaccuggacgucgcccucgggcgccccaagugcaccggcaagaucccguccgcccgggugucgauccugcacgaggugcgccccgucacguccggcugcuuccccaucaugcacgaccggaccaagauccgccagcugcccaaccuccugcggggguacgagcacauccgccugagcacccacaaugugaucaacgccgagaacgcgccgggcgggcccuacaagaucggcaccuccgggucgugccccaacaucacgaacggcaacggcuucuucgagaccauggccugggccgugcccaagaacgacaagaacaagaccgccaccaacccgcucacgaucgagguccccuacaucuguaccgagggggaggaccagaucaccguguggggcuuccacuccgacaacgagacccagauggcgaagcuguacggggacucgaagccccagaaguucacguccagcgccaacggcgugaccacccacuacgucucccagaucggcggguuccccaaccagaccgaggauggcgggcugccgcagucgggccggaucgugguggacuacaugguccagaaguccgggaagacgggcaccaucaccuaccagcgcggcauccuccugccccagaagguguggugcgccucggggcgguccaaggugaucaagggcagccugccccucaucggggaggccgacugccugcacgagaaguacggcgggcugaacaagucgaagcccuacuacaccggcgagcaugccaaggcgaucggcaacugcccgaucugggucaagacgccccucaagcuggccaacgggaccaaguaccgcccgcccgccaagcugcucaaggagcggggcuucuucggggccaucgccggcuuccuggagggcgggugggagggcaugaucgcgggguggcacggcuacaccucccacggggcccacggcguggccguggccgccgaccugaaguccacccaggaggcgaucaacaagaucacgaagaaccucaacucccugagugagcuggaggucaagaaccuccagcgccuguccggcgccauggacgagcugcacaacgagauccucgagcuggacgagaagguggacgaccugcgggccgacaccaucagcucccagaucgagcucgccguccugcugucgaacgaggggaucaucaacuccgaggacgagcaccuccuggcccuggagcgcaagcucaagaagaugcugggccccucggcgguggagaucgggaauggcugcuucgagaccaagcacaagugcaaccagaccugccuggaccggaucgccgccgggaccuucgacgccggcgaguucucccuccccacguucgacagccugaacaucaccgcggccucccugaacgaugacggccucgacaaccacaccauccugcuguacuacucgaccgccgccuccucgcuggccgugacgcucaugaucgcgaucuucgucguguacauggugucccgcgacaacgucagcugcuccaucugccuguga

SEQ ID NO: 16001 - RNA, 1758 nt, Artificial Sequence; identical to SEQ ID NO: 14423
  derived and/or modified CDS sequence (AUadapt) from InfluenzaB__AHZ36895__HA

SEQ ID NO: 16002 - RNA, 1758 nt, Artificial Sequence; identical to SEQ ID NO: 14423
  derived and/or modified CDS sequence (AUadapt) from InfluenzaB__AHZ36906__HA

SEQ ID NO: 16003 - RNA, 1758 nt, Artificial Sequence
  derived and/or modified CDS sequence (AUadapt) from InfluenzaB__AHZ36928__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucccacuucgccaaccugaaggggacgaagacccggggcaagcucugccccaagugccugaauugcaccgaccuggacguggcccucgggcgccccaagugcaccggcaagaucccguccgcccgggugucgauccugcacgagguccgccccgugacguccggcugcuuccccaucaugcacgaccggaccaagauccgccagcugcccaaccuccugcggggguacgagcacauccgccugaguacccacaacgugaucaacgccgagaacgcgccgggcgggcccuacaagaucggcaccuccgggucgugccucaacgucacgaacggcaacggcuucuucgccaccauggccugggccgugcccaagaacgauaagaacaagaccgcgaccaacccccugacgaucgaggugccguacaucugcaccgagggggaggaccagaucaccgucuggggcuuccacuccgacaacgagacccagauggccaagcuguacggggacagcaagccccagaaguucacguccucggccaauggcgugaccacccacuacgugucccagaucggcggguuccccaaccagaccgaggacggcgggcucccccagucgggccggaucgucguggacuacauggugcagaaguccgggaagacgggcaccaucaccuaccagcgcggcauccugcugccgcagaaggucuggugcgccagcgggcgguccaaggugaucaagggcucgcucccccugaucggggaggccgacugucugcacgagaaguacggcgggcucaacaagagcaagcccuacuacaccggcgagcacgcgaaggccaucggcaacugccccaucugggugaagacgccgcugaagcuggccaacgggaccaaguaccgcccgcccgccaagcuccugaaggagcggggcuucuucggggccaucgcgggcuuucuggagggcgggugggagggcaugaucgccggguggcacggcuacaccucccacggggcccacggcgucgccguggccgcggaccucaagucgacccaggaggccaucaacaagaucacgaagaaccugaacucccugagcgagcucgaggucaagaaccugcagcgccuguccggcgccauggacgagcuccacaacgagauccuggagcuggaugagaagguggacgaccuccgggccgacaccaucucgucccagaucgagcuggccgugcugcucucgaacgaggggaucaucaacuccgaggacgagcaccuccuggcgcuggagcgcaagcugaagaagaugcugggccccagcgccgucgagaucgggaacggcugcuucgagaccaagcauaagugcaaccagaccugccucgaccggaucgccgccgggaccuucgacgcgggcgaguucucccugcccacguucgacucgcugaacaucaccgccgccucccucaacgacgauggccuggacaaccacaccauccugcuguacuacagcaccgccgccuccucgcucgcggugacgcugaugaucgccaucuucguggucuacauggugucccgcgacaacgugagcugcuccaucugccuguga

SEQ ID NO: 16004 - RNA, 1758 nt, Artificial Sequence; identical to SEQ ID NO: 15899
  derived and/or modified CDS sequence (AUadapt) from InfluenzaB__AHZ36939__HA

SEQ ID NO: 16005 - RNA, 1758 nt, Artificial Sequence
  derived and/or modified CDS sequence (AUadapt) from InfluenzaB__AHZ36950__HA
augaaggccaucaucgugcugcucauggucgugaccaguaacgccgaccgcaucugcaccggcaucacguccucgaacagcccccacaucgugaagaccgcgacccagggggaggucaacgugaccggcgugaucccgcugacgaccacccccaccaagucgcacuucgccaaccugaaggggacggagacccggggcaagcucugccccaagugccugaauugcaccgaccuggacgucgcccucgggcgccccaagugcaccggcaagaucccguccgcccgggugucgauccugcacgaggugcgccccaucacguccggcugcuuccccaucaugcacgaccggaccaagauccgccagcugcccaaccuccugcggggguacgagcacauccgccugagcacccacaaugucaucaacgccgagaacgcgccgggcgggcccuacaagaucggcaccuccgggucgugccccaacaucacgaacggcaacggcuucuucgccaccauggccugggccgugcccaagaacgacaagaacaagaccgcgaccaacccgcucacgaucgaggugcccuacaucuguaccgagggggaggaccagaucaccgucuggggcuuccacuccgacaacgagacccagauggccaagcuguacggggacucgaagccccagaaguucacguccagcgccaacggcgugaccacccacuacgugucccagaucggcggguuccccaaccagaccgaggauggcgggcugccgcagucgggccggaucgucguggacuacauggugcagaaguccgggaagacgggcaccaucaccuaccagcgcggcauccuccugccccagaaggucuggugcgccucggggcgguccaaggugaucaagggcagccugccccucaucggggaggccgacugccugcacgagaaguacggcgggcugaacaagucgaagcccuacuacaccggcgagcaugcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagugagcuggaggugaagaaccuccagcgccuguccggcgccauggacgagcugcacaacgagauccucgagcuggacgagaaggucgacgaccugcgggccgacaccaucagcucccagaucgagcucgccgugcugcugucgaacgaggggaucaucaacuccgaggacgagcaccuccuggcgcuggagcgcaagcucaagaagaugcugggccccucggccgucgagaucgggaauggcugcuucgagaccaagcacaagugcaaccagaccugccuggaccggaucgccgccgggaccuucgacgcgggcgaguucucccuccccacguucgacagccugaacaucaccgccgccucccugaacgaugacggccucgacaaccacaccauccugcuguacuacucgaccgccgccuccucgcuggcggugacgcucaugaucgccaucuucguggucuacauggugucccgcgacaacgugagcugcuccaucugccuguga

SEQ ID NO: 16006 - RNA, 1758 nt, Artificial Sequence
  derived and/or modified CDS sequence (AUadapt) from InfluenzaB__AHZ36961__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuuugccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuucccaucaugcacgaccggaccaagauccgccagcugcccaaccuccugcggggguacgagcacauccgccugucgacccacaacgugaucaacgccgagaacgcgccgggcgggcccuacaagaucggcaccuccgggaguugccccaacgucacgaacggcaacggcuucuucgccaccauggccugggccgugcccaagaacgacaagaacaagaccgcgaccaacccgcucacgaucgaggugcccuacaucuguaccgagggggaggaccagaucaccgucuggggcuuccacuccgacaacgagacccagauggccaagcuguacggggacucgaagccccagaaguucacguccagcgccaacggcgugaccacccauuacgugucccagaucggcggguuccccaaccagaccgaggacggcgggcugccgcagucgggccggaucgucguggacuacauggugcagaaguccgggaagacgggcaccaucaccuaccagcgcggcauccuccugccccagaaggucuggugcgccagcgggggcuccaaggugaucaaggggucgcugccccucaucggcgaggccgauugccugcacgagaaguacgggggccugaacaagagcaagcccuacuacaccggcgagcacgcgaaggccaucgggaacugcccgaucugggugaagacgccccucaagcuggccaacggcaccaaguaucggccgcccgccaagcugcucaaggagcgcggguucuucggcgccaucgcgggguuccuggagggcggcugggaggggaugaucgccggcuggcacggguacaccucccacggcgcccacggcgucgccguggccgcggaccugaaguccacccaggaggccaucaacaagaucacgaagaaccucaacucccugagugagcuggaggucaagaaccuccagcggcuguccggggccauggacgagcugcacaacgagauccucgagcuggacgagaagguggacgaccugcgcgccgacaccaucagcucccagaucgagcucgccgugcugcugucgaacgagggcaucaucaauuccgaggacgagcaccuccuggcgcuggagcggaagcucaagaagaugcuggggcccagcgccgucgagaucggcaacgggugcuucgagaccaagcacaagugcaaccagaccugccuggaccgcaucgccgccggcaccuuugacgcgggcgaguucucccuccccacguucgacucgcugaacaucaccgccgccucccugaacgacgacgggcucgacaaccauaccauccugcuguacuacagcaccgccgccuccucgcuggcggugacgcucaugaucgccaucuucguggucuacauggugucccgggacaacgugagcugcuccaucugccuguga

SEQ ID NO: 16007 - RNA, 1758 nt, Artificial Sequence; identical to SEQ ID NO: 14423
  derived and/or modified CDS sequence (AUadapt) from InfluenzaB__AHZ36972__HA

SEQ ID NO: 16008 - RNA, 1758 nt, Artificial Sequence
  derived and/or modified CDS sequence (AUadapt) from InfluenzaB__AHZ36983__HA
augaaggccaucaucgugcugcucauggucgugaccaguaacgccgaccgcaucugcaccggcaucacguccucgaacagcccccacaucgugaagaccgcgacccagggggaggucaacgugaccggcgugaucccgcugacgaccacccccaccaagucgcacuucgccaaccugaaggggacggagacccggggcaagcucugucccaagugccugaacugcaccgaccuggacgucgcccucgggcgccccaagugcaccggcaagaucccguccgcccgggugagcauccugcacgaggugcgccccgucacguccggcugcuuccccaucaugcacgaccggaccaagauccgccagcugcccaaucuccugcggggguacgagcacauccgccugucgacccacaacgugaucaacgccgagaacgcgccgggcgggcccuacaagaucggcaccuccgggagcugccccaacaucacgaacggcaauggcuucuucgccaccauggccugggccgugcccaagaacgacaagaacaagaccgcgaccaacccgcucacgaucgagguccccuacaucugcaccgagggggaggaccagaucaccguguggggcuuccacuccgacaaugagacccagauggccaagcuguacggggacucgaagccccagaaguucacguccucggccaacggcgugaccgcccacuacgucucccagaucggcggguuccccaaccagaccgaggacggcgggcugccgcagagcggccggaucgugguggauuacaugguccagaaguccgggaagaccggcacgaucaccuaccagcgcggcauccuccugccccagaagguguggugcgccucggggcgguccaaggugaucaagggcagccugccccucaucggggaggcggacugccugcacgagaaguacggcgggcugaacaagucgaagcccuacuauaccggcgagcacgccaaggccaucggcaacugcccgaucugggucaagacgccccucaagcuggccaacgggaccaaguaccgcccgcccgccaagcugcucaaggagcggggcuucuucggggcgaucgccggcuuccuggagggcgggugggagggcaugaucgccggguggcacggcuacaccucccacggggcccacggcguggccguggcggccgaucugaaguccacccaggaggccaucaacaagaucaccaagaaccucaacucccugagcgagcuggaggucaagaaccuccagcgccuguccggcgccauggacgagcugcacaacgagauccucgagcuggacgagaagguggacgaccugcgggccgacacgaucaguucccagaucgagcucgcgguccugcugucgaacgaggggaucaucaacuccgaggacgagcaccuccuggcccuggagcgcaagcucaagaagaugcugggccccagcgccguggagaucgggaacggcugcuucgagaccaagcacaagugcaaccagaccugucuggaccggaucgccgcggggaccuucgacgccggcgaguucucccuccccaccuucgacucgcugaacaucacggccgccucccugaacgacgacggccucgacaaucacaccauccugcuguacuacagcaccgccgcguccucgcuggccgugacccucaugaucgccaucuucgucguguacauggugucccgcgacaacgucagcugcuccaucugccuguga

SEQ ID NO: 16009 - RNA, 1758 nt, Artificial Sequence
  derived and/or modified CDS sequence (AUadapt) from InfluenzaB__AHZ37005__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccauuucgccaaccugaaggggacggagacccggggcaagcucugccccaagugccccaacugcaccgaccuggacguggcccuggggcgcccgaagugcaccggcaagauccccuccgcccgggugaguauccuccacgagguccgccccgugacguccggcugcuuccccaucaugcacgaccggaccaagauccgccagcugccgaaccugcuccggggguacgagcacauccgccugagcacccauaacgugaucaacgccgaguccgcgcccggcgggcccuacaagaucggcaccucgggguccugccccaacgucacgaacggcaacggcuucuuugccaccauggccugggccgugccgaagaacgacaagaacaagaccgcgaccgacccccugacgaucgaggugcccuacaucugcaccgaggaggaggaccagaucaccgucuggggguuccacagcgauaacgagacccagauggccaagcucuacggcgacuccaagccccagaaguucacgucguccgccaacggggugaccacccacuacgugagccagaucggcggcuuuccgaaccagaccgaggacgggggccugccccaguccgggcggaucgucguggacuacauggugcagaaguccggcaagacggggaccaucaccuaccagcgcggcauccugcucccccagaaggucuggugcgccuccggccggagcaaggugaucaaggggucgcugccccugaucggcgaggccgacugucuccacgagaaguacgggggccugaacaaguccaagccguacuacaccggggagcacgcgaaggccaucggcaacugccccaucugggugaagacgccccugaagcucgccaacggcaccaaguaucggcccccggccaagcugcugaaggagcgcggguucuucggcgccaucgcgggguuccucgagggcgggugggagggcaugaucgccggcuggcacggguacaccagccacggcgcccacggggucgccguggccgcggaccugaaguccacccaggaggccaucaauaagaucacgaagaaccugaacucgcucuccgagcuggaggucaagaaccugcagcgccucagcggcgccauggacgagcugcacaacgagauccuggagcucgacgagaagguggacgaucugcgggccgacaccaucuccucgcagaucgagcuggccgugcuccuguccaacgagggcaucaucaacagcgaggacgagcaccuccuggcgcuggagcgcaagcugaagaagaugcucgggcccuccgccgucgagaucggcaacgggugcuuugagaccaagcacaagugcaaccagaccugccuggaccggaucgccgccggcaccuucgacgcgggggaguucucgcugcccacguuugacucccucaacaucaccgccgccagccugaacgacgacggccuggacaaccacaccauccuccuguauuacuccaccgccgccucgucccuggcggugacgcugaugaucgccaucuucguggucuacauggugagccgcgacaacguguccugcagcaucugccucuga

SEQ ID NO: 16010 - RNA, 1758 nt, Artificial Sequence; identical to SEQ ID NO: 14118
  derived and/or modified CDS sequence (AUadapt) from InfluenzaB__AHZ37016__HA

SEQ ID NO: 16011 - RNA, 1758 nt, Artificial Sequence
  derived and/or modified CDS sequence (AUadapt) from InfluenzaB__AHZ37027__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugccccaagugucugaacugcaccgaccuggacguggcccucgggcgccccaagugcaccggcaagaucccguccgcccgggugagcaucauccacgagguccgccccgugacguccggcugcuuccccaucaugcacgaccggaccaagauccgccagcugcccaaccugcuccggggguacgagcauauccgccugucgacccacaacgugaucaacgccgagaacgcgccgggcgggcccuacaagaucggcaccuccgggagcugccugaacgucacgaacggcaacggcuucuucgccaccauggccugggccgugcccaagaaugacaagaacaagaccgcgaccaacccccucacgaucgaggugccguacaucugcaccgagggggaggaccagaucaccgucuggggcuuccacuccgacaacgagacccagauggccaagcuguacggggacucgaagccccagaaguucacguccagugccaacggcgugaccacccacuacgugucccagaucggcggguuccccaaccagaccgaggacggcgggcugccccagagcggccggaucgucguggacuacauggugcagaaguccgggaagacgggcaccaucaccuaccagcgcggcauccuccugccgcagaaggucuggugcgccucggggcgguccaaggugaucaagggcagccugccccucaucggggaggccgauugccugcacgagaaguacggcgggcugaacaagucgaagcccuacuacaccggcgagcacgcgaaggccaucggcaacugccccaucugggugaagacgccgcucaagcuggccaacgggaccaaguaccgcccgcccgccaagcugcucaaggagcggggcuucuuuggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagcgagcuggaggucaagaaccuccagcgccuguccggcgccauggacgagcugcacaacgagauccucgagcuggaugagaagguggacgaccugcgggccgacaccaucucgucccagaucgagcucgccgugcugcugucgaacgaggggaucaucaacuccgaggacgagcaccuccuggcgcuggagcgcaagcucaagaagaugcugggccccagcgccgucgagaucgggaacggcugcuucgagaccaagcauaagugcaaccagaccugccuggaccggaucgccgccgggaccuucgacgcgggcgaguucucccuccccacguucgacucgcugaacaucaccgccgccucccugaacgacgauggccucgacaaccacaccauccugcuguacuacagcaccgccgccuccucgcuggcggugacgcucaugaucgccaucuucguggucuacauggugucccgcgacaacgugagcugcuccaucugccuguga

SEQ ID NO: 16012 - RNA, 1758 nt, Artificial Sequence; identical to SEQ ID NO: 14118
  derived and/or modified CDS sequence (AUadapt) from InfluenzaB__AHZ37038__HA

SEQ ID NO: 16013 - RNA, 1758 nt, Artificial Sequence; identical to SEQ ID NO: 15899
  derived and/or modified CDS sequence (AUadapt) from InfluenzaB__AHZ37049__HA

SEQ ID NO: 16014 - RNA, 1758 nt, Artificial Sequence; identical to SEQ ID NO: 15899
  derived and/or modified CDS sequence (AUadapt) from InfluenzaB__AHZ37060__HA

SEQ ID NO: 16015 - RNA, 1758 nt, Artificial Sequence; identical to SEQ ID NO: 14118
  derived and/or modified CDS sequence (AUadapt) from InfluenzaB__AHZ37071__HA

SEQ ID NO: 16016 - RNA, 1758 nt, Artificial Sequence; identical to SEQ ID NO: 14118
  derived and/or modified CDS sequence (AUadapt) from InfluenzaB__AHZ37082__HA

SEQ ID NO: 16017 - RNA, 1758 nt, Artificial Sequence; identical to SEQ ID NO: 15899
  derived and/or modified CDS sequence (AUadapt) from InfluenzaB__AHZ37093__HA

SEQ ID NO: 16018 - RNA, 1758 nt, Artificial Sequence
  derived and/or modified CDS sequence (AUadapt) from InfluenzaB__AHZ37104__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuuugccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcuguuuccccaucaugcacgaccggaccaagauccgccagcugcccaaccuccugcggggguacgagcacauccgccugucgacccacaacgugaucaacgccgagaaugcgccgggcgggcccuacaagaucggcaccuccgggagcugccccaacgucacgaacggcaacggcuucuucgccaccauggccugggccgugcccaagaacgacaagaauaagaccgcgaccaacccgcucacgaucgaggugcccuacaucugcaccgagggggaggaccagaucaccgucuggggcuuccacuccgacaacgagacccagauggccaagcuguacggggacaguaagccccagaaguucacguccagcgccaacggcgugaccacccacuacgugucccagaucggcggguuccccaaccagaccgaggacggcgggcugccgcagucgggccggaucgucguggaccauauggugcagaaguccgggaagacgggcaccaucaccuaccagcgcggcauccuccugccccagaaggucuggugcgccagcgggcgguccaaggugaucaagggcucgcugccccucaucggggaggccgacugccugcacgagaaguacggcgggcugaacaagagcaagcccuauuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuauaccucccacggggcccacggcgucgccguggccgcggaccugaaguccacccaggaggccaucaacaagaucacgaagaaccucaacucccugucggagcuggaggucaagaaccuccagcgccuguccggcgccauggacgagcugcacaaugagauccucgagcuggacgagaagguggacgaccugcgggccgacaccaucagcucccagaucgagcucgccgugcugcugucgaacgaggggaucaucaacuccgaggacgagcaccuccuggcgcuggagcgcaagcucaagaagaugcugggccccagugccgucgagaucgggaacggcugcuucgagaccaagcacaagugcaaccagaccugccuggaccggaucgccgccgggaccuucgacgcgggcgaguuuucccuccccacguucgacucgcugaacaucaccgccgccucccugaacgacgacggccucgacaaccacaccauccugcuguauuacagcaccgccgccuccucgcuggcggugacgcucaugaucgccaucuucguggucuacauggugucccgcgacaacgugagcugcuccaucugccuguga

SEQ ID NO: 16019 - RNA, 1758 nt, Artificial Sequence
  derived and/or modified CDS sequence (AUadapt) from InfluenzaB__AHZ41770__HA
augaaggccaucaucgugcugcucauggucgugaccaguaacgccgaccgcaucugcaccggcaucacguccucgaacagcccccacaucgugaagaccgcgacccagggggaggucaacgugaccggcgugaucccgcugacgaccacccccaccaagucgcacuucgccaaccugaaggggacggagacccggggcaagcucugccccaagugucugaacugcaccgaccuggacgucgcccucgggcgccccaagugcaccggcaagaucccguccgcccgggugagcauccugcacgaggugcgccccgucacguccggcugcuuccccaucaugcacgaccggaccaagauccgccagcugcccaaccuccugcggggguacgagcauauccgccugucgacccacaacgugaucaacgccgagaacgcgccgggcgggcccuacaagaucggcaccuccgggagcugccccaacaucacgaacggcaacggcuucuucgccaccauggccugggccgugcccaagaaugacaagaacaagaccgcgaucaacccgcucaccaucgagguccccuacaucugcacggagggggaggaccagaucaccguguggggcuuccacuccgacaacgagacccagauggccaagcuguacggggacucggagccccagaaguucaccuccagugccaacggcgugacgacccacuacgucucccagaucggcggguuccccaaccagaccgaggacggcgggcugccgcagagcggccggaucgugguggacuacaugguccagaaguccgggaagaccggcacgaucaccuaccagcgcggcauccuccugccccagaagguguggugcgccucggggcgguccaaggugaucaagggcagccugccccucaucggggaggccgauugccugcacgagaaguacggcgggcugaacaagucgaagcccuacuacaccggcgagcacgcgaaggccaucggcaacugcccgaucugggucaagacgccccucaagcuggccaacgggaccaaguaccgcccgcccgccaagcugcucaaggagcggggcuucuuuggggccaucgcgggcuuccuggagggcgggugggagggcaugaucgccggguggcacggcuacaccucccacggggcccacggcguggccguggccgcggaccugaaguccacccaggaggccaucaacaagaucaccaagaaccucaacucccugagcgagcuggaggucaagaaccuccagcgccuguccggcgccauggacgagcugcacaacgagauccucgagcuggaugagaagguggacgaccugcgggccgacacgaucucgucccagaucgagcucgccguccugcugucgaacgaggggaucaucaacuccgaggacgagcaccuccuggcgcuggagcgcaagcucaagaagaugcugggccccagcgccguggagaucgggaacggcugcuucgagaccaagcauaagugcaaccagaccugccuggaccggaucgccgccgggaccuucgacgcgggcgaguucucccuccccaccuucgacucgcugaacaucacggccgccucccugaacgacgauggccucgacaaccacaccauccugcuguacuacagcaccgccgccuccucgcuggcggugacccucaugaucgccaucuucgucguguacauggugucccgcgacaacgucagcugcuccaucugccuguga

SEQ ID NO: 16020 - RNA, 1758 nt, Artificial Sequence; identical to SEQ ID NO: 14423
  derived and/or modified CDS sequence (AUadapt) from InfluenzaB__AHZ41781__HA

SEQ ID NO: 16021 - RNA, 1758 nt, Artificial Sequence; identical to SEQ ID NO: 14423
  derived and/or modified CDS sequence (AUadapt) from InfluenzaB__AHZ41792__HA

SEQ ID NO: 16022 - RNA, 1758 nt, Artificial Sequence; identical to SEQ ID NO: 14423
  derived and/or modified CDS sequence (AUadapt) from InfluenzaB__AHZ41803__HA

SEQ ID NO: 16023 - RNA, 1758 nt, Artificial Sequence
  derived and/or modified CDS sequence (AUadapt) from InfluenzaB__AHZ41814__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccauuucgccaaccugaaggggacggagacccggggcaagcucugccccaagugccccaacugcaccgaccuggacguggcccuggggcgcccgaagugcaccggcaagauccccuccgcccgggugaguauccuccacgagguccgccccgugacguccggcugcuuccccaucaugcacgaccggaccaagauccgccagcugccgaaccugcuccggggguacgagcacauccgccugagcacccauaacgugaucaacgccgagaacgcgcccggcgggcccuacaagaucggcaccuccgggucgugccccaacgucacgaacggcaacggcuuuuucgccaccauggccugggccgugccgaagaacgacaagaacaagaccgcgaccaacccccugacgaucgaggugcccuacaucugcaccgagggggaggaccagaucaccgucuggggcuuccacuccgauaacgagacccagauggccaagcucuacggggacagcaagccccagaaguucacguccucggccaacggcgugaccacccacuacgugucccagaucggcggguuuccgaaccagaccgaggacggcgggcugccccagagcggccggaucgucguggacuacauggugcagaaguccgggaagacgggcaccgucaccuaccagcgcggcauccugcucccccagaagguguggugcgccucggggcgguccaaggugaucaagggcagccugccccugaucggggaggccgauugccuccacgagaaguacggcgggcugaacaagucgaagccguacuacaccggcgagcacgcgaaggccaucggcaacugucccaucugggucaagacgccccugaagcucgccaacgggaccaaguaccggcccccggccaagcugcugaaggagcgcggcuucuucggggccaucgcgggcuuccucgagggcgggugggagggcaugaucgccggguggcacggcuacaccucccacggggcccacggcguggccgucgccgcggaucugaaguccacccaggaggccaucaacaagaucacgaagaaccugaacucccucagcgagcuggaggugaagaaccugcagcgccucuccggcgccauggacgagcugcacaacgagauccuggagcucgacgagaagguggacgaucugcgggccgacaccaucucgucccagaucgagcuggccguccuccugagcaacgaggggaucaucaacuccgaggacgagcaccuccuggcgcuggagcgcaagcugaagaagaugcucggccccucggccguggagaucgggaacggcuguuucgagaccaagcacaagugcaaccagaccugccuggaccggaucgccgccgggaccuucgacgcgggcgaguucucccugcccacguuugacagccucaacaucaccgccgccucccugaacgacgacggccuggacaaccacaccauccuccuguauuacucgaccgccgccuccagccuggcggugacgcugaugaucgccaucuucgucguguacauggugucccgcgacaacgucagcugcuccaucugccucuga

SEQ ID NO: 16024 - RNA, 1758 nt, Artificial Sequence; identical to SEQ ID NO: 14423
  derived and/or modified CDS sequence (AUadapt) from InfluenzaB__AHZ41825__HA

SEQ ID NO: 16025 - RNA, 1758 nt, Artificial Sequence; identical to SEQ ID NO: 14423
  derived and/or modified CDS sequence (AUadapt) from InfluenzaB__AHZ41836__HA

SEQ ID NO: 16026 - RNA, 1758 nt, Artificial Sequence; identical to SEQ ID NO: 14423
  derived and/or modified CDS sequence (AUadapt) from InfluenzaB__AHZ41847__HA

SEQ ID NO: 16027 - RNA, 1755 nt, Artificial Sequence; identical to SEQ ID NO: 15871
  derived and/or modified CDS sequence (AUadapt) from InfluenzaB__AHZ41858__HA

SEQ ID NO: 16028 - RNA, 1758 nt, Artificial Sequence; identical to SEQ ID NO: 15896
  derived and/or modified CDS sequence (AUadapt) from InfluenzaB__AHZ41869__HA

SEQ ID NO: 16029 - RNA, 1755 nt, Artificial Sequence; identical to SEQ ID NO: 14114
  derived and/or modified CDS sequence (AUadapt) from InfluenzaB__AIC73844__HA

SEQ ID NO: 16030 - RNA, 1758 nt, Artificial Sequence; identical to SEQ ID NO: 15605
  derived and/or modified CDS sequence (AUadapt) from InfluenzaB__AIC73845__HA

SEQ ID NO: 16031 - RNA, 1758 nt, Artificial Sequence; identical to SEQ ID NO: 15605
  derived and/or modified CDS sequence (AUadapt) from InfluenzaB__AIC73846__HA

SEQ ID NO: 16032 - RNA, 1758 nt, Artificial Sequence
  derived and/or modified CDS sequence (AUadapt) from InfluenzaB__AIC73847__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccauuucgccaaccugaaggggacggagacccggggcaagcucugccccaagugccuggacugcaccgaccuggacguggcccucgggcgccccaagugcaccggcaagaucccguccgcccgggugaguauccugcacgagguccgccccgugacguccggcugcuuccccaucaugcacgaccggaccaagauccgccagcugcccaaccuccugcggggguacgagcacauccgccugagcacccauaacgugaucaacgccgaggacgcgccgggcgggcccuacaagaucggcaccuccgggagcugccccaacgucacgaacggcaacggcuuuuucgccaccauggccugggccgugcccaagaacgacaagaacaagaccgcgaccaacccgcucacgaucgaggugcccuacaucugcaccgagggggaggaccagaucaccgucuggggcuuccacuccgauaacgagacccagauggccaagcuguacggggacucgaagccccagaaguucacguccagcgccaacggcgugaccacccacuacgugucccagaucggcggguuucccaaccagaccgaggacggcgggcugccgcagucgggccggaucgucguggacuacauggugcagaaguccgggaagacgggcaccaucaccuaccagcgcggcauccuccugccccagaaggucuggugcgccagcgggcgguccaaggugaucaagggcucgcugccccucaucggggaggccgauugccugcacgagaaguacggcgggcugaacaagagcaagcccuacuacaccggcgagcacgcgaaggccaucggcaacuguccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaucugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaucugcgggccgacaccaucucgucccagaucgagcucgccgugcugcugagcaacgaggggaucaucaacuccgaggacgagcaccuccuggcgcuggagcgcaagcucaagaagaugcugggccccucggccgucgagaucgggaacggcuguuucgagaccaagcacaagugcaaccagaccugccuggaccggaucgccgccgggaccuucgacgcgggcgaguucucccuccccacguuugacagccugaacaucaccgccgccucccugaacgacgacggccucgacaaccacaccauccugcuguauuacucgaccgccgccuccagccuggcggugacgcucaugaucgccaucuucguggucuacauggugucccgcgacaacgugagcugcuccaucugccuguga

SEQ ID NO: 16033 - RNA, 1758 nt, Artificial Sequence; identical to SEQ ID NO: 15605
  derived and/or modified CDS sequence (AUadapt) from InfluenzaB__AIC73848__HA

SEQ ID NO: 16034 - RNA, 1755 nt, Artificial Sequence; identical to SEQ ID NO: 14093
  derived and/or modified CDS sequence (AUadapt) from InfluenzaB__AIC73849__HA

SEQ ID NO: 16035 - RNA, 1758 nt, Artificial Sequence
  derived and/or modified CDS sequence (AUadapt) from InfluenzaB__AIC73850__HA
augaaggccaucaucgugcugcucauggucgccaccaguaacgcggaccgcaucugcaccggcaucacguccagcaacucgccccacguggugaagaccgccacccagggggaggucaacgugaccggcgugaucccgcugacgaccacccccaccaagagccauuucgccaaccugaaggggacggagacccggggcaagcucugccccaagugccugaacugcaccgaccuggacgucgcccucgggcgccccaagugcaccggcaagaucccguccgcccgggugaguauccugcacgaggugcgccccgucacguccggcugcuuccccaucaugcacgaccggaccaagauccgccagcugcccaaccuccugcggggguacgagcacauccgccugagcacccauaacgugaucaacgcggaggacgccccgggcgggcccuacaagaucggcaccuccgggucgugccccaacgugacgaacggcaacggcuuuuucgccaccauggccugggcgguccccaagaacgacaagaacaagaccgccaccaacccgcucacgaucgaggugcccuacaucugcaccgagggggaggaccagaucaccguguggggcuuccacuccgauaacgagacccagauggccaagcuguacggggacagcaagccccagaaguucacguccucggccaacggcgucaccacccacuacgugucccagaucggcggguuucccaaccagaccgaggacggcgggcugccgcagagcggccggaucguggucgacuacauggugcagaaguccgggaagacgggcaccaucaccuaccagcgcggcauccuccugccccagaagguguggugcgccucggggcgguccaaggucaucaagggcagccugccccucaucggggaggcggauugccugcacgagaaguacggcgggcugaacaagucgaagcccuacuacaccggcgagcacgccaaggccaucggcaacuguccgaucugggugaagacgccccucaagcuggccaacgggaccaaguaccgcccgcccgccaagcugcucaaggagcggggcuucuucggggcgaucgccggcuuccuggagggcgggugggagggcaugaucgccggguggcacggcuacaccucccacggggcccacggcguggccgucgcggccgaucugaaguccacccaggaggccaucaacaagaucacgaagaaccucaacucccugagcgagcuggaggugaagaaccuccagcgccuguccggcgccauggacgagcugcacaacgagauccucgagcuggacgagaaggucgacgaucugcgggccgacaccaucucgucccagaucgagcucgcggugcugcugagcaacgaggggaucaucaacuccgaggacgagcaccuccuggcccuggagcgcaagcucaagaagaugcugggccccucggccguggagaucgggaacggcuguuucgagaccaagcacaagugcaaccagaccugccuggaccggaucgccgcggggaccuucgacgccggcgaguucucccuccccacguuugacagccugaacaucaccgccgccucccugaacgacgacggccucgacaaccacaccauccugcuguauuacucgaccgccgcguccagccuggccgucacgcucaugaucgccaucuucgugguguacauggucucccgcgacaacgugagcugcuccaucugccuguga

SEQ ID NO: 16036 - RNA, 1758 nt, Artificial Sequence; identical to SEQ ID NO: 14124
  derived and/or modified CDS sequence (AUadapt) from InfluenzaB__AIC73851__HA

SEQ ID NO: 16037 - RNA, 1755 nt, Artificial Sequence; identical to SEQ ID NO: 14114
  derived and/or modified CDS sequence (AUadapt) from InfluenzaB__AIC73852__HA

SEQ ID NO: 16038 - RNA, 1755 nt, Artificial Sequence; identical to SEQ ID NO: 14114
  derived and/or modified CDS sequence (AUadapt) from InfluenzaB__AIC73853__HA

SEQ ID NO: 16039 - RNA, 1758 nt, Artificial Sequence
  derived and/or modified CDS sequence (AUadapt) from InfluenzaB__AIC73855__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccacuucgccaaucugaaggggacggagacccggggcaagcucugccccaagugccugaacugcaccgaccuggacguggcccucgggcgccccaagugcaccggcaagaucccguccgcccgggugucgauccugcacgagguccgccccgugacguccggcugcuuccccaucaugcaugaccggaccaagauccgccagcugcccaaccuccugcggggguacgagcacauccgccugagcacccacaacgugaucaacgccgagaacgcgccgggcgggcccuacaucaucggcaccuccgggucgugucccaacgucacgaacggcaacggcuucuucgccaccauggccugggccgugcccaagaacgacaagaacaagaccgcgaccaacccgcucacgaucgaggugcccuacaucugcaccgagggggaggaucagaucaccgucuggggcuuccacuccgacaacgagacccagauggccaagcuguacggggacagcaacccccagaaguucacguccucggccaacggcgugaccacccauuacgugucccagaucggcggguuccccaaccagaccgaggacggcgggcugccgcagagcggccggaucgucguggacuacauggugcagaaguccgggaagacgggcaccaucaccuaccagcgcggcauccuccugccccagaaggucuggugcgccucggggcgguccaaggugaucaagggcagccugccccucaucggggaggccgauugccugcacgagaaguacggcgggcugaacaagucgaagcccuacuacaccggcgagcacgcgaaggccaucggcaacugcccgaucugggugaagacgccccucaagcuggccaacgggaccaaguaucgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagugagcuggaggucaagaaccuccagcgccuguccggcgccauggacgagcugcacaacgagauccucgagcuggacgagaagguggacgaccugcgggccgacaccaucucgucccagaucgagcucgccgugcugcugagcaacgaggggaucaucaauuccgaggacgagcaccuccuggcgcuggagcgcaagcucaagaagaugcugggccccucggccgucgagaucgggaacggcugcuucgagaccaagcacaagugcaaccagaccugccuggaccggaucgccgccgggaccuuugacgcgggcgaguucucccuccccacguucgacagccugaacaucaccgccgccucccugaacgacgacggccucgacaaccauaccauccugcuguacuacucgaccgccgccuccagccuggcggugacgcucaugaucgccaucuucguggucuacauggugucccgcgacaacgugagcugcuccaucugccuguga

SEQ ID NO: 16040 - RNA, 1758 nt, Artificial Sequence; identical to SEQ ID NO: 15605
  derived and/or modified CDS sequence (AUadapt) from InfluenzaB__AIC73856__HA

SEQ ID NO: 16041 - RNA, 1758 nt, Artificial Sequence; identical to SEQ ID NO: 15605
  derived and/or modified CDS sequence (AUadapt) from InfluenzaB__AIC73857__HA

SEQ ID NO: 16042 - RNA, 1758 nt, Artificial Sequence; identical to SEQ ID NO: 15605
  derived and/or modified CDS sequence (AUadapt) from InfluenzaB__AIC73859__HA

SEQ ID NO: 16043 - RNA, 1758 nt, Artificial Sequence
  derived and/or modified CDS sequence (AUadapt) from InfluenzaB__AIC73860__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaucugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuccccaucaugcaugaccggaccaagauccgccagcugcccaaccuccugcggggguacgagcacauccgccugucgacccacaacgugaucaacgccgagaacgcgccgggcgggcccuacaagaucggcaccuccgggagcugucccaacgucacgaacggcaacggcuucuucgccaccauggccugggccgugcccaagaacgacaagaacaagaccgcgaccaacccgcucacgaucgaggugcccuacaucugcaccgagggggaggaucagaucaccgucuggggcuuccacuccgacaacgagacccagauggccaagcuguacggggacucgaacccccagaaguucacguccagcgccaacggcgugaccacccauuacgugucccagaucggcggguuccccaaccagaccgaggacggcgggcugccgcagucgggccggaucgucguggacuacauggugcagaaguccgggaagacgggcaccaucaccuaccagcgcggcauccuccugccccagaaggucuggugcgccagcgggcgguccaaggugaucaagggcucgcugccccucaucggggaggccgauugccugcacgagaaguacggcgggcugaacaagagcaagcccuacuacaccggcgagcacgcgaaggccaucggcaacugcccgaucugggugaagacgccccucaagcuggccaacgggaccaaguaucgcccgcccgccaagcugcucaaggagcggggcuucuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagugagcuggaggucaagaaccuccagcgccuguccggcgccauggacgagcugcacaacgagauccucgagcuggacgagaagguggacgaccugcgggccgacaccaugagcucccagaucgagcucgccgugcugcugucgaacgaggggaucaucaauuccgaggacgagcaccuccuggcgcuggagcgcaagcucaagaagaugcugggccccagcgccgucgagaucgggaacggcugcuucgagaccaagcacaagugcaaccagaccugccuggaccggaucgccgccgggaccuuugacgcgggcgaguucucccuccccacguucgacucgcugaacaucaccgccgccucccugaacgacgacggccucgacaaccauaccauccugcuguacuacagcaccgccgccuccucgcuggcggugacgcucaugaucgccaucuucguggucuacauggugucccgcgacaacgugagcugcuccaucugccuguga

SEQ ID NO: 16044 - RNA, 1758 nt, Artificial Sequence
  derived and/or modified CDS sequence (AUadapt) from InfluenzaB__AIC73861__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugccccaagugucugaacugcaccgaccuggacguggcccucgggcgccccaagugcaccggcaagaucccguccgcccgggugagcauccugcacgagguccgccccgugacguccggcugcuuccccaucaugcacgaccggaccaagauccgccagcugcccaaccuccugcggggguacgagcauauccgccugucgacccacaacgugaucaacaccgagaacgccccgggcgggcccuacaagaucggcacguccgggagcugccccaacgucaccaacggcaacggcuucuucgcgaccauggccugggccgugcccaagaacgauaagaacaagaccgccacgaacccgcucaccaucgaggugcccuacaucugcaccgagggggaggaccagaucaccgucuggggcuuccacuccgacaacgagacgcagauggcgaagcuguacggggacucgaacccccagaaguuuaccuccucggccaacggcgugaccauccacuacgugucccagaucggcggguuccccaaccagaccgaggacggcgggcugccgcagagcggccggaucgucguggacuacauggugcagaaguccgggaagacgggcaccaucaccuaccagcgcggcauccuccugccccagaaggucuggugcgccucggggcgguccaaggugaucaagggcagccugccccucaucggggaggccgauugccugcacgagaaguacggcgggcugaacaagucgaagcccuacuacaccggcgagcacgccaaggcgaucggcaacugcccgaucugggugaagacgccccucaagcuggccaacgggaccaaguaccgcccgcccgccaagcugcucaaggagcggggcuucuuuggggccaucgccggcuuccuggagggcgggugggagggcaugaucgcgggguggcacggcuacaccucccacggggcccacggcgucgccguggccgccgaccugaaguccacccaggaggcgaucaacaagaucacgaagaaccucaacucccugagcgagcuggaggucaagaaccuccagcgccuguccggcgccauggacgagcugcacaaugagauccucgagcuggacgagaagguggacgaccugcgggccgacaccaucucgucccagaucgagcucgccgugcugcugucgaacgaggggaucaucaacuccgaggacgagcaccuccuggcccuggagcgcaagcucaagaagaugcugggccccagcgcggucgagaucgggaacggcugcuucgagaccaagcauaagugcaaccagaccugccuggaccggaucgccgccgggaccuucgacgccggcgaguucucccuccccacguucgacucgcugaacaucaccgcggccucccugaacgacgauggccucgacaaccacaccauccugcuguacuacagcaccgccgccuccucgcuggccgugacgcucaugaucgcgaucuucguggucuacauggugucccgcgacaacgugagcugcuccaucugccuguga

SEQ ID NO: 16045 - RNA, 1758 nt, Artificial Sequence; identical to SEQ ID NO: 16043
  derived and/or modified CDS sequence (AUadapt) from InfluenzaB__AIC73862__HA

SEQ ID NO: 16046 - RNA, 1758 nt, Artificial Sequence; identical to SEQ ID NO: 16043
  derived and/or modified CDS sequence (AUadapt) from InfluenzaB__AIC73863__HA

SEQ ID NO: 16047 - RNA, 1758 nt, Artificial Sequence; identical to SEQ ID NO: 16043
  derived and/or modified CDS sequence (AUadapt) from InfluenzaB__AIC73864__HA

SEQ ID NO: 16048 - RNA, 1755 nt, Artificial Sequence; identical to SEQ ID NO: 14122
  derived and/or modified CDS sequence (AUadapt) from InfluenzaB__AIC73865__HA

SEQ ID NO: 16049 - RNA, 1758 nt, Artificial Sequence
  derived and/or modified CDS sequence (AUadapt) from InfluenzaB__AIC73867__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccacuuugccaaccugaaggggacggagacccggggcaagcucugccccaagugccugaacugcaccgaccuggacguggcccucgggcgccccaagugcaccggcaagaucccguccgcccgggugucgauccugcacgagguccgccccgugacguccggcuguuuccccaucaugcacgaccggaccaagauccgccagcugcccaaccuccugcggggguacgagcacauccgccugagcacccacaacgugaucgacgccgagaaugcgccgggcgggcccuacaagaucggcaccuccgggucgugccccaacgucacgaacggcaacggcuucuucgccaccauggccugggccgugcccaagaacgacaagaauaagaccgcgaccaacccgcucacgaucgaggugcccuacaucugcaccgagggggaggaccagaucaccgucuggggcuuccacuccgacaacgagacccagauggccaagcuguacggggacaguaacccccagaaguucacguccucggccaacggcgugaccacccacuacgugucccagaucggcggguuccccaaccagaccgaggacggcgggcugccgcagagcggccggaucgucguggauuacauggugcagaaguccgggaagacgggcaccaucaccuaccagcgcggcauccuccugccccagaaggucuggugcgccucggggcgguccaaggugaucaagggcagccugccccucaucggggaggccgacugccugcacgagaaguacggcgggcugaacaagaguaagcccuacuacaccggcgagcacgcgaaggccaucggcaacugcccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcauggcuacaccucccacggggcccacggcgucgccguggccgcggaccugaaguccacccaggaggccaucaacaagaucacgaagaaccucaacucccugagcgagcuggaggucaagaaccuccagcgccuguccggcgccauggacgagcugcauaacgagauccucgagcuggacgagaagguggacgaccugcgggccgacaccaucucgucccagaucgagcucgccgugcugcugagcaacgaggggaucaucaacuccgaggacgagcaucuccuggcgcuggagcgcaagcucaagaagaugcugggccccucggccgucgagaucgggaacggcugcuucgagaccaagcacaagugcaaccagaccugccuggaccggaucgccgccgggaccuucgaugcgggcgaguucucccuccccacguucgacagccugaacaucaccgccgccucccugaacgacgacggccucgacaaccauaccauccugcuguacuacucgaccgccgccuccagccuggcggugacgcucaugaucgccaucuucguggucuacauggugucccgcgacaacgugagcugcuccaucugccuguga

SEQ ID NO: 16050 - RNA, 1758 nt, Artificial Sequence; identical to SEQ ID NO: 14124
  derived and/or modified CDS sequence (AUadapt) from InfluenzaB__AIC73868__HA

SEQ ID NO: 16051 - RNA, 1758 nt, Artificial Sequence; identical to SEQ ID NO: 16043
  derived and/or modified CDS sequence (AUadapt) from InfluenzaB__AIC73869__HA

SEQ ID NO: 16052 - RNA, 1758 nt, Artificial Sequence; identical to SEQ ID NO: 16043
  derived and/or modified CDS sequence (AUadapt) from InfluenzaB__AIC73870__HA

SEQ ID NO: 16053 - RNA, 1758 nt, Artificial Sequence; identical to SEQ ID NO: 15605
  derived and/or modified CDS sequence (AUadapt) from InfluenzaB__AIC73871__HA

SEQ ID NO: 16054 - RNA, 1755 nt, Artificial Sequence; identical to SEQ ID NO: 14114
  derived and/or modified CDS sequence (AUadapt) from InfluenzaB__AIC73872__HA

SEQ ID NO: 16055 - RNA, 1755 nt, Artificial Sequence; identical to SEQ ID NO: 14093
  derived and/or modified CDS sequence (AUadapt) from InfluenzaB__AIC73873__HA

SEQ ID NO: 16056 - RNA, 1755 nt, Artificial Sequence; identical to SEQ ID NO: 14114
  derived and/or modified CDS sequence (AUadapt) from InfluenzaB__AIC73874__HA

SEQ ID NO: 16057 - RNA, 1755 nt, Artificial Sequence; identical to SEQ ID NO: 14122
  derived and/or modified CDS sequence (AUadapt) from InfluenzaB__AIC73875__HA

SEQ ID NO: 16058 - RNA, 1755 nt, Artificial Sequence
  derived and/or modified CDS sequence (AUadapt) from InfluenzaB__AIC73876__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgaagacccggggcaagcucugccccgacugccugaacugcaccgaucuggacguggcccucgggcgccccaugugcgugggcaccacgccguccgccaaggccagcauccugcacgagguccggcccgugaccuccggcugcuuccccaucaugcacgaucgcaccaagauccggcagcuggcgaaccuccugcgcggguacgagaacauccggcugucgacccagaacgugaucgacgccgagaaggcccccggcgggccguaccgccucggcacguccgggagcugucccaacgccaccuccaagagcggcuucuucgcgaccauggccugggccguccccaaggacaacaacaagaaugccaccaacccccugacgguggaggugccguacaucugcgccgagggcgaggaccagaucaccgucuggggguuccacuccgacaacaagacccagaugaagaaucuguacggcgacagcaacccccagaaguucaccuccucggcgaacggggugacgacccauuacgugucccagaucggcggcuuccccgaccagcgggaggacgggggccucccccagagcgggcgcaucgucguggacuacaugaugcagaagccgggcaagaccgggaccaucguguaccagcggggcguccugcugccccagaagguguggugugccuccggccgcagcaaggugaucaaggggagccucccccugaucggcgaggccgacugccugcacgagaaguacgggggccucaacaaguccaagcccuauuacacgggggagcacgccaaggccaucggcaacugcccgaucugggucaagacgccccugaagcuggcgaacggcaccaaguaccggccgcccgccaagcuccugaaggagcgcggguucuucggcgccaucgccggguuucuggagggcgggugggagggcaugaucgccggcuggcacggguacaccagccacggcgcgcacgggguggccgucgccgccgaccucaaguccacccaggaggccaucaacaagaucaccaagaaucugaacucgcuguccgagcucgaggugaagaaccugcagcggcugagcggcgcgauggacgagcuccacaacgagauccuggagcuggacgagaagguggaugaccuccgcgccgacaccaucuccagccagaucgagcuggccguccugcucuccaacgagggcaucaucaacagcgaggacgagcaucuccuggcccuggagcggaagcugaagaagaugcuggggcccuccgcgguggacaucggcaacgggugcuucgagaccaagcacaagugcaaccagacgugccucaaucgcaucgccgccggcaccuucaacgccggggaguucucgcugcccaccuucgacucccugaacaucaccgccgcgagucucaacgacgacggccuggacaaccacaccauccugcuguacuacuccacggccgccaguucccucgccgugacccugaugcuggccaucuucaucgucuacauggugagccgggacaacguguccugcagcaucugccucuga

SEQ ID NO: 16059 - RNA, 1755 nt, Artificial Sequence; identical to SEQ ID NO: 14122
  derived and/or modified CDS sequence (AUadapt) from InfluenzaB__AIC73877__HA

SEQ ID NO: 16060 - RNA, 1755 nt, Artificial Sequence; identical to SEQ ID NO: 14122
  derived and/or modified CDS sequence (AUadapt) from InfluenzaB__AIC73878__HA

SEQ ID NO: 16061 - RNA, 1755 nt, Artificial Sequence; identical to SEQ ID NO: 14122
  derived and/or modified CDS sequence (AUadapt) from InfluenzaB__AIC73879__HA

SEQ ID NO: 16062 - RNA, 1755 nt, Artificial Sequence; identical to SEQ ID NO: 14122
  derived and/or modified CDS sequence (AUadapt) from InfluenzaB__AIC73880__HA

SEQ ID NO: 16063 - RNA, 1755 nt, Artificial Sequence; identical to SEQ ID NO: 14122
  derived and/or modified CDS sequence (AUadapt) from InfluenzaB__AIC73881__HA

SEQ ID NO: 16064 - RNA, 1755 nt, Artificial Sequence; identical to SEQ ID NO: 14122
  derived and/or modified CDS sequence (AUadapt) from InfluenzaB__AIC73882__HA

SEQ ID NO: 16065 - RNA, 1755 nt, Artificial Sequence; identical to SEQ ID NO: 14093
  derived and/or modified CDS sequence (AUadapt) from InfluenzaB__AIC73883__HA

SEQ ID NO: 16066 - RNA, 1755 nt, Artificial Sequence; identical to SEQ ID NO: 14122
  derived and/or modified CDS sequence (AUadapt) from InfluenzaB__AIC73884__HA

SEQ ID NO: 16067 - RNA, 1758 nt, Artificial Sequence
  derived and/or modified CDS sequence (AUadapt) from InfluenzaB__AIC73885__HA
auggaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccauuucgccaaccugaaggggacggagacccggggcaagcucugccccaagugccugaacugcaccgaccuggacguggcccucgggcgccccaagugcaccggcaagaucccguccgcccgggugaguauccugcacgagguccgccccgugacguccggcugcuuccccaucaugcacgaccggaccaagauccgccagcugcccaaccuccugcggggguacgagcacauccgccugagcacccauaacgugaucaacgccgaggacgcgccgggcgggcccuacaagaucggcaccuccgggagcugccccaacgucacgaacggcaacggcuuuuucgccaccauggccugggccgugcccaagaacgacaagaacaagaccgcgaccaacccgcucacgaucgaggugcccuacaucugcaccgagggggaggaccagaucaccgucuggggcuuccacuccgauaacgagacccagauggccaagcuguacggggacucgaagccccagaaguucacguccagcgccaacggcgugaccacccacuacgugucccagaucggcggguuucccaaccagaccgaggacggcgggcugccgcagucgggccggaucgucguggacuacauggugcagaaguccgggaagacgggcaccaucaccuaccagcgcggcauccuccugccccagaaggucuggugcgccagcgggcgguccaaggugaucaagggcucgcugccccucaucggggaggccgauugccugcacgagaaguacggcgggcugaacaagagcaagcccuacuacaccggcgagcacgcgaaggccaucggcaacuguccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaucugaaguccacccaggaggccaucaacaagaucacgaagaaccucaacucccugagcgagcuggaggucaagaaccuccagcgccuguccggcgccauggacgagcugcacaacgagauccucgagcuggacgagaagguggacgaucugcgggccgacaccaucucgucccagaucgagcucgccgugcugcugagcaacgaggggaucaucaacuccgaggacgagcaccuccuggcgcuggagcgcaagcucaagaagaugcugggccccucggccgucgagaucgggaacggcuguuucgagaccaagcacaagugcaaccagaccugccuggaccggaucgccgccgggaccuucgacgcgggcgaguucucccuccccacguuugacagccugaacaucaccgccgccucccugaacgacgacggccucgacaaccacaccauccugcuguauuacucgaccgccgccuccagccuggcggugacgcucaugaucgccaucuucguggucuacauggugucccgcgacaacgugagcugcuccaucugccuguga

SEQ ID NO: 16068 - RNA, 1758 nt, Artificial Sequence; identical to SEQ ID NO: 15605
  derived and/or modified CDS sequence (AUadapt) from InfluenzaB__AIC73886__HA

SEQ ID NO: 16069 - RNA, 1758 nt, Artificial Sequence; identical to SEQ ID NO: 16049
  derived and/or modified CDS sequence (AUadapt) from InfluenzaB__AIC73887__HA

SEQ ID NO: 16070 - RNA, 1755 nt, Artificial Sequence; identical to SEQ ID NO: 14093
  derived and/or modified CDS sequence (AUadapt) from InfluenzaB__AIC73888__HA

SEQ ID NO: 16071 - RNA, 1755 nt, Artificial Sequence; identical to SEQ ID NO: 14114
  derived and/or modified CDS sequence (AUadapt) from InfluenzaB__AIC73889__HA

SEQ ID NO: 16072 - RNA, 1755 nt, Artificial Sequence; identical to SEQ ID NO: 14114
  derived and/or modified CDS sequence (AUadapt) from InfluenzaB__AIC73890__HA

SEQ ID NO: 16073 - RNA, 1758 nt, Artificial Sequence
  derived and/or modified CDS sequence (AUadapt) from InfluenzaB__AIC73892__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagucccacuucgccaaccugaaggggacggagacccggggcaagcucugucccaagugccugaacugcaccgaccuggacguggcccucgggcgccccaagugcaccggcaagaucccguccgcccgggugagcauccugcacgagguccgccccgugacguccggcugcuuccccaucaugcacgaucggaccaagauccgccagcugcccaaccuccugcggggguacgagcacauccgccugucgacccacaacgugaucaacgccgaggacgcgccgggcgggcccuacaagaucggcaccuccgggagcugccccaaugucacgaacggcaacggcuucuucgccaccauggccugggccgugcccaagaacgacaagaacaagaccgcgaccaacccgcucacgaucgaggugcccuacaucugcaccgagggggaggaccagaucaccgucuggggcuuucacuccgacaacgagacccagauggccaagcuguacggggacucgaagccccagaaguucacguccagcgccaacggcgugaccacccacuacgugucccagaucggcggguuucccaaccagaccgaggacggcgggcugccgcagucgggccggaucgucguggacuacauggugcagaaguccgggaagacgggcaccaucaccuaccagcgcggcauccuccugccccagaaggucuggugcgccagcgggcgguccaaggugaucaagggcucgcugccccucaucggggaggccgacugccugcaugagaaguacggcgggcugaacaagagcaagcccuacuacaccggcgagcacgcgaaggccaucggcaacugcccgaucugggugaagacgucccucaagcuggccaacgggaccaaguaccgcccgcccgccaagcugcucaaggagcggggcuucuuuggggccaucgcgggcuuccuggagggcgggugggagggcaugaucgccggguggcacggcuacaccucgcacggggcccacggcgucgccguggccgcggaccugaaguccacccaggaggccaucaacaagaucacgaagaaccucaacagccuguccgagcuggaggucaagaaucuccagcgccugucgggcgccauggacgagcugcacaacgagauccucgagcuggacgagaagguggacgaccugcgggccgacaccaucuccagccagaucgagcucgccgugcugcuguccaacgaggggaucaucaacagugaggacgagcaccuccuggcgcuggagcgcaagcucaagaagaugcugggccccuccgccgucgagaucgggaacggcugcuucgagaccaagcacaagugcaaccagaccugccuggaccggaucgccgccgggaccuucgaugcgggcgaguucagccuccccacguucgacucccugaacaucaccgccgccucgcugaacgacgacggccucgacaaccauaccauccugcuguacuacuccaccgccgccagcucccuggcggugacgcucaugaucgccaucuucguggucuacauggugucgcgcgacaacguguccugcagcaucugccuguga

SEQ ID NO: 16074 - RNA, 1755 nt, Artificial Sequence; identical to SEQ ID NO: 14093
  derived and/or modified CDS sequence (AUadapt) from InfluenzaB__AIC73893__HA

SEQ ID NO: 16075 - RNA, 1755 nt, Artificial Sequence; identical to SEQ ID NO: 14114
  derived and/or modified CDS sequence (AUadapt) from InfluenzaB__AIC73894__HA

SEQ ID NO: 16076 - RNA, 1755 nt, Artificial Sequence; identical to SEQ ID NO: 14114
  derived and/or modified CDS sequence (AUadapt) from InfluenzaB__AIC73895__HA

SEQ ID NO: 16077 - RNA, 1755 nt, Artificial Sequence; identical to SEQ ID NO: 14114
  derived and/or modified CDS sequence (AUadapt) from InfluenzaB__AIC73896__HA

SEQ ID NO: 16078 - RNA, 1755 nt, Artificial Sequence; identical to SEQ ID NO: 14114
  derived and/or modified CDS sequence (AUadapt) from InfluenzaB__AIC73897__HA

SEQ ID NO: 16079 - RNA, 1755 nt, Artificial Sequence; identical to SEQ ID NO: 14114
  derived and/or modified CDS sequence (AUadapt) from InfluenzaB__AIC73898__HA

SEQ ID NO: 16080 - RNA, 1755 nt, Artificial Sequence; identical to SEQ ID NO: 14114
  derived and/or modified CDS sequence (AUadapt) from InfluenzaB__AIC73899__HA

SEQ ID NO: 16081 - RNA, 1755 nt, Artificial Sequence; identical to SEQ ID NO: 14114
  derived and/or modified CDS sequence (AUadapt) from InfluenzaB__AIC73900__HA

SEQ ID NO: 16082 - RNA, 1755 nt, Artificial Sequence; identical to SEQ ID NO: 14114
  derived and/or modified CDS sequence (AUadapt) from InfluenzaB__AIC73902__HA

SEQ ID NO: 16083 - RNA, 1755 nt, Artificial Sequence
  derived and/or modified CDS sequence (AUadapt) from InfluenzaB__AIC73903__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuauuucgccaaccugaaggggacgcggacccgcggcaagcucugccccgacugccugaacugcaccgaccuggauguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguaugagaagauccgccugucgacccagaacgugaucgacgcggagaaggccccgggcgggcccuaccggcucggcacguccgggagcugccccaacgccaccuccaagaucggcuucuuugccaccauggcgugggccguccccaaggacaacuacaagaacgccaccaacccgcagacgguggaggugcccuacaucugcaccgagggcgaggaccagaucaccgucuggggguuucacagcgacaacaagacccagaugaagucccuguacggcgacagcaacccccagaaguuuacguccucggccaacgggaucaccacccacuacgugucccagaucggcgacuuccccgaccagaccgaggacggcgggcugccgcagaguggccgcaucguggucgacuacaugaugcagaagcccgggaagacgggcaccaucguguaccagcgcggggugcuccugccccagaaggucuggugcgccuccggccggagcaaggugaucaagggcagccugccccucaucggggaggcggacugccugcaugaggaguacggcgggcugaacaaguccaagccguacuacaccggcaagcacgccaaggccaucgggaacugccccaucugggugaagacgccccucaagcuggccaacggcaccaaguaucggcccccggccaagcugcucaaggagcgcggcuucuucggggcgaucgccggcuuccuggagggcgggugggaggggaugaucgccggcuggcacggcuacaccagccacggggcccacggcgucgccguggcggccgaucugaaguccacccaggaggccaucaacaagaucaccaagaaccucaacucgcuguccgagcuggaggucaagaaccuccagcggcugagcggggccauggacgagcugcacaaugagauccucgagcuggacgagaagguggacgaccugcgcgccgacacgaucuccagccagaucgagcucgcggugcugcuguccaacgagggcaucaucaacagcgaggaugagcaccuccuggcccuggagcggaagcucaagaagaugcugggccccuccgccgucgacaucgggaacggcugcuucgagaccaagcacaagugcaaccagaccugucuggaccgcaucgccgcggggaccuucaacgccggcgaguucucgcuccccaccuucgacucccugaacaucacggccgccagucugaacgacgacgggcucgacaaccacaccauccugcuguacuacuccaccgccgcgaguucccuggccgugacccucaugcuggccaucuucaucguguacauggucagccgggacaacguguccugcagcaucugccuguga

SEQ ID NO: 16084 - RNA, 1755 nt, Artificial Sequence
  derived and/or modified CDS sequence (AUadapt) from InfluenzaB__AIC73904__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuauuucgccaaccugaaggggacgcggacccgcggcaagcucugccccgacugccugaacugcaccgaccuggauguggcccucgggcggcccaugugcgugggcaucaccccguccgccaaggccagcauccugcacgagguccgccccgugacguccggcugcuuccccaucaugcacgaccggaccaagauccgccagcugcccaaccuccugcggggguaugagaagauccgccugagcacccagaacgugaucgacgcggagaaggccccgggcgggcccuaccggcucggcaccuccgggucgugccccaacgccacguccaagaucggcuucuuugccaccauggcgugggccguccccaaggacaacuacaagaacgccaccaacccgcagaccguggaggugcccuacaucugcacggagggcgaggaccagaucaccgucuggggguuucacagcgacaacaagacccagaugaagucccuguacggcgacagcaacccccagaaguuuaccuccagcgccaacggggugacgacccacuacgugucccagaucggcgacuuccccgaccagaccgaggacggcgggcugccgcagaguggccgcaucgucguggacuacaugaugcagaagcccgggaagaccggcacgaucguguaccagcgcgggguccuccugccccagaagguguggugcgccuccggccggagcaaggugaucaagggcucgcugccccucaucggggaggcggacugccugcaugaggaguacggcgggcugaacaaguccaagccguacuacaccggcaagcacgccaaggccaucgggaacugccccaucugggucaagacgccccucaagcuggccaacggcaccaaguaucggcccccggccaagcugcucaaggagcgcggcuucuucggggcgaucgccggcuuccuggagggcgggugggaggggaugaucgccggcuggcacggcuacaccagccacggggcccacggcguggccgucgcggccgaucugaaguccacccaggaggccaucaacaagaucaccaagaaccucaacagccuguccgagcuggaggugaagaaccuccagcggcugagcggggccauggacgagcugcacaaugagauccucgagcuggacgagaagguggacgaccugcgcgccgacaccaucuccagccagaucgagcucgcgguccugcuguccaacgagggcaucaucaacucggaggaugagcaccuccuggcccuggagcggaagcucaagaagaugcugggccccuccgccguggacaucgggaacggcugcuucgagacgaagcacaagugcaaccagaccugucuggaccgcaucgccgcggggaccuucaacgccggcgaguucagccuccccaccuucgacucccugaacaucaccgccgccagucugaacgacgacgggcucgacaaccacacgauccugcuguacuacuccaccgccgcgaguucccuggccgugacccucaugcuggccaucuucaucgucuacauggugagccgggacaacguguccugcagcaucugccuguga

SEQ ID NO: 16085 - RNA, 1755 nt, Artificial Sequence; identical to SEQ ID NO: 14114
  derived and/or modified CDS sequence (AUadapt) from InfluenzaB__AIC73905__HA

SEQ ID NO: 16086 - RNA, 1755 nt, Artificial Sequence; identical to SEQ ID NO: 14114
  derived and/or modified CDS sequence (AUadapt) from InfluenzaB__AIC73906__HA

SEQ ID NO: 16087 - RNA, 1755 nt, Artificial Sequence; identical to SEQ ID NO: 14114
  derived and/or modified CDS sequence (AUadapt) from InfluenzaB__AIC73907__HA

SEQ ID NO: 16088 - RNA, 1755 nt, Artificial Sequence; identical to SEQ ID NO: 14114
  derived and/or modified CDS sequence (AUadapt) from InfluenzaB__AIC73908__HA

SEQ ID NO: 16089 - RNA, 1755 nt, Artificial Sequence; identical to SEQ ID NO: 14114
  derived and/or modified CDS sequence (AUadapt) from InfluenzaB__AIC73909__HA

SEQ ID NO: 16090 - RNA, 1755 nt, Artificial Sequence; identical to SEQ ID NO: 14114
  derived and/or modified CDS sequence (AUadapt) from InfluenzaB__AIC73910__HA

SEQ ID NO: 16091 - RNA, 1755 nt, Artificial Sequence; identical to SEQ ID NO: 14114
  derived and/or modified CDS sequence (AUadapt) from InfluenzaB__AIC73911__HA

SEQ ID NO: 16092 - RNA, 1755 nt, Artificial Sequence; identical to SEQ ID NO: 14114
  derived and/or modified CDS sequence (AUadapt) from InfluenzaB__AIC73912__HA

SEQ ID NO: 16093 - RNA, 1755 nt, Artificial Sequence; identical to SEQ ID NO: 14114
  derived and/or modified CDS sequence (AUadapt) from InfluenzaB__AIC73913__HA

SEQ ID NO: 16094 - RNA, 1755 nt, Artificial Sequence; identical to SEQ ID NO: 14114
  derived and/or modified CDS sequence (AUadapt) from InfluenzaB__AIC73914__HA

SEQ ID NO: 16095 - RNA, 1755 nt, Artificial Sequence; identical to SEQ ID NO: 14114
  derived and/or modified CDS sequence (AUadapt) from InfluenzaB__AIC73915__HA

SEQ ID NO: 16096 - RNA, 1755 nt, Artificial Sequence; identical to SEQ ID NO: 14114
  derived and/or modified CDS sequence (AUadapt) from InfluenzaB__AIC73916__HA

SEQ ID NO: 16097 - RNA, 1755 nt, Artificial Sequence; identical to SEQ ID NO: 14114
  derived and/or modified CDS sequence (AUadapt) from InfluenzaB__AIC73917__HA

SEQ ID NO: 16098 - RNA, 1755 nt, Artificial Sequence; identical to SEQ ID NO: 14114
  derived and/or modified CDS sequence (AUadapt) from InfluenzaB__AIC73918__HA

SEQ ID NO: 16099 - RNA, 1755 nt, Artificial Sequence; identical to SEQ ID NO: 14093
  derived and/or modified CDS sequence (AUadapt) from InfluenzaB__AIC73919__HA

SEQ ID NO: 16100 - RNA, 1755 nt, Artificial Sequence; identical to SEQ ID NO: 14114
  derived and/or modified CDS sequence (AUadapt) from InfluenzaB__AIC73920__HA

SEQ ID NO: 16101 - RNA, 1758 nt, Artificial Sequence; identical to SEQ ID NO: 15605
  derived and/or modified CDS sequence (AUadapt) from InfluenzaB__AIC73921__HA

SEQ ID NO: 16102 - RNA, 1755 nt, Artificial Sequence; identical to SEQ ID NO: 14114
  derived and/or modified CDS sequence (AUadapt) from InfluenzaB__AIC73922__HA

SEQ ID NO: 16103 - RNA, 1758 nt, Artificial Sequence; identical to SEQ ID NO: 14124
  derived and/or modified CDS sequence (AUadapt) from InfluenzaB__AIC73924__HA

SEQ ID NO: 16104 - RNA, 1758 nt, Artificial Sequence
  derived and/or modified CDS sequence (AUadapt) from InfluenzaB__AIC73925__HA
augaaggccaccaucgugcugcucauggucgugaccaguaacgccgaccgcaucugcacgggcaucaccuccagcaacucgccccacguggucaagaccgcgacccagggggaggugaacgugacgggcgucaucccgcugaccaccacccccaccaagagccauuucgccaaccugaaggggaccgagacccggggcaagcucugccccaagugccugaacugcaccgaccuggacguggcccucgggcgccccaagugcacgggcaagaucccguccgcccgggugaguauccugcacgagguccgccccgugaccuccggcugcuuccccaucaugcacgaccggaccaagauccgccagcugcccaaccuccugcggggguacgagcacauccgccugagcacccauaacgugaucaacgccgaggacgcgccgggcgggcccuacaagaucggcacguccgggucgugccccaacgucaccaacggcaacggcuuuuucgccaccauggccugggccgugcccaagaacgacaagaacaagaccgcgacgaacccgcucaccaucgaggugcccuacaucugcaccgagggggaggaccagaucaccgucuggggcuuccacuccgauaacgagacgcagauggccaagcuguacggggacagcaagccccagaaguucaccuccucggccaacggcgugaccacccacuacgugucccagaucggcggguuucccaaccagacggaggacggcgggcugccgcagagcggccggaucgucguggacuacauggugcagaaguccgggaagaccggcaccaucaccuaccagcgcggcauccuccugccccagaaggucuggugcgccucggggcgguccaaggugaucaagggcagccugccccucaucggggaggccgauugccugcacgagaaguacggcgggcugaacaagucgaagcccuacuacacgggcgagcacgcgaaggccaucggcaacuguccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaucugaaguccacgcaggaggccaucaacaagaucaccaagaaccucaacucccugagcgagcuggaggucaagaaccuccagcgccuguccggcgccauggacgagcugcacaacgagauccucgagcuggacgagaagguggacgaucugcgggccgacaccaucucgucccagaucgagcucgccgugcugcugagcaacgaggggaucaucaacuccgaggacgagcaccuccuggcgcuggagcgcaagcucaagaagaugcugggccccucggccgucgagaucgggaacggcuguuucgagaccaagcacaagugcaaccagaccugccuggaccggaucgccgccgggacguucgacgcgggcgaguucucccuccccaccuuugacagccugaacaucaccgccgccucccugaacgacgacggccucgacaaccacaccauccugcuguauuacucgacggccgccuccagccuggcggugacccucaugaucgccaucuucguggucuacauggugucccgcgacaacgugagcugcuccaucugccuguga

SEQ ID NO: 16105 - RNA, 1755 nt, Artificial Sequence; identical to SEQ ID NO: 14114
  derived and/or modified CDS sequence (AUadapt) from InfluenzaB__AIC73926__HA

SEQ ID NO: 16106 - RNA, 1755 nt, Artificial Sequence; identical to SEQ ID NO: 14307
  derived and/or modified CDS sequence (AUadapt) from InfluenzaB__AIL94977__HA

SEQ ID NO: 16107 - RNA, 1755 nt, Artificial Sequence; identical to SEQ ID NO: 14307
  derived and/or modified CDS sequence (AUadapt) from InfluenzaB__AIL94988__HA

SEQ ID NO: 16108 - RNA, 1755 nt, Artificial Sequence
  derived and/or modified CDS sequence (AUadapt) from InfluenzaB__AIL94999__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacugcaccgaucuggacguggcccucgggcggcccaugugcgugggcaccacgccguccgccaaggccagcauccugcacgagguccgccccgugaccuccggcugcuuccccaucaugcacgaucggaccaagauccgccagcugcccaaccuccugcggggguacgagaacauccgccugagcacccagaacgugaucgacgcggagaaggccccgggcgggcccuaccggcucggcacguccgggucgugucccaacgccaccuccaagaccggcuucuucgccaccauggcgugggccguccccaaggacaacuacaagaacgccacgaauccgcugaccguggaggugcccuacaucugcaccgagggcgaggaccagaucaccgucuggggguuccacagcgacaacaagacgcagaugaagaaucuguacggcgacuccaacccccagaaguucaccagcuccgccaacggggugaccacccacuaugugagccagaucggcgacuuccccgaccagacggaggacggcgggcucccgcaguccggccgcaucgucguggacuacaugaugcagaagcccgggaagaccggcaccaucguguaccagcgcgggguccugcugccccagaagguguggugugccagcggccgguccaaggugaucaagggcucgcucccccugaucggggaggcggacugccugcacgagaaguacggcgggcucaacaagaguaagccguacuacaccggcgagcacgccaaggccaucgggaacugccccaucugggucaagacgccccugaagcuggccaacggcaccaaguaccggcccccggccaagcuccugaaggagcgcggcuucuuuggggcgaucgccggcuuccuggagggcgggugggaggggaugaucgccggcuggcacggcuacaccucccacggggcccacggcguggccgucgcggccgaccucaagagcacccaggaggccaucaauaagaucacgaagaaccugaacucccugagcgagcucgaggugaagaaccugcagcggcuguccggggccauggacgagcuccacaacgagauccuggagcuggacgagaagguggaugaccuccgcgccgacaccaucagcucccagaucgagcuggcgguccugcucucgaacgagggcaucaucaacuccgaggacgagcaucuccuggcccuggagcggaagcugaagaagaugcugggccccagcgccguggacaucgggaacggcugcuucgagaccaagcacaagugcaaccagaccugucucgaccgcaucgccgcggggaccuucaacgccggcgaguucucccugcccacguucgacagccugaauaucaccgccgccucccucaacgacgacgggcuggacaaccacaccauccugcuguacuacaguaccgccgcguccagccucgccgugacgcugaugcuggccaucuucaucgucuacauggugucccgggacaacgugagcugcuccaucugccucuga

SEQ ID NO: 16109 - RNA, 1755 nt, Artificial Sequence; identical to SEQ ID NO: 14307
  derived and/or modified CDS sequence (AUadapt) from InfluenzaB__AIL95010__HA

SEQ ID NO: 16110 - RNA, 1755 nt, Artificial Sequence; identical to SEQ ID NO: 14117
  derived and/or modified CDS sequence (AUadapt) from InfluenzaB__AIL95021__HA

SEQ ID NO: 16111 - RNA, 1758 nt, Artificial Sequence; identical to SEQ ID NO: 14388
  derived and/or modified CDS sequence (AUadapt) from InfluenzaB__AIL95032__HA

SEQ ID NO: 16112 - RNA, 1755 nt, Artificial Sequence; identical to SEQ ID NO: 14117
  derived and/or modified CDS sequence (AUadapt) from InfluenzaB__AIL95043__HA

SEQ ID NO: 16113 - RNA, 1758 nt, Artificial Sequence; identical to SEQ ID NO: 14434
  derived and/or modified CDS sequence (AUadapt) from InfluenzaB__AIL95054__HA

SEQ ID NO: 16114 - RNA, 1758 nt, Artificial Sequence; identical to SEQ ID NO: 14388
  derived and/or modified CDS sequence (AUadapt) from InfluenzaB__AIL95065__HA

SEQ ID NO: 16115 - RNA, 1758 nt, Artificial Sequence; identical to SEQ ID NO: 14118
  derived and/or modified CDS sequence (AUadapt) from InfluenzaB__AIL95076__HA

SEQ ID NO: 16116 - RNA, 1758 nt, Artificial Sequence; identical to SEQ ID NO: 14388
  derived and/or modified CDS sequence (AUadapt) from InfluenzaB__AIL95087__HA

SEQ ID NO: 16117 - RNA, 1755 nt, Artificial Sequence; identical to SEQ ID NO: 14117
  derived and/or modified CDS sequence (AUadapt) from InfluenzaB__AIL95098__HA

SEQ ID NO: 16118 - RNA, 1758 nt, Artificial Sequence; identical to SEQ ID NO: 15899
  derived and/or modified CDS sequence (AUadapt) from InfluenzaB__AIL95109__HA

SEQ ID NO: 16119 - RNA, 1758 nt, Artificial Sequence
  derived and/or modified CDS sequence (AUadapt) from InfluenzaB__AIL95120__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuucgccaaccugaaggggacggagacccggggcaagcucugccccaagugucugaacugcaccgaccuggacguggcccucgggcgccccaagugcaccggcaagaucccguccgcccgggugucgauccugcacgagguccgccccgugacguccggcugcuuccccaucaugcacgaccggaccaagauccgccagcugcccaaccuccugcggggguacgagcauauccgccugagcacccacaacgugaucaacgccgagaacgcgccgggcgggcccuacaagaucggcaccuccgggucgugccccaacgucacgaacggcaacggcuucuucgccaccauggccugggccgugcccaagaaugacaagaacaagaccgcgaccaacccgcucacgaucgaggugcccuacaucugcaccgagggggaggaccagaucaccgucuggggcuuccacuccgacaacgagacccagauggccaagcuguacggggacagcaagccccagaaguucacguccagugccaacggcgugaccacccacuacgugucccagaucggcggguuccccaaccagaccgaggacggcgggcugccgcagucgggccggaucgucguggacuacauggugcagaaguccgggaagacgggcaccaucaccuaccagcgcggcauccuccugccccagaaggucuggugcgccagcgggcgguccaaggugaucaagggcucgcugccccucaucggggaggccgauugccugcacgagaaguacggcgggcugaacaagucgaagcccuacuacaccggcgagcacgcgaaggccaucggcaacugcccgaucugggugaagacgccccucaagcuggccaacgggaccaaguaccgcccgcccgccaagcugcucaaggagcggggcuucuuuggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagcgagcuggaggucaagaaccuccagcgccuguccggcgccauggacgagcugcacaacgagauccucgagcuggaugagaagguggacgaccugcgggccgacaccaucucgucccagaucgagcucgccgugcugcugagcaacgaggggaucaucaacuccgaggacgagcaccuccuggcgcuggagcgcaagcucaagaagaugcugggccccucggccgucgagaucgggaacggcugcuucgagaccaagcauaagugcaaccagaccugccuggacaagaucgccgccgggaccuucgacgcgggcgaguucucccuccccacguucgacucgcugaacaucaccgccgccucccugaacgacgauggccucgacaaccacaccauccugcuguacuacagcaccgccgccuccucgcuggcggugacgcucaugaucgccaucuucguggucuacauggugucccgggacaacgugagcugcuccaucugccuguga

SEQ ID NO: 16120 - RNA, 1755 nt, Artificial Sequence; identical to SEQ ID NO: 14114
  derived and/or modified CDS sequence (AUadapt) from InfluenzaB__AKA54644__HA

SEQ ID NO: 16121 - RNA, 1755 nt, Artificial Sequence
  derived and/or modified CDS sequence (AUadapt) from InfluenzaB__AKA54645__HA
augaaggccaucaccgugcugcucauggucgugaccaguaacgccgaccgcaucugcacgggcaucaccuccagcaacagcccccauguggucaagaccgcgacccagggggaggugaacgugacgggcgucaucccgcugaccaccacccccacgaaguccuacuucgccaaccugaaggggacccggacccgcggcaagcucugccccgacugccugaauugcaccgaccuggacguggcccucgggcggcccaugugcgugggcacgaccccguccgccaaggccagcauccugcacgagguccgccccgugaccuccggcuguuuccccaucaugcacgaccggaccaagauccgccagcugcccaaccuccugcggggguacgagaagauccgccugagcacgcagaacgugaucgaugcggagaaggccccgggcgggcccuaccggcucggcaccuccgggagcugccccaacgccaccuccaagaucggcuucuucgccaccauggcgugggccguccccaaggauaacuacaagaacgccacgaacccgcugaccguggaggugcccuacaucugcaccgagggcgaggaccagaucaccgucuggggguuucacagcgacaacaagacgcagaugaagucccuguacggcgacagcaauccccagaaguucaccuccagcgccgacggggugaccacccacuacgugucccagaucggcgacuuucccgaccagacggaggacggcgggcucccgcagagcggccgcaucgucguggacuacaugaugcagaagcccgggaagaccggcaccaucguguaccagcgcgggguccugcugccccagaagguguggugcgccuccggccggaguaaggugaucaagggcucgcucccccugaucggggaggcggacugccugcacgaggaguacggcgggcucaacaaguccaagccguauuacaccggcaagcacgccaaggccaucgggaacugccccaucugggucaagacgccccugaagcuggccaacggcaccaaguaccggcccccggccaagcuccugaaggagcgcggcuucuuuggggcgaucgccggcuuccuggagggcgggugggaggggaugaucgccggcuggcacggcuacaccagccacggggcccacggcguggccgucgcggccgaucucaaguccacccaggaggccaucaacaagaucacgaagaaccugaacagccuguccgagcucgaggugaagaaccugcagcggcugagcggggccauggacgagcuccauaacgagauccuggagcuggacgagaagguggacgaccuccgcgccgacaccaucuccagccagaucgagcuggcgguccugcucuccaacgagggcaucaucaauagcgaggacgagcaccuccuggcccuggagcggaagcugaagaagaugcugggccccuccgccguggacaucgggaacggcugcuuugagaccaagcacaagugcaaccagaccugccucgaccgcaucgccgcggggaccuucaacgccggcgaguuuagccugcccacguucgacucccugaacaucaccgccgccagccucaacgaugacgggcuggacaaccacaccauccugcuguacuacuccaccgccgcgagcucccucgccgugacgcugaugcuggccaucuuuaucgucuacauggugagccgggacaacguguccugcagcaucugccucuga

SEQ ID NO: 16122 - RNA, 1755 nt, Artificial Sequence; identical to SEQ ID NO: 14114
  derived and/or modified CDS sequence (AUadapt) from InfluenzaB__AKA54646__HA

SEQ ID NO: 16123 - RNA, 1755 nt, Artificial Sequence; identical to SEQ ID NO: 14114
  derived and/or modified CDS sequence (AUadapt) from InfluenzaB__AKA54647__HA

SEQ ID NO: 16124 - RNA, 1758 nt, Artificial Sequence; identical to SEQ ID NO: 14124
  derived and/or modified CDS sequence (AUadapt) from InfluenzaB__AKA54648__HA

SEQ ID NO: 16125 - RNA, 1755 nt, Artificial Sequence
  derived and/or modified CDS sequence (AUadapt) from InfluenzaB__AKA54649__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuauuucgccaaccugaaggggacgcggacccgcggcaagcucugccccgacugccugaacugcaccgaccuggauguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguaugagaagauccgccugagcacccagaacgugaucgacgcggagaaggccccgggcgggcccuaccggcucggcacguccgggucgugccccaacaccaccuccaagaucggcuucuuugccaccauggccugggcgguccccaaggacaacuacaagaacgccacgaacccgcugaccguggaggugcccuacaucugcaccgagggcgaggaccagaucaccgucuggggguuucacagcgacaacaagacgcagaugaagucccuguacggcgacagcaacccccagaaguuuaccuccagcgccaacggggugaccacccacuacgugucccagaucggcgacuuccccgaccagacggaggacggcgggcucccgcagaguggccgcaucgucguggacuacaugaugcagaagcccgggaagaccggcaccaucguguaccagcgcgggguccugcugccccagaagguguggugcgccuccggccggagcaaggugaucaagggcucgcucccccugaucggggaggccgacugccugcaugaggaguacggcgggcucaacaaguccaagccguacuacaccggcaagcacgcgaaggccaucgggaacugccccaucugggucaagacgccccugaagcuggccaacggcaccaaguaucggcccccggccaagcuccugaaggagcgcggcuucuucggggccaucgcgggcuuccuggagggcgggugggaggggaugaucgccggcuggcacggcuacaccagccacggggcccacggcguggccgucgccgcggaucucaaguccacccaggaggccaucaacaagaucacgaagaaccugaacagccuguccgagcucgaggugaagaaccugcagcggcugagcggggccauggacgagcuccacaaugagauccuggagcuggacgagaagguggacgaccuccgcgccgacaccaucuccagccagaucgagcuggccguccugcucuccaacgagggcaucaucaacucggaggaugagcaccuccuggcgcuggagcggaagcugaagaagaugcugggccccuccgccguggacaucgggaacggcugcuucgagaccaagcacaagugcaaccagaccugucucgaccgcaucgccgccgggaccuucaacgcgggcgaguucagccugcccacguucgacucccugaacaucaccgccgccagucucaacgacgacgggcuggacaaccacaccauccugcuguacuacuccaccgccgccaguucccucgcggugacgcugaugcuggccaucuucaucgucuacauggugagccgggacaacguguccugcagcaucugccucuga

SEQ ID NO: 16126 - RNA, 1755 nt, Artificial Sequence; identical to SEQ ID NO: 14114
  derived and/or modified CDS sequence (AUadapt) from InfluenzaB__AKU40581__HA

SEQ ID NO: 16127 - RNA, 1755 nt, Artificial Sequence; identical to SEQ ID NO: 14114
  derived and/or modified CDS sequence (AUadapt) from InfluenzaB__AKU40592__HA

SEQ ID NO: 16128 - RNA, 1755 nt, Artificial Sequence; identical to SEQ ID NO: 14093
  derived and/or modified CDS sequence (AUadapt) from InfluenzaB__AKU40603__HA

SEQ ID NO: 16129 - RNA, 1755 nt, Artificial Sequence; identical to SEQ ID NO: 14114
  derived and/or modified CDS sequence (AUadapt) from InfluenzaB__AKU40614__HA

SEQ ID NO: 16130 - RNA, 1755 nt, Artificial Sequence; identical to SEQ ID NO: 14093
  derived and/or modified CDS sequence (AUadapt) from InfluenzaB__AKU40625__HA

SEQ ID NO: 16131 - RNA, 1755 nt, Artificial Sequence
  derived and/or modified CDS sequence (AUadapt) from InfluenzaB__AKU40636__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccgccaaguccuauuucgccaaccugaaggggacccggacgcgcggcaagcucugccccgacugccugaacugcaccgaccuggacguggcccucgggcggcccaugugugugggcaccaccccguccgccaaggcgagcauccugcacgagguccgccccgugacguccggcugcuuccccaucaugcacgaccggaccaagauccgccagcugcccaaccuccugcggggguacgagaacauccgccugaguaccaagaacgugaucgacgccgagaaggccccgggcgggcccuaccggcucggcaccuccgggagcugccccaacgccacguccaagaucggcuucuucgcgaccauggccugggccguccccaaggauaacuacaagaacgccaccaacccgcugaccguggaggugcccuacaucugcaaggagggcgaggaccagaucacggucuggggguuccacagugacaacaagacccagaugaagaaccuguacggcgacuccaacccccagaaguucaccagcuccgccaacggggugaccacgcauuacgugucgcagaucggcgacuuccccgaccagaccgaggacggcgggcucccgcaguccggccgcaucgucguggacuacaugaugcagaagcccgggaagaccggcaccaucguguaucagcgcgggguccugcugccccagaagguguggugcgcgagcggccgguccaaggugaucaagggcagccucccccugaucggggaggccgacugccugcacgaggaguacggcgggcucaacaagagcaagccguauuacacgggcaagcacgccaaggccaucgggaacugccccaucugggucaagacgccccugaagcuggccaacggcaccaaguaccggcccccggcgaagcuccugaaggagcgcggcuucuucggggccaucgccggcuuccuggagggcgggugggaggggaugaucgccggcuggcauggcuacaccucccacggggcccacggcguggcggucgccgccgaccucaagucgacccaggaggccaucaacaagaucaccaagaaccugaacucccugagugagcucgaggugaagaaccugcagcggcuguccggggccauggacgagcuccacaacgagauccuggagcuggacgagaagguggacgaccuccgcgcggacaccaucagcucccagaucgagcuggccguccugcucaguaacgagggcaucaucaacuccgaggacgagcaccuccuggcccuggagcggaagcugaagaagaugcugggccccucggccguggacaucgggaacggcugcuucgagaccaagcauaagugcaaccagacgugccucgaccgcaucgcggccgggaccuucaacgccggcgaguucucccugcccaccuucgauagccugaacaucaccgccgccucccucaacgacgacgggcuggacaaccacaccauccugcuguacuauagcacggcggccuccagccucgccgugacccugaugcuggccaucuucaucgucuacauggugucccgggacaacgugagcugcuccaucugccucuga

SEQ ID NO: 16132 - RNA, 1755 nt, Artificial Sequence
  derived and/or modified CDS sequence (AUadapt) from InfluenzaB__AKU40647__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuauuucgccaaccugaaggggacgcggacccgcggcaagcucugccccgacugccugaacugcaccgaccuggauguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguaugagaagauccgccugucgacccagaacgugaucgacgcggagaaggccccgggcgggcccuaccggcucggcacguccgggagcugccccaacgccaccuccaagaucggcuucuuugccaccauggcgugggccguccccaaggacaacuacaagaacgccaccaacccgcagacgguggagauccccuacaucugcaccgagggcgaggaccagaucaccguguggggguuucacagcgacaacaagacccagaugaagucccuguacggcgacagcaacccccagaaguuuacguccucggccaacggggucaccacccacuacgugucccagaucggcgacuuccccgaccagaccgaggacggcgggcugccgcagaguggccgcaucguggucgacuacaugaugcagaagcccgggaagacgggcaccaucguguaccagcgcggggugcuccugccccagaaggucuggugcgccuccggccggagcaaggugaucaagggcagccugccccucaucggggaggcggacugccugcaugaggaguacggcgggcugaacaaguccaagccguacuacaccggcaagcacgccaaggccaucgggaacugccccaucugggugaagacgccccucaagcuggccaacggcaccaaguaucggcccccggccaagcugcucaaggagcgcggcuucuucggggcgaucgccggcuuccuggagggcgggugggaggggaugaucgccggcuggcacggcuacaccagccacggggcccacggcgucgccguggcggccgaucugaaguccacccaggaggccaucaacaagaucaccaagaaccucaacucgcuguccgagcuggaggucaagaaccuccagcggcugagcggggccauggacgagcugcacaaugagauccucgagcuggacgagaagguggacgaccugcgcgccgacacgaucuccagccagaucgagcucgcggugcugcuguccaacgagggcaucaucaacagcgaggaugagcaccuccuggcccuggagcggaagcucaagaagaugcugggccccuccgccgucgacaucgggaacggcugcuucgagaccaagcacaagugcaaccagaccugucuggaccgcaucgccgcggggaccuucaacgccggcgaguucucgcuccccaccuucgacucccugaacaucacggccgccagucugaacgacgacgggcucgacaaccacaccauccugcuguacuacuccaccgccgcgaguucccuggccgugacccucaugcuggccaucuucaucguguacauggucagccgggacaacguguccugcagcaucugccuguga

SEQ ID NO: 16133 - RNA, 1755 nt, Artificial Sequence; identical to SEQ ID NO: 14114
  derived and/or modified CDS sequence (AUadapt) from InfluenzaB__AKU40658__HA

SEQ ID NO: 16134 - RNA, 1755 nt, Artificial Sequence; identical to SEQ ID NO: 14114
  derived and/or modified CDS sequence (AUadapt) from InfluenzaB__AKU40669__HA

SEQ ID NO: 16135 - RNA, 1755 nt, Artificial Sequence; identical to SEQ ID NO: 14114
  derived and/or modified CDS sequence (AUadapt) from InfluenzaB__AKU40680__HA

SEQ ID NO: 16136 - RNA, 1755 nt, Artificial Sequence
  derived and/or modified CDS sequence (AUadapt) from InfluenzaB__AKU40691__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuauuucgccaaccugaaggggacgcggacccgcggcaagcucugccccgacugccugaacugcaccgaccuggauguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguaugagaagauccgccugagcacccagaacgugaucgacgcggagaaggccccgggcgggcccuaccggcucggcacguccgggucgugccccaacgccaccuccaagaucggcuucuuugccaccauggcgugggccguccccaaggacaacuacaagaacgccaccaacccgcagacgguggaggugcccuacaucugcaccgagggcgaggaccagaucaccgucuggggguuucacagcgacaacaagacccagaugaagucccuguacggcgacagcaacccccagaaguuuacguccagcgccaacggggugaccacccacuacgugucccagaucggcgacuuccccgaccagaccgaggacggcgggcugccgcagaguggccgcaucgucguggacuacaugaugcagaagcccgggaagacgggcaccaucguguaccagcgcgggguccuccugccccagaagguguggugcgccuccggccggagcaaggugaucaagggcucgcugccccucaucggggaggcggacugccugcaugaggaguacggcgggcugaacaaguccaagccguacuacaccggcaagcacgccaaggccaucgggaacugccccaucugggucaagacgccccucaagcuggccaacggcaccaaguaucggcccccggccaagcugcucaaggagcgcggcuucuucggggcgaucgccggcuuccuggagggcgggugggaggggaugaucgccggcuggcacggcuacaccagccacggggcccacggcguggccgucgcggccgaucugaaguccacccaggaggccaucaacaagaucaccaagaaccucaacagccuguccgagcuggaggugaagaaccuccagcggcugagcggggccauggacgaguuccauaacgagauccuggagcucgacgagaagguggacgaccugcgcgccgacacgaucuccagccagaucgagcuggcgguccuccuguccaacgagggcaucaucaacagugaggacgagcaccuccuggcccuggagcggaagcugaagaagaugcucggccccuccgccguggacaucgggaacggcugcuucgagaccaagcacaagugcaaucagaccugccuggaccgcaucgccgcggggaccuucaacgccggcgaguucagccugcccaccuucgacucccucaauaucacggccgccagccugaacgacgacgggcuggacaaccacaccauccuccuguacuauuccaccgccgcgagcucccuggccgugacccugaugcucgccaucuucaucgucuacauggugagccgggacaacguguccugcagcaucugccuguga

SEQ ID NO: 16137 - RNA, 1755 nt, Artificial Sequence; identical to SEQ ID NO: 14114
  derived and/or modified CDS sequence (AUadapt) from InfluenzaB__AKU40702__HA

SEQ ID NO: 16138 - RNA, 1755 nt, Artificial Sequence; identical to SEQ ID NO: 14114
  derived and/or modified CDS sequence (AUadapt) from InfluenzaB__AKU40713__HA

SEQ ID NO: 16139 - RNA, 1755 nt, Artificial Sequence; identical to SEQ ID NO: 14093
  derived and/or modified CDS sequence (AUadapt) from InfluenzaB__AKU40724__HA

SEQ ID NO: 16140 - RNA, 1755 nt, Artificial Sequence; identical to SEQ ID NO: 16132
  derived and/or modified CDS sequence (AUadapt) from InfluenzaB__AKU40735__HA

SEQ ID NO: 16141 - RNA, 1755 nt, Artificial Sequence; identical to SEQ ID NO: 14114
  derived and/or modified CDS sequence (AUadapt) from InfluenzaB__AKU40746__HA

SEQ ID NO: 16142 - RNA, 1755 nt, Artificial Sequence; identical to SEQ ID NO: 14114
  derived and/or modified CDS sequence (AUadapt) from InfluenzaB__AKU40757__HA

SEQ ID NO: 16143 - RNA, 1755 nt, Artificial Sequence; identical to SEQ ID NO: 14114
  derived and/or modified CDS sequence (AUadapt) from InfluenzaB__AKU40768__HA

SEQ ID NO: 16144 - RNA, 1755 nt, Artificial Sequence; identical to SEQ ID NO: 14114
  derived and/or modified CDS sequence (AUadapt) from InfluenzaB__AKU40779__HA

SEQ ID NO: 16145 - RNA, 1755 nt, Artificial Sequence; identical to SEQ ID NO: 14093
  derived and/or modified CDS sequence (AUadapt) from InfluenzaB__AKU40790__HA

SEQ ID NO: 16146 - RNA, 1755 nt, Artificial Sequence; identical to SEQ ID NO: 14114
  derived and/or modified CDS sequence (AUadapt) from InfluenzaB__AKU40801__HA

SEQ ID NO: 16147 - RNA, 1755 nt, Artificial Sequence
  derived and/or modified CDS sequence (AUadapt) from InfluenzaB__AKU40812__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacuguaccgaccuggacguggcccucgggcggcccaugugcgugggcaccacgccguccgccaaggccagcauccugcacgagguccgccccgugaccuccggcugcuuccccaucaugcaugaccggaccaagauccgccagcugcccaaccuccugcggggguacgagaagauccgccugagcacccagaacgugaucgacgcggagaaggccccgggcgggcccuaccggcucggcacguccgggaguugccccaacgccaccuccaagaucggcuucuucgccaccauggcgugggccguccccaaggacaacuacaagaaugccaccaacccgcagacgguggaggugcccuacaucugcaccgagggcgaggaccagaucaccgucuggggguuccacagcgauaacaagacccagaugaagucccuguacggcgacucgaacccccagaaguucacguccagcgccaauggggugaccacccacuacgugucccagaucggcgacuuccccgaccagaccgaggacggcgggcugccgcagagcggccgcaucgucguggauuacaugaugcagaagcccgggaagacgggcaccaucguguaccagcgcgggguccuccugccccagaagguguggugcgccuccggccggagcaaggugaucaagggcagccugccccucaucggggaggcggacugccugcaugaggaguacggcgggcugaacaaguccaagccguacuacaccggcaagcacgccaaggccaucgggaacugccccaucugggucaagacgccccucaagcuggccaauggcaccaaguaccggcccccggccaagcugcucaaggagcgcggcuucuucggggcgaucgccggcuuccuggagggcgggugggaggggaugaucgccggcuggcacggcuacaccagccauggggcccacggcguggccgucgcggccgaccugaaguccacccaggaggccaucaacaagaucaccaagaaccucaacagccuguccgagcuggaggugaagaaccuccagcggcugaguggggccauggacgagcugcacaacgagauccucgagcuggacgagaagguggacgaccugcgcgccgacacgaucuccagucagaucgagcucgcgguccugcuguccaacgagggcaucaucaacagcgaggacgagcaccuccuggcccuggagcggaagcucaagaagaugcugggccccuccgccguggacaucgggaacggcuguuucgagaccaagcacaagugcaaccagaccugccuggaccgcaucgccgcggggaccuucaaugccggcgaguucagccuccccaccuucgacucccugaacaucacggccgccagccugaacgaugacgggcucgacucccacaccauccugcuguacuacagcaccgccgcguccagccuggccgugacccucaugcuggccaucuuuaucgucuacauggugucccgggacaacgugagcugcagcaucugccuguga

SEQ ID NO: 16148 - RNA, 1755 nt, Artificial Sequence; identical to SEQ ID NO: 14114
  derived and/or modified CDS sequence (AUadapt) from InfluenzaB__AKU40823__HA

SEQ ID NO: 16149 - RNA, 1755 nt, Artificial Sequence; identical to SEQ ID NO: 14114
  derived and/or modified CDS sequence (AUadapt) from InfluenzaB__AKU40834__HA

SEQ ID NO: 16150 - RNA, 1755 nt, Artificial Sequence; identical to SEQ ID NO: 14114
  derived and/or modified CDS sequence (AUadapt) from InfluenzaB__AKU40845__HA

SEQ ID NO: 16151 - RNA, 1755 nt, Artificial Sequence; identical to SEQ ID NO: 14114
  derived and/or modified CDS sequence (AUadapt) from InfluenzaB__AKU40856__HA

SEQ ID NO: 16152 - RNA, 1755 nt, Artificial Sequence; identical to SEQ ID NO: 14114
  derived and/or modified CDS sequence (AUadapt) from InfluenzaB__AKU40867__HA

SEQ ID NO: 16153 - RNA, 1755 nt, Artificial Sequence; identical to SEQ ID NO: 14114
  derived and/or modified CDS sequence (AUadapt) from InfluenzaB__AKU40878__HA

SEQ ID NO: 16154 - RNA, 1758 nt, Artificial Sequence
  derived and/or modified CDS sequence (AUadapt) from InfluenzaB__AKU40889__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccauuucgccaaccugaaggggacggagacccggggcaagcucugccccaagugccugaacugcaccgaccuggacguggcccucgggcgccccaagugcaccggcaagaucccguccgcccgggugaguauccugcacgagguccgccccgugacguccggcugcuuccccaucaugcacgaccggaccaagauccgccagcugcccaaccuccugcggggguacgagcacauccgccugagcacccauaacgugaucaacgccgaggacgcgccgggcgggcccuacaagaucggcaccuccgggucgugccccaacgucacgaacggcaacggcuuuuucgccaccauggccugggccgugcccaagaacgacaagaacaagaccgcgaccaacccgcucacgaccgaggugcccuacaucugcaccgagggggaggaccagaucaccgucuggggcuuccacuccgauaacgagacgcagauggccaagcuguacggggacagcaagccccagaaguucaccuccucggccaacggcgugaccacccacuacgugucccagaucggcggguuucccaaccagacggaggacggcgggcugccgcagagcggccggaucgucguggacuacauggugcagaaguccgggaagaccggcaccaucaccuaccagcgcggcauccuccugccccagaaggucuggugcgccucggggcgguccaaggugaucaagggcagccugccccucaucggggaggccgauugccugcacgagaaguacggcgggcugaacaagucgaagcccuacuacacgggcgagcacgcgaaggccaucggcaacuguccgaucugggugaagacgccccucaagcuggccaacgggaccaaguaccgcccgcccgccaagcugcucaaggagcggggcuucuucggggccaucgcgggcuuccuggagggcgggugggagggcaugaucgccggguggcacggcuacaccucccacggggcccacggcgucgccguggccgcggaucugaaguccacccaggaggccaucaacaagaucaccaagaaccucaacucccugagcgagcuggaggucaagaaccuccagcgccuguccggcgccauggacgagcugcacaacgagauccucgagcuggacgagaagguggacgaucugcgggccgacaccaucucgucccagaucgagcucgccgugcugcugagcaacgaggggaucaucaacuccgaggacgagcaccuccuggcgcuggagcgcaagcucaagaagaugcugggccccucggccgucgagaucgggaacggcuguuucgagaccaagcacaagugcaaccagaccugccuggaccggaucgccgccgggacguucgacgcgggcgaguucucccuccccaccuuugacagccugaacaucaccgccgccucccugaacgacgacggccucgacaaccacaccauccugcuguauuacucgacggccgccuccagccuggcggugacccucaugaucgccaucuucguggucuacauggugucccgcgacaacgugagcugcuccaucugccuguga

SEQ ID NO: 16155 - RNA, 1755 nt, Artificial Sequence; identical to SEQ ID NO: 14114
  derived and/or modified CDS sequence (AUadapt) from InfluenzaB__AKU40900__HA

SEQ ID NO: 16156 - RNA, 1755 nt, Artificial Sequence; identical to SEQ ID NO: 14093
  derived and/or modified CDS sequence (AUadapt) from InfluenzaB__AKU40911__HA

SEQ ID NO: 16157 - RNA, 1755 nt, Artificial Sequence
  derived and/or modified CDS sequence (AUadapt) from InfluenzaB__AKU40922__HA
augaaggccaucaucgugcugcucauggucgugaccaguaacgccgaccgcaucugcaccggcaucacguccagcaacagcccccacguggucaagaccgugacccagggggaggugaacgucaccggcgugaucccgcugacgaccacccccaccaaguccuauuucgcgaaccugaaggggacgcggacccgcggcaagcucugccccgacugccugaacugcaccgaccuggauguggcccucgggcggcccaugugcgucggcaccacgccguccgccaaggccagcauccugcacgaggugcgccccgugaccuccggcugcuuccccaucaugcacgaccggaccaagauccgccagcugcccaaccuccugcggggguaugagaagauccgccugagcacccagaacgucaucgacgccgagaaggcgccgggcgggcccuaccggcucggcacguccgggucgugccccaacgccaccuccaagaucggcuucuuugccaccauggccugggcggugcccaaggacaacuacaagaacgccaccaacccgcagacgguggagguccccuacaucugcaccgagggcgaggaccagaucaccguguggggguuucacagcgacaacaagacccagaugaagucccuguacggcgacagcaacccccagaaguuuacguccagcgccaacggggugaccacccacuacgucucccagaucggcgacuuccccgaccagaccgaggacggcgggcugccgcagaguggccgcaucgugguggacuacaugaugcagaagcccgggaagacgggcaccaucgucuaccagcgcggggugcuccugccccagaagguguggugcgccuccggccggagcaaggucaucaagggcucgcugccccucaucggggaggccgacugccugcaugaggaguacggcgggcugaacaaguccaagccguacuacaccggcaagcacgcgaaggccaucgggaacugccccaucugggugaagacgccccucaagcuggccaacggcaccaaguaucggcccccggccaagcugcucaaggagcgcggcuucuucggggccaucgcgggcuuccuggagggcgggugggaggggaugaucgccggcuggcacggcuacaccagccacggggcccacggcgucgccguggccgcggaucugaaguccacccaggaggccaucaacaagaucaccaagaaccucaacagccuguccgagcuggaggugaagaaccuccagcggcugagcggggccauggacgagcugcacaaugagauccucgagcuggacgagaaggucgacgaccugcgcgccgacacgaucuccagccagaucgagcucgccgugcugcuguccaacgagggcaucaucaacucggaggaugagcaccuccuggcgcuggagcggaagcucaagaagaugcugggccccuccgccguggacaucgggaacggcugcuucgagaccaagcacaagugcaaccagaccugucuggaccgcaucgccgccgggaccuucaacgcgggcgaguucagccuccccaccuucgacucccugaacaucacggccgccagucugaacgacgacgggcucgacaaccacaccauccugcuguacuacuccaccgccgccaguucccuggcggucacccucaugcuggccaucuucaucguguacauggugagccgggacaacgucuccugcagcaucugccuguga

SEQ ID NO: 16158 - RNA, 1755 nt, Artificial Sequence; identical to SEQ ID NO: 16132
  derived and/or modified CDS sequence (AUadapt) from InfluenzaB__AKU40933__HA

SEQ ID NO: 16159 - RNA, 1755 nt, Artificial Sequence; identical to SEQ ID NO: 14114
  derived and/or modified CDS sequence (AUadapt) from InfluenzaB__AKU40944__HA

SEQ ID NO: 16160 - RNA, 1755 nt, Artificial Sequence; identical to SEQ ID NO: 14114
  derived and/or modified CDS sequence (AUadapt) from InfluenzaB__AKU40955__HA

SEQ ID NO: 16161 - RNA, 1755 nt, Artificial Sequence; identical to SEQ ID NO: 14114
  derived and/or modified CDS sequence (AUadapt) from InfluenzaB__AKU40966__HA

SEQ ID NO: 16162 - RNA, 1755 nt, Artificial Sequence; identical to SEQ ID NO: 14114
  derived and/or modified CDS sequence (AUadapt) from InfluenzaB__AKU40977__HA

SEQ ID NO: 16163 - RNA, 1755 nt, Artificial Sequence; identical to SEQ ID NO: 14114
  derived and/or modified CDS sequence (AUadapt) from InfluenzaB__AKU40987__HA

SEQ ID NO: 16164 - RNA, 1755 nt, Artificial Sequence; identical to SEQ ID NO: 14114
  derived and/or modified CDS sequence (AUadapt) from InfluenzaB__AKU40998__HA

SEQ ID NO: 16165 - RNA, 1755 nt, Artificial Sequence; identical to SEQ ID NO: 14114
  derived and/or modified CDS sequence (AUadapt) from InfluenzaB__AKU41009__HA

SEQ ID NO: 16166 - RNA, 1755 nt, Artificial Sequence; identical to SEQ ID NO: 14114
  derived and/or modified CDS sequence (AUadapt) from InfluenzaB__AKU41020__HA

SEQ ID NO: 16167 - RNA, 1755 nt, Artificial Sequence; identical to SEQ ID NO: 14114
  derived and/or modified CDS sequence (AUadapt) from InfluenzaB__ALA08485__HA

SEQ ID NO: 16168 - RNA, 1755 nt, Artificial Sequence; identical to SEQ ID NO: 14114
  derived and/or modified CDS sequence (AUadapt) from InfluenzaB__ALA08486__HA

SEQ ID NO: 16169 - RNA, 1755 nt, Artificial Sequence; identical to SEQ ID NO: 14114
  derived and/or modified CDS sequence (AUadapt) from InfluenzaB__ALA08487__HA

SEQ ID NO: 16170 - RNA, 1755 nt, Artificial Sequence; identical to SEQ ID NO: 14114
  derived and/or modified CDS sequence (AUadapt) from InfluenzaB__ALA08564__HA

SEQ ID NO: 16171 - RNA, 1755 nt, Artificial Sequence; identical to SEQ ID NO: 14114
  derived and/or modified CDS sequence (AUadapt) from InfluenzaB__ALA08565__HA

SEQ ID NO: 16172 - RNA, 1755 nt, Artificial Sequence; identical to SEQ ID NO: 14114
  derived and/or modified CDS sequence (AUadapt) from InfluenzaB__ALA08566__HA

SEQ ID NO: 16173 - RNA, 1755 nt, Artificial Sequence; identical to SEQ ID NO: 14114
  derived and/or modified CDS sequence (AUadapt) from InfluenzaB__ALA08567__HA

SEQ ID NO: 16174 - RNA, 1755 nt, Artificial Sequence; identical to SEQ ID NO: 14114
  derived and/or modified CDS sequence (AUadapt) from InfluenzaB__ALA08568__HA

SEQ ID NO: 16175 - RNA, 1755 nt, Artificial Sequence; identical to SEQ ID NO: 14114
  derived and/or modified CDS sequence (AUadapt) from InfluenzaB__ALA08569__HA

SEQ ID NO: 16176 - RNA, 1758 nt, Artificial Sequence
  derived and/or modified CDS sequence (AUadapt) from InfluenzaB__ALA08689__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuuugccaaccugaaggggacggagacccggggcaagcucugccccaagugccccaacugcaccgaccuggacguggcccuggggcgcccgaagugcaccggcaagauccccuccgcccgggugagcauccuccacgagguccgccccgugacguccggcuguuuccccaucaugcacgaccggaccaagauccgccagcugccgaaccugcuccggggguacgagcacauccgccugucgacccacaacgugaucaacgccgagaaugcgcccggcgggcccuacaagaucggcaccuccgggagcugccccaacgucacgaacggcaacggcuucuucgccaccauggccugggccgugccgaagaacgacaagaauaagaccgcgaccaacccccugacgaucgaggugcccuacaucugcaccgagggggaggaccagaucaccgucuggggcuuccacuccgacaacgagacccagauggccaagcucuacggggacaguaacccccagaaguucacguccagcgccaacggcgugaccacccacuacgugucccagaucggcggguucccgaaccagaccgaggacggcgggcugccccagucgggccggaucgucguggauuacauggugcagaaguccgggaagacgggcaccaucaccuaccagcgcggcauccugcucccccagaaggucuggugcgccagcgggcgguccaaggugaucaagggcucgcugccccugaucggggaggccgacugccuccacgagaaguacggcgggcugaacaagaguaagccguacuacaccggcgagcacgcgaaggccaucggcaacugccccaucugggugaagacgccccugaagcucgccaacgggaccaaguaccggcccccggccaagcugcugaaggagcgcggcuucuucggggccaucgcgggcuuccucgagggcgggugggagggcaugaucgccggguggcauggcuacaccucccacggggcccacggcgucgccguggccgcggaccugaaguccacccaggaggccaucaacaagaucacgaagaaccugaacucccucucggagcuggaggucaagaaccugcagcgccucuccggcgccauggacgagcugcauaacgagauccuggagcucgacgagaagguggacgaccugcgggccgacaccaucagcucccagaucgagcuggccgugcuccugucgaacgaggggaucaucaacuccgaggacgagcaucuccuggcgcuggagcgcaagcugaagaagaugcucggccccagcgccgucgagaucgggaacggcugcuucgagaccaagcacaagugcaaccagaccugccuggaccggaucgccgccgggaccuucgaugcgggcgaguucucccugcccacguucgacucgcucaacaucaccgccgccucccugaacgacgacggccuggacaaccauaccauccuccuguacuacagcaccgccgccuccucgcuggcggugacgcugaugaucgccaucuucguggucuacauggugucccgcgacaacgugagcugcuccaucugccucuga

SEQ ID NO: 16177 - RNA, 1758 nt, Artificial Sequence
  derived and/or modified CDS sequence (AUadapt) from InfluenzaB__ALA08690__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuuugccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuucccaucaugcacgaccggaccaagauccgccagcugcccaaccuccugcggggguacgagcacauccgccugucgacccacaacgugaucaacgccgaggacgcgccgggcgggcccuacaagaucggcaccuccgggaguugccccaacaucacgaacggcaacggcuucuucgccaccauggccugggccguccagaagaacgacaagaacaagaccgcgaccaacccccucacgaucgaggugccguacaucuguaccgagggggaggaccagaucaccguguggggcuuccacuccgacaacgagacccagauggccaagcuguacggggacucgaagccccagaaguucacguccagcgccaacggcgucaccacccauuacgugucccagaucggcggguuccccaaccagaccgaggacggcgggcugccccagucgggccggaucguggucgacuacauggugcagaaguccgggaagacgggcaccaucaccuaccagcgcggcauccuccugccgcagaagguguggugcgccagcgggcgguccaaggucaucaagggcucgcugccccucaucggggaggccgauugccugcacgagaaguacggcgggcugaacaagagcaagcccuacuacaccggcgagcacgcgaaggccaucggcaacugccccaucugggugaagacgccgcucaagcuggccaacgggaccaaguaucgcccgcccgccaagcugcucaaggagcggggcuucuucggggccaucgcgggcuuccuggagggcgggugggagggcaugaucgccggguggcacggcuacaccucccacggggcccacggcguggccgucgccgcggaccugaaguccacccaggaggccaucaacaagaucacgaagaaccucaacucccugagugagcuggaggugaagaaccuccagcgccuguccggcgccauggacgagcugcacaacgagauccucgagcuggacgagaaggucgacgaccugcgggccgacaccaucagcucccagaucgagcucgccgugcugcugucgaacgaggggaucaucaauuccgaggacgagcaccuccuggcgcuggagcgcaagcucaagaagaugcugggccccagcgccguggagaucgggaacggcugcuucgagaccaagcacaagugcaaccagaccugccuggaccggaucgccgccgggaccuuugacgcgggcgaguucucccuccccacguucgacucgcugaacaucaccgccgccucccugaacgacgacggccucgacgaccauaccauccugcuguacuacagcaccgccgccuccucgcuggcggucacgcucaugaucgccaucuucgugguguacauggucucccgcgacaacgugagcugcuccaucugccuguga

SEQ ID NO: 16178 - RNA, 1755 nt, Artificial Sequence; identical to SEQ ID NO: 14114
  derived and/or modified CDS sequence (AUadapt) from InfluenzaB__ALE31766__HA

SEQ ID NO: 16179 - RNA, 1758 nt, Artificial Sequence
  derived and/or modified CDS sequence (AUadapt) from InfluenzaB__ALE31768__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuuugccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuucccaucaugcacgaccggaccaagauccgccagcugcccaaccuccugcggggguacgagcacauccgccugucgacccacaacgugaucaacgccgaggacgcgccgggcgggcccuacaagaucggcaccuccgggaguugccccaacaucacgaacggcaacggcuucuucgccaccauggccugggccguccccaagaacgacaagaacaagaccgcgaccaacccgcucacgaucgaggugcccuacaucuguaccgagggggaggaccagaucaccguguggggcuuccacuccgacaacgagacccagauggccaagcuguacggggacucgaagccccagaaguucacguccagcgccaacggcgucaccacccauuacgugucccagaucggcggguuccccaaccagaccgaggacggcgggcugccgcagucgggccggaucguggucgacuacauggugcagaaguccgggaagacgggcaccaucaccuaccagcgcggcauccuccugccccagaagguguggugcgccagcgggcgguccaaggucaucaagggcucgcugccccucaucggggaggccgauugccugcacgagaaguacggcgggcugaacaagagcaagcccuacuacaccggcgagcacgcgaaggccaucggcaacugcccgaucugggugaagacgccccucaagcuggccaacgggaccaaguaucgcccgcccgccaagcugcucaaggagcggggcuucuucggggccaucgcgggcuuccuggagggcgggugggagggcaugaucgccggguggcacggcuacaccucccacggggcccacggcguggccgucgccgcggaccugaaguccacccaggaggccaucaacaagaucacgaagaaccucaacucccugagugagcuggaggugaagaaccuccagcgccuguccggcgccauggacgagcugcacaacgagauccucgagcuggacgagaaggucgacgaccugcgggccgacaccaucagcucccagaucgagcucgccgugcugcugucgaacgaggggaucaucaauuccgaggacgagcaccuccuggcgcuggagcgcaagcucaagaagaugcugggccccagcgccguggagaucgggaacggcugcuucgagaccaagcacaagugcaaccagaccugccuggaccggaucgccgccgggaccuuugacgcgggcgaguucucccuccccacguucgacucgcugaacaucaccgccgccucccugaacgacgacggccucgacaaccauaccauccugcuguacuacagcaccgccgccuccucgcuggcggucacgcucaugaucgccaucuucgugguguacauggucucccgcgacaacgugagcugcuccaucugccuguga

SEQ ID NO: 16180 - RNA, 1758 nt, Artificial Sequence
  derived and/or modified CDS sequence (AUadapt) from InfluenzaB__ALE31770__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccacuucgccaaucugaaggggacggagacccggggcaagcucugccccaagugccugaacugcaccgaccuggacguggcccucgggcgccccaagugcaccggcaagaucccguccgcccgggugucgauccugcacgagguccgccccgugacguccggcugcuuccccaucaugcaugaccggaccaagauccgccagcugcccaaccuccugcggggguacgagcacaucagccuguccacccacaacgugaucaacgccgaggacgcgccgggcgggcccuacaagaucggcaccucgggguccugucccaacgucacgaacggcaacggcuucuucgccaccauggccugggccgugcccaagaacgacaagaacaagaccgcgaccaacccgcucacgaucgaggugcccuacaucugcaccgagggggaggaucagaucaccgucuggggcuuccacagcgacaacgagacccagauggccaagcuguacggggacuccaagccccagaaguucacgucguccgccaacggcgugaccacccacuaugugagccagaucggcggguuccccaaccagaccgaggacggcgggcugccgcaguccggccgcaucgucguggacuacauggugcagaaguccgggaagacgggcaccaucaccuaccagcggggcauccuccugccccagaaggucuggugcgccuccgggcgcucgaaggugaucaagggcagccugccccucaucggggaggccgacugucugcacgagaaguacggcgggcugaacaaguccaagcccuacuacaccggcgagcacgcgaaggccaucggcaacugcccgaucugggugaagacgccccucaagcuggccaacgggaccaaguaccggccgcccgccaagcugcucaaggagcgcggcuucuuuggggccaucgcgggcuuccuggagggcgggugggagggcaugaucgccggguggcacggcuacaccucgcacggggcccacggcgucgccguggccgcggaccugaaguccacccaggaggccaucaacaagaucacgaagaaccucaacagccuguccgagcuggaggucaagaaucuccagcggcugucgggcgccauggacgagcugcacaacgagauccucgagcuggacgagaagguggacgaccugcgcgccgacaccaucuccagccagaucgagcucgccgugcugcuguccaacgaggggaucaucaacagugaggacgagcaccuccuggcgcuggagcggaagcucaagaagaugcugggccccuccgccgucgagaucgggaacggcugcuucgagaccaagcacaagugcaaccagaccugccuggaccgcaucgccgccgggaccuucgaugcgggcgaguucagccuccccacguucgacucccugaacaucaccgccgccucgcugaacgacgacggccucgacaaccauaccauccugcuguacuacuccaccgccgccagcucccuggcggugacgcucaugaucgccaucuucguggucuacauggugucgcgggacaacguguccugcagcaucugccuguga

SEQ ID NO: 16181 - RNA, 1755 nt, Artificial Sequence; identical to SEQ ID NO: 14114
  derived and/or modified CDS sequence (AUadapt) from InfluenzaB__ALE31772__HA

SEQ ID NO: 16182 - RNA, 1755 nt, Artificial Sequence; identical to SEQ ID NO: 14114
  derived and/or modified CDS sequence (AUadapt) from InfluenzaB__ALE31773__HA

SEQ ID NO: 16183 - RNA, 1755 nt, Artificial Sequence
  derived and/or modified CDS sequence (AUadapt) from InfluenzaB__ALE31884__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacuguaccgaccuggacguggcccucgggcggcccaugugcgugggcaccacgccguccgccaaggccagcauccugcacgagguccgccccgugaccuccggcugcuuccccaucaugcaugaccggaccaagauccgccagcugcccaaccuccugcggggguacgagaagauccgccugagcacccagaacgugaucgacgcggagaaggccccgggcgggcccuaccggcucggcacguccgggaguugccccaacgccaccuccaagaucggcuucuucgccaccauggcgugggccguccccaaggacaacuacaagaaugccaccaacccgcagacgguggaggugcccuacaucugcaccgagggcgaggaccagaucaccgucuggggguuccacagcgauaacaagacccagaugaagucccuguacggcgacucgaacccccagaaguucacguccagcgccaauggggugaccacccacuacgugucccagaucggcgacuuccccgaccagaccgaggacggcgggcugccgcagagcggccgcaucgucguggauuacaugaugcagaagcccgggaagacgggcaccaucguguaccagcgcgggguccuccugccccagaagguguggugcgccuccggccggagcaaggugaucaagggcagccugccccucaucggggaggcggacugccugcaugaggaguacggcgggcugaacaaguccaagccguacuacaccggcaagcacgccaaggccaucgggaacugccccaucugggucaagacgccccucaagcuggccaauggcaccaaguaccggcccccggccaagcugcucaaggagcgcggcuucuucggggcgaucgccggcuuccuggagggcgggugggaggggaugaucgccggcuggcacggcuacaccagccauggggcccacggcguggccgucgcggccgaccugaaguccacccaggaggccaucaacaagaucaccaagaaccucaacagccuguccgagcuggaggugaagaaccuccagcggcugaguggggccauggacgagcugcacaacgagauccucgagcuggacgagaagguggacgaccugcgcgccgacacgaucuccagucagaucgagcucgcgguccugcuguccaacgagggcaucaucaacagcgaggacgagcaccuccuggcccuggagcggaagcucaagaagaugcugggccccuccgccguggacaucgggaacggcuguuucgagaccaagcacaagugcaaccagaccugccuggaccgcaucgccgcggggaccuucaaugccggcgaguucagccuccccaccuucgacucccugaacaucacggccgccagccugaacgaugacgggcucgacaaccacaccauccugcuguacuacuccaccgccgcgagcucccuggccgugacccucaugcuggccaucuuuaucgucuacauggugagccgggacaacguguccugcagcgucugccuguga

SEQ ID NO: 16184 - RNA, 1755 nt, Artificial Sequence
  derived and/or modified CDS sequence (AUadapt) from InfluenzaB__ALE31885__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacuguaccgaccuggacguggcccucgggcggcccaugugcgugggcaccacgccguccgccaaggccagcauccugcacgagguccgccccgugaccuccggcugcuuccccaucaugcaugaccggaccaagauccgccagcugcccaaccuccugcggggguacgagaagauccgccugagcacccagaacgugaucgacgcggagaaggccccgggcgggcccuaccggcucggcacguccgggaguugccccaacgccaccuccaagaucggcuucuucgccaccauggcgugggccguccccaaggacaacuacaagaaugccaccaacccgcagacgguggaggugcccuacaucugcaccgagggcgaggaccagaucaccgucuggggguuccacagcgauaacaagacccagaugaagucccuguacggcgacucgaacccccagaaguucacguccagcgccaauggggugaccacccacuacgugucccagaucggcgacuuccccgaccagaccgaggacggcgggcugccgcagagcggccgcaucgucguggauuacaugaugcagaagcccgggaagacgggcaccaucguguaccagcgcgggguccuccugccccagaagguguggugcgccuccggccggagcaaggugaucaagggcagccugccccucaucggggaggcggacugccugcaugaggaguacggcgggcugaacaaguccaagccguacuacaccggcaagcacgccaaggccaucgggaacugccccaucugggucaagacgccccucaagcuggccaauggcaccaaguaccggcccccggccaagcugcucaaggagcgcggcuucuucggggcgaucgccggcuuccuggagggcgggugggaggggaugaucgccggcuggcacggcuacaccagccauggggcccacggcguggccgucgcggccgaccugaaguccacccaggaggccaucaacaagaucaccaagaaccucaacagccuguccgagcuggaggugaagaaccuccagcggcugaguggggccauggacgagcugcacaacgagauccucgagcuggacgagaagguggacgaccugcgcgccgacacgaucuccagucagaucgagcucgcgguccugcuguccaacgagggcaucaucaacagcgaggacgagcaccuccuggcccuggagcggaagcucaagaagaugcugggccccuccgccguggacaucgggaacggcuguuucgagaccaagcacaagugcaaccagaccugccuggaccgcaucgccgcggggaccuucaaugccggcgaguucagccuccccaccuucgacucccugaacaucacggccgccagccugaacgaugacgggcucgacaaccacaccauccugcuguacuacuccaccgccgcgagcucccuggccgugacccucaugcuggccaucuuugucguguacauggugagccgggacaacgucuccugcagcaucugccuguga

SEQ ID NO: 16185 - RNA, 1755 nt, Artificial Sequence; identical to SEQ ID NO: 14114
  derived and/or modified CDS sequence (AUadapt) from InfluenzaB__ALE31886__HA

SEQ ID NO: 16186 - RNA, 1755 nt, Artificial Sequence
  derived and/or modified CDS sequence (AUadapt) from InfluenzaB__ALE31887__HA
augaaggccaucaucgugcugcucauggucgugaccaguaacgccgaccgcaucugcaccggcaucacguccagcaacagcccccacguggucaagaccgcgacccagggggagaucaacgugaccggcgugaucccgcugacgaccacccccaccaaguccuauuucgccaaccugaaggggacgcggacccgcggcaagcucugccccgacugccugaacugcaccgaccuggaugucgcccucgggcggcccaugugcgugggcaccacgccguccgccaaggccagcauccugcacgaggugcgccccgucaccuccggcugcuuccccaucaugcacgaccggaccaagauccgccagcugcccaaccuccugcggggguaugagaagauccgccugucgacccagaacgugaucgacgcggagaaggccccgggcgggcccuaccggcucggcacguccgggagcugccccaacgccaccuccaagaucggcuucuuugccaccauggcgugggccgugcccaaggacaacuacaagaacgccaccaacccgcagacggucgaggugcccuacaucugcaccgagggcgaggaccagaucaccguguggggguuucacagcgacaacaagacccagaugaagucccuguacggcgacagcaacccccagaaguuuacguccucggccaacggggucaccacccacuacgugucccagaucggcgacuuccccgaccagaccgaggacggcgggcugccgcagaguggccgcaucguggucgacuacaugaugcagaagcccgggaagacgggcaccaucguguaccagcgcggggugcuccugccccagaaggucuggugcgccuccggccggagcaaggugaucaagggcagccugccccucaucggggaggcggacugccugcaugaggaguacggcgggcugaacaaguccaagccguacuacaccggcaagcacgccaaggccaucgggaacugccccaucugggugaagacgccccucaagcuggccaacggcaccaaguaucggcccccggccaagcugcucaaggagcgcggcuucuucggggcgaucgccggcuuccuggagggcgggugggaggggaugaucgccggcuggcacggcuacaccagccacggggcccacggcgucgccguggcggccgaucugaaguccacccaggaggccaucaacaagaucaccaagaaccucaacucgcuguccgagcuggaggucaagaaccuccagcggcugagcggggccauggacgagcugcacaaugagauccucgagcuggacgagaagguggacgaccugcgcgccgacacgaucuccagccagaucgagcucgcggugcugcuguccaacgagggcaucaucaacagcgaggaugagcaccuccuggcccuggagcggaagcucaagaagaugcugggccccuccgccgucgacaucgggaacggcugcuucgagaccaagcacaagugcaaccagaccugucuggaccgcaucgccgcggggaccuucaacgccggcgaguucucgcuccccaccuucgacucccugaacaucacggccgccagucugaacgacgacgggcucgacaaccacaccauccugcuguacuacuccaccgccgcgaguucccuggccgugacccucaugcuggccaucuucaucguguacauggucagccgggacaacguguccugcagcaucugccuguga

SEQ ID NO: 16187 - RNA, 1755 nt, Artificial Sequence; identical to SEQ ID NO: 14114
  derived and/or modified CDS sequence (AUadapt) from InfluenzaB__ALE31982__HA

SEQ ID NO: 16188 - RNA, 1755 nt, Artificial Sequence
  derived and/or modified CDS sequence (AUadapt) from InfluenzaB__ALE31983__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacuguaccgaccuggacguggcccucgggcggcccaugugcgugggcaccacgccguccgccaaggccagcauccugcacgagguccgccccgugaccuccggcugcuuccccaucaugcaugaccggaccaagauccgccagcugcccaaccuccugcggggguacgagaagauccgccugagcacccagaacgugaucgacgcggagaaggccccgggcgggcccuaccggcucggcacguccgggaguugccccaacgccaccuccaagaucggcuucuucgccaccauggcgugggccguccccaaggacaacuacaagaaugccaccaacccgcagacgguggaggugcccuacaucugcaccgagggcgaggaccagaucaccgucuggggguuccacagcgauaacaagacccagaugaagucccuguacggcgacucgaacccccagaaguucacguccagcgccaauggggugaccacccacuacgugucccagaucggcgacuuccccgaccagaccgaggacggcgggcugccgcagagcggccgcaucgucguggauuacaugaugcagaagcccgggaagacgggcaccaucguguaccagcgcgggguccuccugccccagaagguguggugcgccuccggccggagcaaggugaucaagggcagccugccccucaucggggaggcggacugccugcaugaggaguacggcgggcugaacaaguccaagccguacuacaccggcaagcacgccaaggccaucgggaacugccccaucugggucaagacgccccucaagcuggccaauggcaccaaguaccggcccccggccaagcugcucaaggagcgcggcuucuucggggcgaucgccggcuuccuggagggcgggugggaggggaugaucgccggcuggcacggcuacaccagccauggggcccacggcguggccgucgcggccgaccugaaguccacccaggaggccaucaacaagaucaccaagaaccucaacagccuguccgagcuggaggugaagaaccuccagcggcugaguggggccauggacgagcugcacaacgagauccucgagcuggacgagaagguggacgaccugcgcgccgacacgaucuccagucagaucgagcucgcgguccugcuguccaacgagggcaucaucaacagcgaggacgagcaccuccuggcccuggagcggaagcucaagaagaugcugggccccuccgccguggacaucgggaacggcuguuucgagaccaagcacaagugcaaccagaccugccuggaccgcaucgccgcggggaccuucaaugccggcgaguucagccuccccaccuucgacucccugaacaucacggccgccagccugaacgaugacgggcucgacaaccacaccauccugcuguacuacuccaccgccgcgagcucccuggccgugacccucaugcuggcccuguuuaucgucuacauggugagccgggacaacguguccugcagcaucugccucuga

SEQ ID NO: 16189 - RNA, 1755 nt, Artificial Sequence
  derived and/or modified CDS sequence (AUadapt) from InfluenzaB__ALE31984__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacuguaccgaccuggacguggcccucgggcggcccaugugcgugggcaccacgccguccgccaaggccagcauccugcacgagguccgccccgugaccuccggcugcuuccccaucaugcacgaucggaccaagauccgccagcugcccaaccuccugcggggguacgagaagauccgccugagcacccagaacgugaucgacgcggagaaggccccgggcgggcccuaccggcucggcacguccgggucgugucccaacgccaccuccaagaucggcuucuucgccaccauggcgugggccguccccaaggacaacuacaagaacgccaccaacccgcagacgguggaggugcccuauaucugcaccgaggaggaggaccagaucaccgucuggggcuuccacagcgacaacaagacccagaugaagucccuguauggggacagcaacccccagaaguucacguccagcgccaacggcgugaccacccacuacgugucccagaucggggauuuccccgaccagaccgaggacggcggccugccgcagagcgggcgcaucgucguggacuacauggugcagaagcccggcaagacggggaccaucgucuaccagcggggcgugcuccugccccagaagguguggugugccuccgggcgcagcaaggucaucaagggcucgcugccccucaucggcgaggcggacugccugcacgaggaguacgggggccugaacaaguccaagccguacuauaccgggaagcacgccaaggccaucggcaacugccccaucugggugaagacgccccucaagcuggccaacgggaccaaguaccggcccccggccaagcugcucaaggagcgcggcuucuucggcgcgaucgccggguuucuggagggcgggugggagggcaugaucgccggguggcacggcuacaccagccacggcgcccacggggucgccguggcggccgaccugaaguccacccaggaggccaucaacaagaucaccaagaaccucaauagccuguccgagcuggaggugaagaaccuccagcggcugagcggcgccauggacgagcugcacaacgagauccucgagcuggacgagaaggucgaugaccugcgcgccgacacgaucuccagccagaucgagcucgcggugcugcuguccaacgaggggaucaucaacucggaggacgagcaccuccuggcccuggagcggaagcucaagaagaugcugggccccuccgccguggauaucggcaacgggugcuucgagaccaagcacaagugcaaccagaccugccuggaucgcaucgccgcgggcaccuucaacgccggggaguucagccuccccaccuucgacucccugaacaucacggccgccagccugaaugacgacggccucgacaaccacaccauccugcuguacuacuccaccgccgcgaguucccuggccgucacccucaugcuggccaucuucaucguguacauggugagccgggacaacgucuccugcagcaucugccuguga

SEQ ID NO: 16190 - RNA, 1755 nt, Artificial Sequence; identical to SEQ ID NO: 14114
  derived and/or modified CDS sequence (AUadapt) from InfluenzaB__ALE31985__HA

SEQ ID NO: 16191 - RNA, 1758 nt, Artificial Sequence
  derived and/or modified CDS sequence (AUadapt) from InfluenzaB__ALE31986__HA
augaaggccaucaucgugcugcucauggucgugaccaguaacgccgaccgcaucugcaccggcaucacguccucgaacagcccccacguggucaagaccgcgacccagggggaggugaacgugaccggcgucaucccgcugacgaccacccccaccaagucgcacuuugccaaccugaaggggacggagacccggggcaagcucugccccaagugccugaacugcaccgaccuggacguggcccucgggcgccccaagugcaccggcaagaucccguccgcccgggugagcauccugcacgagguccgccccgugacguccggcugcuuucccaucaugcacgaccggaccaagauccgccagcugcccaaccuccugcggggguacgagcacauccgccugucgacccacaacgugaucaacgccgaggacgcgccgggcgggcccuacaagaucggcaccuccgggaguugccccaacaucacgaacggcaacggcuucuucgccaccauggccugggccguccccaagaacgacaagaacaagaccgcgaccaacccgcucacgaucgaggugcccuacaucuguaccgagggggaggaccagaucaccguguggggcuuccacuccgacaacgagacccagauggccaagcuguacggggacucgaagccccagaaguucacguccagcgccaacggcgucaccacccauuacgugucccagaucggcggguuccccaaccagaccgaggacggcgggcugccgcagucgggccggaucgugaucgacuacaugguccagaaguccgggaagacgggcaccaucaccuaccagcgcggcauccuccugccccagaagguguggugcgccagcgggcgguccaaggugaucaagggcucgcugccccucaucggggaggccgauugccugcacgagaaguacggcgggcugaacaagagcaagcccuacuacaccggcgagcacgcgaaggccgucggcaacugcccgaucugggugaagacgccccucaagcuggccaacgggaccaaguaucgcccgcccgccaagcugcucaaggagcggggcuucuucggggccaucgcgggcuuccuggagggcgggugggagggcaugaucgccggguggcacggcuacaccucccacggggcccacggcguggccgucgccgcggaccugaaguccacccaggaggccaucaacaagaucacgaagaaccucaacucccugagugagcuggaggugaagaaccuccagcgccuguccggcgccauggacgagcugcacaacgagauccucgagcuggacgagaaggucgacgaccugcgggccgacaccaucagcucccagaucgagcucgccgugcugcugucgaacgaggggaucaucaauuccgaggacgagcaccuccuggcgcuggagcgcaagcucaagaagaugcugggccccagcgccguggagaucgggaacggcugcuucgagaccaagcacaagugcaaccagaccugccuggaccggaucgccgccgggaccuuugacgcgggcgaguucucccuccccacguucgacucgcugaacaucaccgccgccucccugaacgacgacggccucgacaaccauaccauccugcuguacuacagcaccgccgccuccucgcuggcggucacgcucaugaucgccaucuucgugguguacauggucucccgcgacaacgugagcugcuccaucugccuguga

SEQ ID NO: 16192 - RNA, 1755 nt, Artificial Sequence; identical to SEQ ID NO: 14106
  derived and/or modified CDS sequence (AUadapt) from InfluenzaB__ALE31988__HA

SEQ ID NO: 16193 - RNA, 1758 nt, Artificial Sequence; identical to SEQ ID NO: 16191
  derived and/or modified CDS sequence (AUadapt) from InfluenzaB__ALE31989__HA

SEQ ID NO: 16194 - RNA, 1758 nt, Artificial Sequence; identical to SEQ ID NO: 16191
  derived and/or modified CDS sequence (AUadapt) from InfluenzaB__ALE31990__HA

SEQ ID NO: 16195 - RNA, 1755 nt, Artificial Sequence; identical to SEQ ID NO: 14114
  derived and/or modified CDS sequence (AUadapt) from InfluenzaB__ALE31991__HA

SEQ ID NO: 16196 - RNA, 1758 nt, Artificial Sequence
  derived and/or modified CDS sequence (AUadapt) from InfluenzaB__ALE31992__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccacuuugccaaccugaaggggacggagacccggggcaagcucugccccaagugccugaacugcaccgaccuggacguggcccucgggcgccccaagugcaccggcaagaucccguccgcccgggugucgauccugcacgagguccgccccgugacguccggcuguuuccccaucaugcacgaccggaccaagauccgccagcugcccaaccuccugcggggguacgagcacgugcgccugagcacccacaacgucaucaacgccgaggaugcgccgggcgggcccuacaagaucggcaccuccgggucgugccccaacaucacgaacggcaacggcuucuucgccaccauggccugggccgugcccaagaacgacaagaauaagaccgcgaccaacccgcucacgaucgaggugcccuacaucugcaccgagcgggaggaccagaucaccgucuggggguuccacuccgacaacgagacccagauggccaagcuguacggcgacaguaagccccagaaguucacguccucggccaacggggugaccacccacuacgugucccagaucggcggcuuccccaaccagaccgaggacgggggccugccgcagagcgggcgcaucgucguggacuauauggugcagaaguccggcaagacggggaccaucaccuaccagcggggcauccuccugccccagaaggucuggugcgccucgggccgcuccaaggugaucaaggggagccugccccucaucggcgaggccgacugccugcacgagaaguacgggggccugaacaagucgaagcccuauuacaccggggagcacgcgaaggccaucggcaacugcccgaucugggugaagacgccccucaagcuggccaacggcaccaaguaccggccgcccgccaagcugcucaaggagcgcggguucuucggcgccaucgcgggguuccuggagggcgggugggagggcaugaucgccggcuggcacggguauaccucccacggcgcccacggggucgccguggccgcggaccugaaguccacccaggaggccaucaacaagaucacgaagaaccucaacucccugagcgagcuggaggucaagaaccuccagcggcuguccggcgccauggacgagcugcacaaugagauccucgagcuggacgagaagguggacgaccugcgcgccgacaccaucucgucccagaucgagcucgccgugcugcugagcaacgagggcaucaucaacuccgaggacgagcaccuccuggcgcuggagcggaagcucaagaagaugcuggggcccagugccgucgagaucggcaacgggugcuucgagaccaagcacaagugcaaccagaccugccuggaccgcaucgccgccggcaccuucgacgcgggggaguuuucccuccccacguucgacagccugaacaucaccgccgccucccugaacgacgacggccucgacaaccacaccauccugcuguauuacucgaccgccgccuccagccuggcggugacgcucaugaucgccaucuucguggucuacauggugucccgggacaacgugagcugcuccaucugccuguga

SEQ ID NO: 16197 - RNA, 1758 nt, Artificial Sequence; identical to SEQ ID NO: 15605
  derived and/or modified CDS sequence (AUadapt) from InfluenzaB__ALE31993__HA

SEQ ID NO: 16198 - RNA, 1758 nt, Artificial Sequence
  derived and/or modified CDS sequence (AUadapt) from InfluenzaB__ALE31994__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagucacuucgccaaccugaaggggacggagacccggggcaagcucugccccaagugccugaacugcaccgaccuggacguggcccucgggcgccccaaguguaccggcaagaucccguccgcccgggugagcauccugcacgagguccgccccgugacguccggcugcuuccccaucaugcacgaccggaccaagauccgccagcugcccaaccuccugcggggguacgagcaugugcgccugucgacccacaacgucaucaacgccgaggacgcgccgggcgggcccuacaagaucggcaccuccgggagcugccccaacaucacgaauggcaacggcuucuucgccaccauggccugggccgugcccaagaacgacaagaacaagaccgcgaccaacccgcucacgaucgaggugcccuacaucuguaccgagggggaggaccagaucaccgucuggggcuuccacuccgacaacgagacccagauggccaagcuguacggggacucgaagccccagaaguucacguccagugccaacggcgugaccacccacuacgugucccagaucggcggguuccccaaccagaccgaggacggcgggcugccgcagagcggccggaucgucguggacuauauggugcagaaguccgggaagacgggcaccaucaccuaccagcgcggcauccuccugccccagaaggucuggugcgccucggggcgguccaaggugaucaagggcagccugccccucaucggggaggccgacugccugcacgagaaguacggcgggcugaacaagaguaagcccuacuacaccggcgagcacgcgaaggccaucggcaacugcccgaucugggugcgcacgccccucaagcuggccaacgggaccaaguaccggccgcccgccaagcugcucaaggagcgcggcuucuuuggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagugagcuggaggucaagaaccuccagcggcuguccggcgccauggacgagcugcacaacgagauccucgagcuggacgagaagguggacgaccugcgcgccgacaccaucaguucccagaucgagcucgccgugcugcugucgaacgaggggaucaucaacuccgaggacgagcaccuccuggcgcuggagcggaagcucaagaagaugcugggccccagcgccgucgagaucgggaacggcugcuucgagaccaagcauaagugcaaccagaccugccuggaccgcaucgccgccgggaccuucgacgcgggcgaguucucccuccccacguucgauagccugaacaucaccgccgccucccugaacgacgacggccucgacaaccacaccauccugcuguacuauucgaccgccgccuccagccuggcggugacgcucaugaucgccaucuucguggucuacauggugucccgggacaacgugagcugcuccaucugccuguga

SEQ ID NO: 16199 - RNA, 1755 nt, Artificial Sequence; identical to SEQ ID NO: 16188
  derived and/or modified CDS sequence (AUadapt) from InfluenzaB__ALN39719__HA

SEQ ID NO: 16200 - RNA, 1755 nt, Artificial Sequence; identical to SEQ ID NO: 14114
  derived and/or modified CDS sequence (AUadapt) from InfluenzaB__ALN39720__HA

SEQ ID NO: 16201 - RNA, 1755 nt, Artificial Sequence; identical to SEQ ID NO: 14114
  derived and/or modified CDS sequence (AUadapt) from InfluenzaB__ALN39721__HA

SEQ ID NO: 16202 - RNA, 1755 nt, Artificial Sequence; identical to SEQ ID NO: 14114
  derived and/or modified CDS sequence (AUadapt) from InfluenzaB__ALN39723__HA

SEQ ID NO: 16203 - RNA, 1755 nt, Artificial Sequence; identical to SEQ ID NO: 14114
  derived and/or modified CDS sequence (AUadapt) from InfluenzaB__ALN39724__HA

SEQ ID NO: 16204 - RNA, 1755 nt, Artificial Sequence; identical to SEQ ID NO: 14106
  derived and/or modified CDS sequence (AUadapt) from InfluenzaB__ALN39725__HA

SEQ ID NO: 16205 - RNA, 1755 nt, Artificial Sequence
  derived and/or modified CDS sequence (AUadapt) from InfluenzaB__ALN39726__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacuguaccgaccuggacguggcccucgggcggcccaugugcgugggcaccacgccguccgccaaggccagcauccugcacgagguccgccccgugaccuccggcugcuuccccaucaugcaugaccggaccaagauccgccagcugcccaaccuccugcggggguacgagaagauccgccugagcacccagaacgugaucgacgcggagaaggccccgggcgggcccuaccggcucggcacguccgggaguugccccaacgccaccuccaagaucggcuucuucgccaccauggcgugggccguccccaaggacaacuacaagaaugccaccaacccgcagacgguggaggugcccuacaucugcaccgagggcgaggaccagaucaccgucuggggguuccacagcgauaacaagacccagaugaagucccuguacggcgacucgaacccccagaaguucacguccagcgccgauggggugaccacccacuacgugucccagaucggcgacuuccccgaccagaccgaggacggcgggcugccgcagagcggccgcaucgucguggauuacaugaugcagaagcccgggaagacgggcaccaucguguaccagcgcgggguccuccugccccagaagguguggugcgccuccggccggagcaaggugaucaagggcagccugccccucaucggggaggcggacugccugcaugaggaguacggcgggcugaacaaguccaagccguacuacaccggcaagcacgccaaggccaucgggaacugccccaucugggucaagacgccccucaagcuggccaauggcaccaaguaccggcccccggccaagcugcucaaggagcgcggcuucuucggggcgaucgccggcuuccuggagggcgggugggaggggaugaucgccggcuggcacggcuacaccagccauggggcccacggcguggccgucgcggccgaccugaaguccacccaggaggccaucaacaagaucaccaagaaccucaacagccuguccgagcuggaggugaagaaccuccagcggcugaguggggccauggacgagcugcacaacgagauccucgagcuggacgagaagguggacgaccugcgcgccgacacgaucuccagucagaucgagcucgcgguccugcuguccaacgagggcaucaucaacagcgaggacgagcaccuccuggcccuggagcggaagcucaagaagaugcugggccccuccgccguggacaucgggaacggcuguuucgagaccaagcacaagugcaaccagaccugccuggaccgcaucgccgcggggaccuucaaugccggcgaguucagccuccccaccuucgacucccugaacaucacggccgccagccugaacgaugacgggcucgacaaccacaccauccugcuguacuacuccaccgccgcgagcucccuggccgugacccucaugcuggccaucuuuaucgucuacauggugagccgggacaacguguccugcagcaucugccuguga

SEQ ID NO: 16206 - RNA, 1755 nt, Artificial Sequence; identical to SEQ ID NO: 14106
  derived and/or modified CDS sequence (AUadapt) from InfluenzaB__ALN39727__HA

SEQ ID NO: 16207 - RNA, 1755 nt, Artificial Sequence; identical to SEQ ID NO: 14114
  derived and/or modified CDS sequence (AUadapt) from InfluenzaB__ALN39728__HA

SEQ ID NO: 16208 - RNA, 1755 nt, Artificial Sequence; identical to SEQ ID NO: 14114
  derived and/or modified CDS sequence (AUadapt) from InfluenzaB__ALN39729__HA

SEQ ID NO: 16209 - RNA, 1758 nt, Artificial Sequence
  derived and/or modified CDS sequence (AUadapt) from InfluenzaB__ALN39730__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccacuucgccaaucugaaggggacggagacccggggcaagcucugccccaagugccugaacugcaccgaccuggacguggcccucgggcgccccaagugcaccggcaagaucccguccgcccgggugucgauccugcacgagguccgccccgugacguccggcugcuuccccaucaugcaugaccggaccaagauccgccagcugcccaaccuccugcggggguacgagcacgugcgccugagcacccacaacgucaucaacgccgaggacgcgccgggcgggcccuacaagaucggcaccuccgggucgugucccaacaucacgaacggcaacggcuucuucgccaccauggccugggccgugcccaagaacgacaagaacaagaccgcgaccaacccgcucacgaucgaggugcccuacaucugcaccgagggggaggaucagaucaccgucuggggcuuccacuccgacaacgagacccagauggccaagcuguacggggacagcaagccccagaaguucacguccucggccaacggcgugaccacccacuaugugucccagaucggcggguuccccaaccagaccgaggacggcgggcugccgcagagcggccggaucgucguggacuacauggugcagaaguccgggaagacgggcaccaucaccuaccagcgcggcauccuccugccccagaaggucuggugcgccucggggcgguccaaggugaucaagggcagccugccccucaucggggaggccgacugucugcacgagaaguacggcgggcugaacaagucgaagcccuacuacaccggcgagcacgcgaaggccaucggcaacugcccgaucugggugaagacgccccucaagcuggccaacgggaccaaguaccgcccgcccgccaagcugcucaaggagcggggcuuuuucggggccaucgcgggcuuccuggagggcgggugggagggcaugaucgccggguggcacggcuacaccucccacggggcccacggcgucgccguggccgcggaccugaaguccacccaggaggccaucaacaagaucacgaagaaccucaacucccugagcgagcuggaggucaagaaucuccagcgccuguccggcgccauggacgagcugcacaacgagauccucgagcuggacgagaagguggacgaccugcgggccgacaccaucucgucccagaucgagcucgccgugcugcugagcaacgaggggaucaucaacuccgaggaugagcaccuccuggcgcuggagcgcaagcucaagaagaugcugggccccucggccgucgagaucgggaacggcugcuucgagaccaagcacaagugcaaccagaccugccuggaccggaucgccgccgggaccuucgaugcgggcgaguucuuccuccccacguucgacucccugaacaucaccgccgccagccugaacgacgacggccucgacaaccauaccauccugcuguacuacuccaccgccgccucgucccuggcggugacgcucaugaucgccaucuucguggucuacauggugagccgcgacaacguguccugcagcaucugccuguga

SEQ ID NO: 16210 - RNA, 1755 nt, Artificial Sequence; identical to SEQ ID NO: 14114
  derived and/or modified CDS sequence (AUadapt) from InfluenzaB__ALN39732__HA

SEQ ID NO: 16211 - RNA, 1755 nt, Artificial Sequence
  derived and/or modified CDS sequence (AUadapt) from InfluenzaB__ALN39733__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaaguccuacuucgccaaccugaaggggacgcggacccgcggcaagcucugccccgacugccugaauugcaccgaccuggacguggcccucgggcggcccaugugcgugggcaccacgccguccgccaaggccagcauccugcacgagguccgccccgugaccuccggcuguuuccccaucaugcacgaccggaccaagauccgccagcugcccaaccuccugcggggguacgagaagauccgccugagcacccagaacgugaucgaugcggagaaggccccgggcgggcccuaccggcucggcacguccgggagcugccccaacgccaccuccaagaucggcuucuucgccaccauggcgugggccguccccaaggauaacuacaagaacgccaccaacccgcagacgguggaggugcccuacaucugcaccgagggcgaggaccagaucaccgucuggggguuucacagcgacaacaagacccagaugaagucccuguacggcgacagcaauccccagaaguucacguccagcgccaacggggugaccacccacuacgugucccagaucggcgacuuucccgaccagaccgaggacggcgggcugccgcagagcggccgcaucgucguggacuacaugaugcagaagcccgggaagacgggcaccaucguguaccagcgcgggguccuccugccccagaagguguggugcgccuccggccggaguaaggugaucaagggcucgcugccccucaucggggaggcggacugccugcacgaggaguacggcgggcugaacaaguccaagccguauuacaccggcaagcacgccaaggccaucgggaacugccccaucugggucaagacgccccucaagcuggccaacggcaccaaguaccggcccccggccaagcugcucaaggagcgcggcuucuuuggggcgaucgccggcuuccuggagggcgggugggaggggaugaucgccggcuggcacggcuacaccagccacggggcccacggcguggccgucgcggccgaucugaaguccacccaggaggccaucaacaagaucaccaagaaccucaacagccuguccgagcuggaggugaagaaccuccagcggcugagcggggccauggacgagcugcauaacgagauccucgagcuggacgagaagguggacgaccugcgcgccgacacgaucuccagccagaucgagcucgcgguccugcuguccaacgagggcaucaucaauagcgaggacgagcaccuccuggcccuggagcggaagcucaagaagaugcugggccccuccgccguggacaucgggaacggcugcuuugagaccaagcaccgcugcaaccagaccugccuggaccggaucgccgcggggaccuucaacgccggcgaguuuagccuccccaccuucgacucccugaacaucacggccgccagccugaacgaugacgggcucgacaaccacaccauccugcuguacuacuccaccgccgcgagcucccuggccgugacccucaugcuggccaucuuuaucgucuacauggugagccgcgacaacguguccugcagcaucugccuguga

SEQ ID NO: 16212 - RNA, 1755 nt, Artificial Sequence
  derived and/or modified CDS sequence (AUadapt) from InfluenzaB__ALN39751__HA
augaaggccaucaucgugcugcucauggucgugaccaguaacgccgaccgcaucugcaccggcaucacguccagcaacagcccccauguggucaagaccgcgacccagggggaggugaacgugaccggcgucaucccgcugacgaccacccccaccaaguccuacuucgccaaccugaaggggacgcggacccgcggcaagcucugccccgacugccugaauugcaccgaccuggacguggcccucgggcggcccaugugcgugggcaccacgccguccgccaaggccagcauccugcacgagguccgccccgugaccuccggcuguuuccccaucaugcacgaccggaccaagauccgccagcugcccaaccuccugcggggguacgagaagauccgccugagcacccagaacgugaucgaugcggagaaggccccgggcgggcccuaccggcucggcacguccgggagcugccccaacgccaccuccaagaucggcuucuucgccaccauggcgugggccguccccaaggauaacuacaagaacgccaccaacccgcagacgguggaggugcccuacaucugcaccgagggcgaggaccagaucaccgucuggggguuucacagcgacaacaagacccagaugaagucccuguacggcgacagcaauccccagaaguucacguccagcgccaacggggugaccacccacuacgugucccagaucggcgacuuucccgaccagaccgaggacggcgggcugccgcagagcggccgcaucgucguggacuacaugaugcagaagcccgggaagacgggcaccaucguguaccagcgcgggguccuccugccccagaagguguggugcgccuccggccggaguaaggugaucaagggcucgcugccccucaucggggaggcggacugccugcacgaggaguacggcgggcugaacaaguccaagccguauuacaccggcaagcacgccaaggccaucgggaacugccccaucugggucaagacgccccucaagcuggccaacggcaccaaguaccggcccccggccaagcugcucaaggagcgcggcuucuuuggggcgaucgccggcuuccuggagggcgggugggaggggaugguggccggcuggcacggcuacaccagccacggggcccacggcgucgccguggcggccgaucugaaguccacccaggaggccaucaacaagaucaccaagaaccucaacagccuguccgagcuggaggugaagaaccuccagcggcugagcggggccauggacgagcugcauaacgagauccucgagcuggacgagaaggucgacgaccugcgcgccgacacgaucuccagccagaucgagcucgcggugcugcuguccaacgagggcaucaucaauagcgaggacgagcaccuccuggcccuggagcggaagcucaagaagaugcugggccccuccgccguggacaucgggaacggcugcuuugagaccaagcacaagugcaaccagaccugccuggaccgcaucgccgcggggaccuucaacgccggcgaguuuagccuccccaccuucgacucccugaacaucacggccgccagccugaacgaugacgggcucgacaaccacaccauccugcuguacuacuccaccgccgcgagcucccuggccgucacccucaugcuggcccuguuuaucguguacauggugagccgggacaacgucuccugcagcaucugccucuga

SEQ ID NO: 16213 - RNA, 1755 nt, Artificial Sequence; identical to SEQ ID NO: 16188
  derived and/or modified CDS sequence (AUadapt) from InfluenzaB__ALN39752__HA

SEQ ID NO: 16214 - RNA, 1755 nt, Artificial Sequence; identical to SEQ ID NO: 14114
  derived and/or modified CDS sequence (AUadapt) from InfluenzaB__ALN39753__HA

SEQ ID NO: 16215 - RNA, 1758 nt, Artificial Sequence; identical to SEQ ID NO: 14100
  derived and/or modified CDS sequence (AUadapt) from InfluenzaB__ALN39754__HA

SEQ ID NO: 16216 - RNA, 1758 nt, Artificial Sequence
  derived and/or modified CDS sequence (AUadapt) from InfluenzaB__ALN39755__HA
augaaggccaucaucgugcugcuccuggucgugaccaguaacgccgaccgcaucugcaccggcaucacguccagcaacucgccccacguggucaagaccgcgacccagggggaggugaacgugaccggcgucaucccgcugacgaccacccccaccaagucccacuuugccaaccucaaggggacggagacccggggcaagcugugccccaagugccugaacugcaccgaccucgacguggcccuggggcgccccaagugcaccggcaagaucccguccgcccgggugagcauccugcaugagguccgccccgugacguccggcugcuuccccaucaugcacgaccggaccaagauccgccagcuccccaaccugcugcggggguacgagcacgugcgccucucgacccacaaugucaucaacgccgaggacgcgccgggcgggcccuacaagaucggcaccuccgggagcugccccaacaucacgaacggcaacggcuucuuugccaccauggccugggccgugcccaagaacgacaagaacaagaccgcgaccaacccgcugacgaucgaggugcccuacaucugcaccgagggggaggaccagaucaccgucuggggcuuccacuccgacaaugagacccagauggccaagcuguacggggacagcaagccccagaaguucacguccucggccaacggcgugaccacccacuacgugucccagaucggcggguuccccaaucagaccgaggacggcgggcucccgcagagcggccggaucgucguggacuacauggugcagaaguccgggaagacgggcaccaucaccuaccagcgcggcauccugcugccccagaaggucuggugcgccucggggcgguccaaggugaucaagggcagccucccccugaucggggaggccgacugucugcacgagaaguacggcgggcucaacaagucgaagcccuacuacaccggcgagcacgcgaaggccaucggcaacugcccgaucugggugaagacgccccugaagcuggccaaugggaccaaguaccgcccgcccgccaagcuccugaaggagcggggcuucuucggggccaucgcgggcuuccuggagggcgggugggagggcaugaucgccggguggcacggcuacaccucccacggggcccacggcgucgccguggccgcggaccucaagaguacccaggaggccaucaacaagaucacgaagaaccugaacucccugagcgagcucgaggucaagaaccugcagcgccuguccggcgccauggacgagcuccacaacgagauccuggagcuggacgagaagguggacgaucuccgggccgacaccaucucgucccagaucgagcuggccgugcugcucagcaacgaggggaucaucaacuccgaggacgagcaccuccuggcgcuggagcgcaagcugaagaagaugcugggccccucggccgucgagaucgggaacggcuguuucgagaccaagcacaagugcaaccagaccugccucgaccggaucgccgccgggaccuucgacgcgggcgaguucucccugcccacguuugacagccugaacaucaccgccgccucccucaacgacgacggccuggacaaccacaccauccugcuguauuacucgaccgccgccuccagccucgcggugacgcugaugaucgccaucuucguggucuacauggugucccgcgacaacgugagcugcuccaucugccuguga

SEQ ID NO: 16217 - RNA, 1755 nt, Artificial Sequence
  derived and/or modified CDS sequence (AUadapt) from InfluenzaB__ALN39756__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuauuucgccaaccugaaggggacgcggacccgcggcaagcucugccccgacugccugaacugcaccgaccuggauguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguaugagaagauccgccugagcacccagaacgugaucgacgcggagaaggccccgggcgggcccuaccggcucggcacguccgggucgugccccaacgccaccuccaagaucggcuucuuugccaccauggcgugggccguccccaaggacaacuacaagaacgccaccaacccgcagacgguggaggugcccuacaucugcaccgagggcgaggaccagaucaccgucuggggguuucacagcgacaacaagacccagaugaagucccuguacggcgacagcaacccccagaaguuuacguccagcgccaacggggugaccacccacuacgugucccagaucggcgacuuccccgaccagaccgaggacggcgggcugccgcagaguggccgcaucgucguggacuacaugaugcagaagcccgggaagacgggcaccaucguguaccagcgcgggguccuccugccccagaagguguggugcgccuccggccggagcaaggugaucaagggcucgcugccccucaucggggaggcggacugccugcaugaggaguacggcgggcugaacaaguccaagccguacuacaccggcaagcacgccaaggccaucgggaacugccccaucugggucaagacgccccucaagcuggccaacggcaccaaguaucggcccccggccaagcugcucaaggagcgcggcuucuucggggcgaucgccggcuuccuggagggcgggugggaggggaugaucgccggcuggcacggcuacaccagccacggggcccacggcguggccgucgcggccgaucugaaguccacccaggaggccaucaacaagaucaccaagaaccucaacagccuguccgagcuggaggugaagaaccuccagcggcugagcggggccauggacgagcugcacaaugagauccucgagcuggacgagaagguggacgaccugcgcgccgacacgaucuccagccagaucgagcucgcgguccugcuguccaacgagggcaucaucaacucggaggaugagcaccuccuggcccuggagcggaagcucaagaagaugcugggccccuccgccguggacaucgggaacggcugcuucgagaccaagcacaagugcaaccagaccugucuggaccgcaucgccgcggggaccuucaacgugggcgaguucagccuccccaccuucgacucccugaacaucacggccgccagucugaacgacgacgggcucgacaaccacaccauccugcuguacuacuccaccgccgccaguucccuggcggucacccucaugcuggccaucuucaucguguacauggugagccgggacaacgucuccugcagcaucugccuguga

SEQ ID NO: 16218 - RNA, 1758 nt, Artificial Sequence; identical to SEQ ID NO: 14100
  derived and/or modified CDS sequence (AUadapt) from InfluenzaB__ALN39757__HA

SEQ ID NO: 16219 - RNA, 1755 nt, Artificial Sequence; identical to SEQ ID NO: 14114
  derived and/or modified CDS sequence (AUadapt) from InfluenzaB__ALN39758__HA

SEQ ID NO: 16220 - RNA, 1755 nt, Artificial Sequence
  derived and/or modified CDS sequence (AUadapt) from InfluenzaB__ALN39759__HA
augaagaccaucaucgugcugcucauggucgugaccaguaacgccgaccgcaucugcacgggcaucaccuccagcaacagcccccacguggucaagaccgccacccagggggaggugaacgugacgggcgucaucccgcugaccaccacccccacgaaguccuauuucgcgaaccugaaggggacccggacccgcggcaagcucugccccgacugccugaacugcaccgaccuggauguggcccucgggcggcccaugugcgugggcacgaccccguccgccaaggccagcauccugcacgagguccgccccgugaccuccggcugcuuccccaucaugcacgaccggaccaagauccgccagcugcccaaccuccugcggggguaugagaagauccgccugucgacgcagaacgugaucgacgccgagaaggcgccgggcgggcccuaccggcucggcaccuccgggagcugccccaacgccaccuccaagaucggcuucuuugccaccauggccugggcgguccccaaggacaacuacaagaacgccacgaacccgcagaccguggaggugcccuacaucugcaccgagggcgaggaccagaucaccgucuggggguuucacagcgacaacaagacgcagaugaagucccuguacggcgacagcaacccccagaaguuuaccuccucggccaacggggugaccacccacuacgugucccagaucggcgacuuccccgaccagacggaggacggcgggcugccgcagaguggccgcaucgucguggacuacaugaugcagaagcccgggaagaccggcaccaucguguaccagcgcgggguccuccugccccagaagguguggugcgccuccggccggagcaaggugaucaagggcagccugccccucaucggggaggccgacugccugcaugaggaguacggcgggcugaacaaguccaagccguacuacaccggcaagcacgcgaaggccaucgggaacugccccaucugggucaagacgccccucaagcuggccaacggcaccaaguaucggcccccggccaagcugcucaaggagcgcggcuucuucggggccaucgcgggcuuccuggagggcgggugggaggggaugaucgccggcuggcacggcuacaccagccacggggcccacggcguggccgucgccgcggaucugaaguccacccaggaggccaucaacaagaucacgaagaaccucaacucgcuguccgagcuggaggugaagaaccuccagcggcugagcggggccauggacgagcugcacaaugagauccucgagcuggacgagaagguggacgaccugcgcgccgacaccaucuccagccagaucgagcucgccguccugcuguccaacgagggcaucaucaacagcgaggaugagcaccuccuggcgcuggagcggaagcucaagaagaugcugggccccuccgccguggacaucgggaacggcugcuucgagaccaagcacaagugcaaccagaccugucuggaccgcaucgccgccgggaccuucaacgcgggcgaguucucgcuccccacguucgacucccugaacaucaccgccgccagucugaacgacgacgggcucgacaaccacaccauccugcuguacuacuccaccgccgccaguucccuggcggugacgcucaugcuggccaucuucaucgucuacauggugagccgggacaacguguccugcagcaucugccuguga

SEQ ID NO: 16221 - RNA, 1758 nt, Artificial Sequence; identical to SEQ ID NO: 16179
  derived and/or modified CDS sequence (AUadapt) from InfluenzaB__ALN39760__HA

SEQ ID NO: 16222 - RNA, 1755 nt, Artificial Sequence; identical to SEQ ID NO: 14114
  derived and/or modified CDS sequence (AUadapt) from InfluenzaB__ALN39761__HA

SEQ ID NO: 16223 - RNA, 1755 nt, Artificial Sequence; identical to SEQ ID NO: 14114
  derived and/or modified CDS sequence (AUadapt) from InfluenzaB__ALN39762__HA

SEQ ID NO: 16224 - RNA, 1755 nt, Artificial Sequence; identical to SEQ ID NO: 14114
  derived and/or modified CDS sequence (AUadapt) from InfluenzaB__ALN39763__HA

SEQ ID NO: 16225 - RNA, 1758 nt, Artificial Sequence; identical to SEQ ID NO: 14100
  derived and/or modified CDS sequence (AUadapt) from InfluenzaB__ALN39764__HA

SEQ ID NO: 16226 - RNA, 1755 nt, Artificial Sequence
  derived and/or modified CDS sequence (AUadapt) from InfluenzaB__ALN39765__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacuguaccgaccuggacguggcccucgggcggcccaugugcgugggcaccacgccguccgccaaggccagcauccugcacgagguccgccccgugaccuccggcugcuuccccaucaugcaugaccggaccaagauccgccagcugcccaaccuccugcggggguacgagaagauccgccugagcacccagaacgugaucgacgcggagaaggccccgggcgggcccuaccggcucggcacguccgggaguugccccaacgccaccuccaagaucggcuucuucgccaccauggcgugggccguccccaaggacaacuacaagaaugccaccaacccgcagacgguggaggugcccuacaucugcaccgagggcgaggaccagaucaccgucuggggguuccacagcgauaacaagacccagaugaagucccuguacggcgacucgaacccccagaaguucacguccagcgccaauggggugaccacccacuacgugucccagaucggcgacuuccccgaccagaccgaggacggcgggcugccgcagagcggccgcaucgucguggauuacaugaugcagaagcccgggaagacgggcaccaucguguaccagcgcgggguccuccugccccagaagguguggugcgccuccggccggagcaaggugaucaagggcagccugccccucaucggggaggcggacugccugcaugaggaguacggcgggcugaacaaguccaagccguacuacaccggcaagcacgccaaggccaucgggaacugccccaucugggucaagacgccccucaagcuggccaauggcaccaaguaccggcccccggccaagcugcucaaggagcgcggcuucuucggggcgaucgccggcuuccuggagggcgggugggaggggaugaucgccggcuggcacggcuacaccagccauggggcccacggcguggccgucgcggccgaccugaaguccacccaggaggccaucaacaagaucaccaagaaccucaacagccuguccgagcuggaggugaacaaucuccagcggcugucgggggccauggacgagcugcacaacgagauccucgagcuggacgagaagguggacgaccugcgcgccgauacgaucuccagccagaucgagcucgcgguccugcuguccaacgagggcaucaucaacagcgaggacgagcaccuccuggcccuggagcggaagcucaagaagaugcugggccccuccgccguggacaucgggaauggcugcuucgagaccaagcacaagugcaaccagaccugccuggaccgcaucgccgcggggaccuuuaacgccggcgaguucagccuccccaccuucgacucccugaacaucacggccgccagccugaaugacgacgggcucgacaaccacaccauccugcuguacuacuccaccgccgcgaguucccuggccgugacccucaugcuggcccuguucaucgucuacauggugagccgggacaacguguccugcagcaucugccucuga

SEQ ID NO: 16227 - RNA, 1755 nt, Artificial Sequence; identical to SEQ ID NO: 14106
  derived and/or modified CDS sequence (AUadapt) from InfluenzaB__ALN39766__HA

SEQ ID NO: 16228 - RNA, 1755 nt, Artificial Sequence; identical to SEQ ID NO: 14114
  derived and/or modified CDS sequence (AUadapt) from InfluenzaB__ALN39767__HA

SEQ ID NO: 16229 - RNA, 1755 nt, Artificial Sequence; identical to SEQ ID NO: 14106
  derived and/or modified CDS sequence (AUadapt) from InfluenzaB__ALN39768__HA

SEQ ID NO: 16230 - RNA, 1755 nt, Artificial Sequence
  derived and/or modified CDS sequence (AUadapt) from InfluenzaB__ALN39769__HA
augaaggccaucaucgugcugcucauggucgugaccaguaacgccgaccgcaucugcaccggcaucacguccagcaacuccccgcacguggucaagaccgcgacccagggggaggugaaugugaccggcgucaucccgcugacgaccacccccaccaagagcuacuucgccaaccugaaggggacgcggacccgcggcaagcucugccccgacugccugaauugcaccgaccuggacguggcccucgggcggcccaugugcgugggcaccacgccguccgccaaggccagcauccugcacgagguccgccccgugaccuccggcugcuuucccaucaugcacgggcggaccaagauccgccagcugcccaaccuccugcggggcuacgagaagauccgccugagcacccagaacgugaucgacgcggagaaggcccccgggggccccuaccggcucgggacguccggcaguugccccaacgccaccuccaagaucggcuucuucgccaccauggcgugggccguccccaaggacaacuacaagaaugccaccaacccgcagacgguggaggugcccuacaucugcaccgagggggaggaccagaucaccgucuggggcuuccacagcgauaacaagacccagaugaagucccuguacggggacucgaacccccagaaguucacguccagcgccaauggcgugaccacccacuacgugucccagaucggcgacuuccccgaccagaccgaggacgggggccugccgcagagcgggcgcaucgucguggauuacaugaugcagaagcccggcaagacggggaccaucguguaccagcggggcguccuccugccccagaagguguggugcgccuccggccgcagcaaggugaucaaggggagccugccccucaucggcgaggcggacugccugcaugaggaguacgggggccugaacaaguccaagccguacuacaccgggaagcacgccaaggccaucggcaacugccccaucugggucaagacgccccucaagcuggccaauggcaccaaguaccggcccccggccaagcugcucaaggagcgcggguucuucggcgcgaucgccggguuccuggagggcgggugggagggcaugaucgccggcuggcacggguacaccagccauggcgcccacgggguggccgucgcggccgaccugaaguccacccaggaggccaucaacaagaucaccaagaaccucaacagccuguccgagcuggaggugaagaaccuccagcggcugaguggcgccauggacgagcugcacaacgagauccucgagcuggacgagaagguggacgaccugcgcgccgacacgaucuccagucagaucgagcucgcgguccugcuguccaacgagggcaucaucaacagcgaggacgagcaccuccuggcccuggagcggaagcucaagaagaugcuggggcccuccgccguggacaucggcaacggguguuucgagaccaagcacaagugcaaccagaccugccuggaccgcaucgccgcgggcaccuucaaugccggggaguucagccuccccaccuucgacucccugaacaucacggccgccagccugaacgaugacggccucgacaaccacaccauccugcuguacuacuccaccgccgcgagcucccuggccgugacccucaugcuggccaucuuuaucgucuacauggugagccgggacaacguguccugcagcaucugccuguga

SEQ ID NO: 16231 - RNA, 1755 nt, Artificial Sequence; identical to SEQ ID NO: 16188
  derived and/or modified CDS sequence (AUadapt) from InfluenzaB__ALN39770__HA

SEQ ID NO: 16232 - RNA, 1755 nt, Artificial Sequence; identical to SEQ ID NO: 16188
  derived and/or modified CDS sequence (AUadapt) from InfluenzaB__ALN39771__HA

SEQ ID NO: 16233 - RNA, 1755 nt, Artificial Sequence; identical to SEQ ID NO: 14114
  derived and/or modified CDS sequence (AUadapt) from InfluenzaB__ALN39773__HA

SEQ ID NO: 16234 - RNA, 1755 nt, Artificial Sequence; identical to SEQ ID NO: 14114
  derived and/or modified CDS sequence (AUadapt) from InfluenzaB__ALN39774__HA

SEQ ID NO: 16235 - RNA, 1758 nt, Artificial Sequence
  derived and/or modified CDS sequence (AUadapt) from InfluenzaB__ALN39775__HA
augcaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccacuuugccaaccugaaggggacggagacccggggcaagcucugccccaagugccugaacugcaccgaccuggacguggcccucgggcgccccaagugcaccggcaagaucccguccgcccgggugucgauccugcacgagguccgccccgugacguccggcugcuuucccaucaugcacgaccggaccaagauccgccagcugcccaaccuccugcggggguacgagcacauccgccugagcacccacaacgugaucaacgccgaggacgcgccgggcgggcccuacaagaucggcaccuccgggaguugccccaacaucacgaacggcaacggcuucuucgccaccauggccugggccguccccaagaacgacaagaacaagaccgcgaccaacccgcucacgaucgaggugcccuacaucuguaccgagggggaggaccagaucaccguguggggcuuccacuccgacaacgagacccagauggccaagcuguacggggacagcaagccccagaaguucacguccucggccaacggcgucaccacccauuacgugucccagaucggcggguuccccaaccagaccgaggacggcgggcugccgcagagcggccggaucgugaucgacuacaugguccagaaguccgggaagacgggcaccaucaccuaccagcgcggcauccuccugccccagaagguguggugcgugucggggcgguccaaggucaucaagggcagccugccccucaucggggaggccgauugccugcacgagaaguacggcgggcugaacaagucgaagcccuacuacaccggcgagcacgccaaggcggugggcaacugcccgaucugggugaagacgccccucaagcuggccaacgggaccaaguaucgcccgcccgccaagcugcucaaggagcggggcuucuucggggccaucgccggcuuccuggagggcgggugggagggcaugaucgcgggguggcacggcuacaccucccacggggcccacggcgucgccguggccgccgaccugaaguccacccaggaggcgaucaacaagaucacgaagaaccucaacucccugagugagcuggaggucaagaaccuccagcgccuguccggcgccauggacgagcugcacaacgagauccucgagcuggacgagaagguggacgaccugcgggccgacaccaucucgucccagaucgagcucgccgugcugcugagcaacgaggggaucaucaauuccgaggacgagcaccuccuggcccuggagcgcaagcucaagaagaugcugggccccucggcggucgagaucgggaacggcugcuucgagaccaagcacaagugcaaccagaccugccuggaccggaucgccgccgggaccuuugacgccggcgaguucucccuccccacguucgacagccugaacaucaccgcggccucccugaacgacgacggccucgacaaccauaccauccugcuguacuacucgaccgccgccuccagccuggccgugacgcucaugaucgcgaucuucguggucuacauggugucccgcgacaacgugagcugcuccaucugccuguga

SEQ ID NO: 16236 - RNA, 1755 nt, Artificial Sequence
  derived and/or modified CDS sequence (AUadapt) from InfluenzaB__ALN39776__HA
augaaggccaucaucauccugcucaugguggucaccaguaacgccgaccgcaucugcaccggcaucacguccagcaacagcccccacguggugaagaccgcgacccagggggaggucaacgugaccggcgugaucccgcugacgaccacccccaccaaguccuauuucgccaaccugaaggggacgcggacccgcggcaagcucugccccgacugccugaacugcaccgaccuggaugucgcccucgggcggcccaugugcgugggcaccacgccguccgccaaggccagcauccugcacgaggugcgccccgucaccuccggcugcuuccccaucaugcacgaccggaccaagauccgccagcugcccaaccuccugcggggguaugagaagauccgccugucgacccagaacgugaucgacgcggagaaggccccgggcgggcccuaccggcucggcacguccgggagcugccccaacgccaccuccaagaucggcuucuuugccaccauggcgugggccgugcccaaggacaacuacaagaacgccaccaacccgcagacggucgaggugcccuacaucugcaccgagggcgaggaccagaucaccguguggggguuucacagcgacaacaagacccagaugaagucccuguacggcgacagcaacccccagaaguuuacguccucggccaacggggucaccacccacuacgugucccagaucggcgacuuccccgaccagaccgaggacggcgggcugccgcagaguggccgcaucguggucgacuacaugaugcagaagcccgggaagacgggcaccaucguguaccagcgcggggugcuccugccccagaaggucuggugcgccuccggccggagcaaggugaucaagggcagccugccccucaucggggaggcggacugccugcaugaggaguacggcgggcugaacaaguccaagccguacuacaccggcaagcacgccaaggccaucgggaacugccccaucugggugaagacgccccucaagcuggccaacggcaccaaguaucggcccccggccaagcugcucaaggagcgcggcuucuucggggcgaucgccggcuuccuggagggcgggugggaggggaugaucgccggcuggcacggcuacaccagccacggggcccacggcgucgccguggcggccgaucugaaguccacccaggaggccaucaacaagaucaccaagaaccucaacucgcuguccgagcuggaggucaagaaccuccagcggcugagcggggccauggacgagcugcacaaugagauccucgagcuggacgagaagguggacgaccugcgcgccgacacgaucuccagccagaucgagcucgcggugcugcuguccaacgagggcaucaucaacagcgaggaugagcaccuccuggcccuggagcggaagcucaagaagaugcugggccccuccgccgucgacaucgggaacggcugcuucgagaccaagcacaagugcaaccagaccugucuggaccgcaucgccgcggggaccuucaacgccggcgaguucucgcuccccaccuucgacucccugaacaucacggccgccagucugaacgacgacgggcucgacaaccacaccauccugcuguacuacuccaccgccgcgaguucccuggccgugacccucaugcuggccaucuucaucguguacauggucagccgggacaacguguccugcagcaucugccuguga

SEQ ID NO: 16237 - RNA, 1755 nt, Artificial Sequence; identical to SEQ ID NO: 14106
  derived and/or modified CDS sequence (AUadapt) from InfluenzaB__ALN39778__HA

SEQ ID NO: 16238 - RNA, 1758 nt, Artificial Sequence; identical to SEQ ID NO: 14100
  derived and/or modified CDS sequence (AUadapt) from InfluenzaB__ALN39779__HA

SEQ ID NO: 16239 - RNA, 1755 nt, Artificial Sequence; identical to SEQ ID NO: 14114
  derived and/or modified CDS sequence (AUadapt) from InfluenzaB__ALN39780__HA

SEQ ID NO: 16240 - RNA, 1758 nt, Artificial Sequence; identical to SEQ ID NO: 14100
  derived and/or modified CDS sequence (AUadapt) from InfluenzaB__ALN39781__HA

SEQ ID NO: 16241 - RNA, 1758 nt, Artificial Sequence; identical to SEQ ID NO: 16179
  derived and/or modified CDS sequence (AUadapt) from InfluenzaB__ALN39782__HA

SEQ ID NO: 16242 - RNA, 1755 nt, Artificial Sequence
  derived and/or modified CDS sequence (AUadapt) from InfluenzaB__ALN39783__HA
augaaggccaucaucgugcugcucauggucgugaccaguaacgccgaccgcaucugcaccggcaucacguccagcaacagcccccacguggucaagaccgcgacccagggggaggugaaugugaccggcgucaucccgcugacgaccacccccaccaaguccuacuucgccaaccugaaggggacgcggacccgcggcaagcucugccccgacugccugaacuguaccgaccuggacguggcccucgggcggcccaugugcgugggcaccacgccguccgccaaggccagcauccugcacgagguccgccccgugaccuccggcugcuuccccaucaugcacgaucggaccaagauccgccagcugcccaaccuccugcggggguacgagaagauccgccugagcacccagaacgugaucgacgcggagaaggccccgggcgggcccuaccggcucggcacguccgggagcugucccaacgccaccuccaagaucggcuucuucgccaccauggcgugggccguccccaaggacaacuacaagaacgccaccaaccugcagacgguggaggugccguauaucugcaccgagggcgaggaccagaucaccgucuggggguuccacagcgacaacaagacccagaugaagucccuguauggcgacucgaacccccagaaguucacguccagcgccaacggggugaccacccacuacgugucccagaucggcgauuuccccgaccagaccgaggacggcgggcucccccagagcggccgcaucgucguggacuacauggugcagaagccggggaagacgggcaccaucgucuaccagcgcggggugcugcugccccagaagguguggugugccuccggccggagcaaggucaucaagggcagccucccccugaucggggaggcggacugccugcacgaggaguacggcgggcucaacaaguccaagcccuacuauaccggcaagcacgccaaggccaucgggaacugcccgaucugggugaagacgccccugaagcuggccaacggcaccaaguaccggccgcccgccaagcuccugaaggagcgcggcuucuucggggcgaucgccggcuuucuggagggcgggugggaggggaugaucgccggcuggcacggcuacaccagccacggggcccacggcgucgccguggcggccgaccucaaguccacccaggaggccaucaacaagaucaccaagaaccugaauagccuguccgagcucgaggugaagaaccugcagcggcugucgggggccauggacgagcuccacaacgagauccuggagcuggacgagaaggucgaugaccuccgcgccgacacgaucuccagccagaucgagcuggcggugcugcucuccaacgagggcaucaucaacagcgaggacgagcaccuccuggcccuggagcggaagcugaagaagaugcugggccccuccgccguggauaucgggaacggcugcuucgagaccaagcacaagugcaaccagaccugccucgaucgcaucgccgcggggaccuucaacgccggcgaguucagccugcccaccuucgacucccugaacaucacggccgccagccucaaugacgacgggcuggacaaccacaccauccugcuguacuacuccaccgccgcgaguucccucgccgucacccugaugcuggccaucuucaucguguacauggugagccgggacaacgucuccugcagcaucugccucuga

SEQ ID NO: 16243 - RNA, 1758 nt, Artificial Sequence; identical to SEQ ID NO: 16191
  derived and/or modified CDS sequence (AUadapt) from InfluenzaB__ALN39784__HA

SEQ ID NO: 16244 - RNA, 1758 nt, Artificial Sequence; identical to SEQ ID NO: 14100
  derived and/or modified CDS sequence (AUadapt) from InfluenzaB__ALN39785__HA

SEQ ID NO: 16245 - RNA, 1755 nt, Artificial Sequence; identical to SEQ ID NO: 14114
  derived and/or modified CDS sequence (AUadapt) from InfluenzaB__ALN39786__HA

SEQ ID NO: 16246 - RNA, 1758 nt, Artificial Sequence; identical to SEQ ID NO: 14100
  derived and/or modified CDS sequence (AUadapt) from InfluenzaB__ALN39787__HA

SEQ ID NO: 16247 - RNA, 1758 nt, Artificial Sequence; identical to SEQ ID NO: 14100
  derived and/or modified CDS sequence (AUadapt) from InfluenzaB__ALN39788__HA

SEQ ID NO: 16248 - RNA, 1755 nt, Artificial Sequence
  derived and/or modified CDS sequence (AUadapt) from InfluenzaB__ALN39790__HA
augaaggccaucaucgugcugcucauggucgugaccagugacgccgaccgcaucugcaccggcaucacguccagcaacaguccccacguggucaagaccgcgacccagggggaggugaacgugaccggcgucaucccgcugacgaccacccccaccaaguccuacuucgccaaccugaaggggacgcggacccgcggcaagcucugccccgauugccugaacugcaccgaccuggacguggcccucgggcggcccaugugcgugggcaccacgccguccgccaaggccaguauccugcacgagguccgccccgugaccuccggcugcuuccccaucaugcacgaccggaccaagauccgccagcugcccaaccuccugcggggguaugagaagauccgccugagcacccagaacgugaucgacgcggagaaggccccgggcgggcccuaccggcucggcacguccgggagcugccccaaugccaccuccaagaucggcuucuucgccaccauggcgugggccguccccaaggacaacuacaagaacgccaccaauccgcagacgguggaggugcccuacaucugcaccgagggcgaggaccagaucaccgucuggggguuccacagcgauaacaagacccagaugaagucccuguacggcgacagcaacccccagcgcuuuacguccagcgccaacggggugaccacccacuacgugucccagaucggcgacuuccccgaucagaccgaggacggcgggcugccgcagagcggccggaucgucguggacuacauggugcagaagcccgggaagacgggcaccaucgucuaccagcgcggggugcuccugccccagaagguguggugcgccuccggccggaguaaggucaucaagggcagccugccccucaucggggaggcggacugccugcacgaggaguacggcgggcugaacaaguccaagccguauuacaccggcaagcacgccaaggccaucgggaacugccccaucugggugaagacgccccucaagcuggccaacggcaccaaguaccggcccccggccaagcugcucaaggagcgcggcuuuuucggggcgaucgccggcuuccuggagggcgggugggaggggaugaucgccggcuggcacggcuacaccagccacggggcccauggcgucgccguggcggccgaccugaaguccacccaggaggccaucaacaagaucaccaagaaccucaacagccuguccgagcuggaggugaagaaccuccagcgccugaguggggccauggacgagcugcacaacgagauccucgagcuggacgagaaggucgacgaucugcgggccgacacgaucuccagccagaucgagcucgcggugcugcuguccaacgagggcaucaucaacagcgaggacgagcaucuccuggcccuggagcgcaagcucaagaagaugcugggccccuccgccguggacaucgggaacggcugcuucgagaccaagcacaagugcaaucagaccugccuggaccggaucgccgcggggaccuucaacgccggcgaguucagccuccccaccuuugacucccugaacaucacggccgccagccugaacgacgacgggcucgauaaccacaccauccugcuguacuacuccaccgccgcgagcucccuggccgucacccucaugcuggccaucuucaucguguauauggugagccgcgacaacgucuccugcagcaucugccuguga

SEQ ID NO: 16249 - RNA, 1755 nt, Artificial Sequence
  derived and/or modified CDS sequence (AUadapt) from InfluenzaB__ALN39791__HA
augaaggccaucaucgugcugcucauggucgugaugaguaacgccgaccgcaucugcaccggcaucaccuccagcaacagcccccacguggucaagacggcgacccagggggaggugaaugugaccggcgucaucccgcugaccacgacccccaccaaguccuacuucgccaaccugaaggggacccggacgcgcggcaagcucugccccgacugccugaacuguaccgaccuggacguggcccucgggcggcccaugugcgugggcaccaccccguccgccaaggccagcauccugcacgagguccgccccgugacguccggcugcuuccccaucaugcacgaucggaccaagauccgccagcugcccaaccuccugcggggguacgagaagauccgccugagcacccagaacgugaucgacgcggagaaggccccgggcgggcccuaccggcucggcaccuccgggagcugucccaacgccacguccaagaucggcuucuucgccaccauggcgugggccguccccaaggacaacuacaagaacgccaccaacccgcagaccguggaggugcccuauaucugcacggagggcgaggaccagaucaccgucuggggguuccacagcgacaacaagacccagaugaagucccuguauggcgacucgaacccccagaaguucaccuccagcgccaacggggugacgacccacuacgugucccagaucggcgauuuccccgaccagaccgaggacggcgggcugccgcagagcggccgcaucgucguggacuacauggugcagaagcccgggaagaccggcacgaucgucuaccagcgcggggugcuccugccccagaagguguggugugccuccggccggagcaaggucaucaagggcagccugccccucaucggggaggcggacugccugcacgaggaguacggcgggcugaacaaguccaagccguacuauaccggcaagcacgccaaggccaucgggaacugccccaucugggugaagacgccccucaagcuggccaacggcaccaaguaccggcccccggccaagcugcucaaggagcgcggcuucuucggggcgaucgccggcuuucuggagggcgggugggaggggaugaucgccggcuggcacggcuacaccagccacggggcccacggcgucgccguggcggccgaccugaaguccacccaggaggccaucaacaagaucaccaagaaccucaauagccuguccgagcuggaggugaagaaccuccagcggcugucgggggccauggacgagcugcacaacgagauccucgagcuggacgagaaggucgaugaccugcgcgccgacaccaucuccagccagaucgagcucgcggugcugcuguccaacgagggcaucaucaacagcgaggacgagcaccuccuggcccuggagcggaagcucaagaagaugcugggccccuccgccguggauaucgggaacggcugcuucgagacgaagcacaagugcaaccagaccugccuggaucgcaucgccgcggggaccuucaacgccggcgaguucagccuccccaccuucgacucccugaacaucaccgccgccagccugaaugacgacgggcucgacaaccacacgauccugcuguacuacuccaccgccgcgaguucccuggccgucacccucaugcuggccaucuucaucguguacauggugagccgggacaacgucuccugcagcaucugccuguga

SEQ ID NO: 16250 - RNA, 1758 nt, Artificial Sequence; identical to SEQ ID NO: 14100
  derived and/or modified CDS sequence (AUadapt) from InfluenzaB__ALN39792__HA

SEQ ID NO: 16251 - RNA, 1758 nt, Artificial Sequence; identical to SEQ ID NO: 14100
  derived and/or modified CDS sequence (AUadapt) from InfluenzaB__ALN39793__HA

SEQ ID NO: 16252 - RNA, 1755 nt, Artificial Sequence
  derived and/or modified CDS sequence (AUadapt) from InfluenzaB__ALN39794__HA
augaaggccaucaucauccugcucaugguggucaccaguaacgccgaccgcaucugcaccggcaucacguccagcaacagcccccacguggugaagaccgcgacccagggggaggucaaugugaccggcgugaucccgcugacgaccacccccaccaaguccuacuucgccaaccugaaggggacgcggacccgcggcaagcucugccccgacugccugaacuguaccgaccuggacgucgcccucgggcggcccaugugcgugggcaccacgccguccgccaaggccagcauccugcacgaggugcgccccgucaccuccggcugcuuccccaucaugcacgaucggaccaagauccgccagcugcccaaccuccugcggggguacgagaagauccgccugagcacccagaacgugaucgacgcggagaaggccccgggcgggcccuaccggcucggcacguccgggucgugucccaacgccaccuccaagaucggcuucuucgccaccauggcgugggccgugcccaaggacaacuacaagaacgccaccaacccgcagacggucgaggugcccuauaucugcaccgagggcgaggaccagaucaccguguggggguuccacagcgacaacaagacccagaugaagucccuguauggcgacagcaacccccagaaguucacguccagcgccgacggggucaccacccacuacgugucccagaucggcgauuuccccgaccagaccgaggacggcgggcugccgcagagcggccgcaucguggucgacuacaugaugcagaagcccgggaagacgggcaccaucguguaccagcgcggggugcuccugccccagaaggucuggugugccuccggccggagcaaggugaucaagggcucgcugccccucaucggggaggcggacugccugcacgaggaguacggcgggcugaacaaguccaagccguacuauaccggcaagcacgccaaggccaucgggaacugccccaucugggugaagacgccccucaagcuggccaacggcaccaaguaccggcccccggccaagcugcucaaggagcgcggcuucuucggggcgaucgccggcuuucuggagggcgggugggaggggaugaucgccggcuggcacggcuacaccagccacggggcccacggcgucgccguggcggccgaccugaaguccacccaggaggccaucaacaagaucaccaagaaccucaauagccuguccgagcuggaggucaagaaccuccagcggcugagcggggccauggacgagcugcacaacgagauccucgagcuggacgagaagguggaugaccugcgcgccgacacgaucuccagccagaucgagcucgcggugcugcuguccaacgagggcaucaucaacucggaggacgagcaccuccuggcccuggagcggaagcucaagaagaugcugggccccuccgccgucgauaucgggaacggcugcuucgagaccaagcacaagugcaaccagaccugccuggaucgcaucgccgcggggaccuucaacgccggcgaguucagccuccccaccuucgacucccugaacaucacggccgccagccugaaugacgacgggcucgacaaccacaccauccugcuguacuacuccaccgccgcgaguucccuggccgugacccucaugcuggccaucuucaucguguacauggucagccgggacaacguguccugcagcaucugccuguga

SEQ ID NO: 16253 - RNA, 1755 nt, Artificial Sequence; identical to SEQ ID NO: 14106
  derived and/or modified CDS sequence (AUadapt) from InfluenzaB__ALN39795__HA

SEQ ID NO: 16254 - RNA, 1758 nt, Artificial Sequence
  derived and/or modified CDS sequence (AUadapt) from InfluenzaB__ALN39796__HA
augaaggccaucaucgugcugcucauggucgugaccaguaacgccgaccgcaucugcaccggcaucacguccagcaacucgccccacguggucaagaccgcgacccagggggaggugaacgugaccggcgucaucccgcugacgaccacccccaccaagagccauuucgccaaccugaaggggacggagacccggggcaagcucugccccaagugccugaacugcaccgaccuggacguggcccucgggcgccccaagugcaccggcaagaucccguccgcccgggugaguauccugcacgagguccgccccgugacguccggcugcuuccccaucaugcacgaccggaccaagauccgccagcugcccaaccuccugcggggguacgagcacauccgccugagcacccauaacgugaucaacgccgaggacgcgccgggcgggcccuacaagaucggcaccuccgggucgugccccaacgccacgaacggcaacggcuuuuucgccaccauggccugggcgguccccaagaacgacaagaacaagaccgccaccaacccgcucacgaucgaggugcccuacaucugcaccgagggggaggaccagaucaccguguggggcuuccacuccgauaacgagacccagauggccaagcuguacggggacagcaagccccagaaguucacguccucggccaacggcgucaccacccacuacgugucccagaucggcggguuucccaaccagaccgaggacggcgggcugccgcagagcggccggaucguggucgacuacauggugcagaaguccgggaagacgggcaccaucaccuaccagcgcggcauccuccugccccagaagguguggugcgccucggggcgguccaaggucaucaagggcagccugccccucaucggggaggcggauugccugcacgagaaguacggcgggcugaacaagucgaagcccuacuacaccggcgagcacgccaaggccaucggcaacuguccgaucugggugaagacgccccucaagcuggccaacgggaccaaguaccgcccgcccgccaagcugcucaaggagcggggcuucuucggggcgaucgccggcuuccuggagggcgggugggagggcaugaucgccggguggcacggcuacaccucccacggggcccacggcguggccgucgcggccgaucugaaguccacccaggaggccaucaacaagaucacgaagaaccucaacucccugagcgagcuggaggugaagaaccuccagcgccuguccggcgccauggacgagcugcacaacgagauccucgagcuggacgagaaggucgacgaucugcgggccgacaccaucucgucccagaucgagcucgcggugcugcugagcaacgaggggaucaucaacuccgaggacgagcaccuccuggcccuggagcgcaagcucaagaagaugcugggccccucggccguggagaucgggaacggcuguuucgagaccaagcacaagugcaaccagaccugccuggaccggaucgccgcggggaccuucgacgccggcgaguucucccuccccacguuugacagccugaacaucaccgccgccucccugaacgacgacggccucgacaaccacaccauccugcuguauuacucgaccgccgcguccagccuggccgucacgcucaugaucgccaucuucgugguguacauggucucccgcgacaacgugagcugcuccaucugccuguga

SEQ ID NO: 16255 - RNA, 1755 nt, Artificial Sequence; identical to SEQ ID NO: 14106
  derived and/or modified CDS sequence (AUadapt) from InfluenzaB__ALN39797__HA

SEQ ID NO: 16256 - RNA, 1755 nt, Artificial Sequence
  derived and/or modified CDS sequence (AUadapt) from InfluenzaB__ALN39798__HA
augaaggccaucaucgugcugcucauggucgugaccaguaacgccgaccgcaucugcaccggcaucacguccagcuccagcccccacguggucaagaccgcgacccagggggaggugaacgugaccggcgucaucccgcugacgaccacccccaccaaguccuauuucgccaaccugaaggggacgcggacccgcggcaagcucugccccgacugccugaacugcaccgaucuggacguggcccucgggcggcccaugugcgugggcaccacgccgagcgccaaggccuccauccugcacgagguccgccccgugaccagcggcugcuuccccaucaugcaugaccggaccaagauccgccagcugcccaaccuccugcggggguacgagaagauccgccuguccacccagaacgugaucgacgcggagaaggccccgggcgggcccuaccggcucggcacgagcggguccugucccaacgccaccagcaagaucggcuucuucgccaccauggcgugggccguccccaaggacaacuacaagaaugccaccaacccgcagacgguggaggugcccuacaucugcaccgagggcgaggaccagaucaccgucuggggguuccacuccgacaauaagacccagaugaagucccuguacggcgacucgaacccccagaaguucacgagcuccgccaacggggugaccacccauuacgugagccagaucggcgacuuccccgaccagaccgaggacggcgggcugccgcaguccggccgcaucgucguggacuauaugaugcagaagcccgggaagacgggcaccaucguguaccagcgcgggguccuccugccccagaagguguggugcgccagcggccggagcaaggugaucaagggcucccugccccucaucggggaggcggacugccugcacgaggaguauggcgggcugaacaagagcaagccguacuacaccggcaagcacgccaaggccaucgggaacugccccaucugggucaagacgccccucaagcuggccaauggcaccaaguaccggcccccggccaagcugcucaaggagcgcggcuucuucggggcgaucgccggcuuccuggagggcgggugggaggggaugaucgccggcuggcacggcuacaccucccacggggcccauggcguggccgucgcggccgaccucaagagcacccaggaggccaucaacaagaucaccaagaaccugaacucccugagcgagcuggaggugaagaaccuccagcggcuguccggggccauggaugagcugcacaacgagauccucgagcuggacgagaagguggacgaccugcgcgccgacacgaucucgucccagaucgagcucgcgguccugcugaguaacgagggcaucaucaacuccgaggacgagcaccuccuggcccuggagcggaagcucaagaagaugcugggccccagcgccguggacaucgggaacggcuguuucgagaccaagcacaagugcaaccagaccugccuggaccgcaucgccgcggggaccuucaaugccggcgaguucucccuccccaccuucgacagccugaacaucacggccgccucccugaacgacgaugggcucgacaaccacaccauccugcuguacuacagcaccgccgcguccagccuggccgugacccucaugcuggccaucuuuaucgucuacauggugucccgggacaacgugagcugcagcaucugccuguga

SEQ ID NO: 16257 - RNA, 1755 nt, Artificial Sequence; identical to SEQ ID NO: 14114
  derived and/or modified CDS sequence (AUadapt) from InfluenzaB__ALN39799__HA

SEQ ID NO: 16258 - RNA, 1755 nt, Artificial Sequence
  derived and/or modified CDS sequence (AUadapt) from InfluenzaB__ALN39800__HA
augaaggccaucaucgugcugcucauggucgugaccaguaacgccgaccgcaucugcaccggcaucacguccagcaacagcccccacguggucaagaccgcgacccagggggaggugaacgugaccggcgucaucccgcugacgaccacccccaccaaguccuauuucgccaaccugaaggggacgcggacccgcggcaagcucugccccgacugccugaacugcaccgaccuggacguggcccucgggcggcccaugugugugggcaccacgccguccgccaaggccucgauccugcacgagguccgccccgugaccuccggcugcuuccccaucaugcacgaccggaccaagauccgccagcugcccaaccuccugcggggguacgagaagauccgccugaguacccagaacgugaucgacgcggagaaggccccgggcgggcccuaccggcucggcacguccgggagcugccccaacgccaccuccaagaucggcuucuucgccaccauggcgugggccguccccaaggacaauuacaagaacgccaccaacccgcagacgguggaggugcccuacaucugcaccgagggcgaggaccagaucaccgucuggggguuccacagcgauaacaagacccagaugaagucccuguacggcgacucgaacccccagaaguucacguccagcgccaacggggugaccacccauuacgugucccagaucggcgacuuccccgaccagaccgaggacggcgggcugccgcagagcggccgcaucgucguggacuacaugaugcagaagcccgggaagacgggcaccaucguguaccagcgcgggguccuccugccccagaagguguggugugccuccggccggagcaaggugaucaagggcucgcugccccucaucggggaggcggacugccugcacgaggaguacggcgggcugaacaaguccaagccguacuauaccggcaagcacgccaaggccaucgggaacugccccaucugggucaagacgccccucaagcuggccaacggcaccaaguaccggcccccggccaagcugcucaaggagcgcggcuucuucggggcgaucgccggcuuccuggagggcgggugggaggggaugaucgccggcuggcacggcuauaccagccacggggcccacggcguggccgucgcggccgaccugaaguccacccaggaggccaucaacaagaucaccaagaaccucaacagccuguccgagcuggaggugaagaaccuccagcggcugaguggggccauggacgagcugcacaacgagauccucgagcuggacgagaagguggacgaccugcgcgccgacacgaucuccagccagaucgagcucgcgguccugcuguccaaugagggcaucaucaacagcgaggacgagcaccuccuggcccuggagaagaagcucaagaagaugcugggccccuccgccguggacaucgggaacggcugcuucgagaccaagcacaaguguaaccagaccugccuggaccggaucgccgcggggaccuucaacgccggcgaguucagccuccccaccuucgauucccugaacaucacggccgccucgcugaacgacgacgggcucgacaaccacaccauccugcuguacuauuccaccgccgcgagcucccuggccgugacccucaugcuggccaucuucaucgucuacauggugagccgcgacaacguguccugcagcaucugccuguga

SEQ ID NO: 16259 - RNA, 1755 nt, Artificial Sequence; identical to SEQ ID NO: 16249
  derived and/or modified CDS sequence (AUadapt) from InfluenzaB__ALN39801__HA

SEQ ID NO: 16260 - RNA, 1755 nt, Artificial Sequence; identical to SEQ ID NO: 14106
  derived and/or modified CDS sequence (AUadapt) from InfluenzaB__ALN39802__HA

SEQ ID NO: 16261 - RNA, 1755 nt, Artificial Sequence; identical to SEQ ID NO: 16249
  derived and/or modified CDS sequence (AUadapt) from InfluenzaB__ALN39803__HA

SEQ ID NO: 16262 - RNA, 1755 nt, Artificial Sequence; identical to SEQ ID NO: 16188
  derived and/or modified CDS sequence (AUadapt) from InfluenzaB__ALN39804__HA

SEQ ID NO: 16263 - RNA, 1758 nt, Artificial Sequence; identical to SEQ ID NO: 14100
  derived and/or modified CDS sequence (AUadapt) from InfluenzaB__ALN39805__HA

SEQ ID NO: 16264 - RNA, 1410 nt, Artificial Sequence
  derived and/or modified CDS sequence (AUadapt) from InfluenzaA__H3N2(Hongkong-4801-2014)-NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccucguccugccacgacggcaaggccuggcugcacgucugcaucaccggggacgacaagaacgcgaccgccagcuucaucuacaacggccggcucguggacuccguggucucgugguccaaggacauccugcgcacccaggagagcgagugcaucugcaucaacgggacgugcaccguggugaugaccgacggcuccgccucgggcaaggccgacaccaagauccuguucaucgaggaggggaagaucguccacacgagcacccucuccggcucggcgcagcacguggaggagugcuccugcuacccccgguacccgggggugcgcugcgucugccgggacaacuggaagggcucgaaccgcccgaucguggacaucaacaucaaggaccacuccaucgugagcuccuacgucugcucgggccuggugggggacaccccgcggaagaacgacuccagcuccucgucccacugccuggaccccaacaacgaggagggcgggcacggcgugaaggggugggccuucgacgacggcaacgacgucuggaugggccgcaccaucaacgagacgucgcggcucggguacgagaccuucaaggugaucgagggcugguccaacccgaagagcaagcugcagaccaaccgccaggucaucguggaccggggcgaccgcuccggguacucggggaucuucuccguggagggcaagagcugcaucaaccggugcuucuacgucgagcugauccgcggccggaaggaggagaccgaggugcucuggacgucgaacuccaucguggucuucugcgggaccagcggcaccuacgggaccggcuccuggcccgacggggccgaccugaaccugaugcccaucuga

SEQ ID NO: 16265 - RNA, 1410 nt, Artificial Sequence
  derived and/or modified CDS sequence (AUadapt) from InfluenzaA__H1N1(California2009)-NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcgugcggaucggcuccaagggggacgucuucgugauccgcgagccguucaucagcugcuccccccuggagugccggaccuucuuccugacccagggcgcccuccugaacgacaagcacagcaacgggaccaucaaggaccgcucccccuaccggacgcugaugucgugcccgaucggcgaggugcccucccccuacaacagccgcuucgagagcgucgccugguccgcgagcgccugccacgacgggaucaacuggcucaccaucggcaucuccggccccgacaacggggccguggccgugcugaaguacaacggcaucaucaccgacaccaucaagagcuggcggaacaacauccugcgcacgcaggaguccgagugcgcgugcgucaacgggucgugcuucaccgugaugaccgacggcccguccaacggccaggccagcuacaagaucuuccggaucgagaaggggaagaucgugaaguccgucgagaugaacgcccccaacuaccacuacgaggagugcagcugcuaccccgacuccagcgagaucaccugcgugugccgcgacaacuggcacggcuccaaccggcccugggugucguucaaccagaaccucgaguaccagaucggguacaucugcuccggcaucuucggggacaacccgcgccccaacgacaagacgggcagcugcggccccgucuccagcaacggggccaacggcgugaagggguucuccuucaaguacggcaacgggguguggaucggccggaccaagagcaucagcucccgcaacggcuucgagaugaucugggaccccaacggguggaccggcaccgacaacaacuucucgaucaagcaggacaucgucgggaucaacgagugguccggcuacagcggguccuucgugcagcacccggagcugacgggccuggacugcauccggcccugcuucuggguggagcucauccgcggccggcccaaggagaacaccaucuggaccagcggguccagcaucuccuucugcggcgucaacagcgacaccguggggugguccuggcccgacggcgccgagcugccguucacgaucgacaaguga

SEQ ID NO: 16266 - RNA, 1410 nt, Artificial Sequence
  derived and/or modified CDS sequence (AUadapt) from InfluenzaA__H1N1(Netherlands2009)-NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcgugcgggugggcuccaagggggacgucuucgugauccgcgagccguucaucagcugcuccccccuggagugccggaccuucuuccugacccagggcgcccuccugaacgacaagcacagcaacgggaccaucaaggaccgcucccccuaccggacgcugaugucgugcccgaucggcgaggugcccucccccuacaacagccgcuucgagagcgucgccugguccgcgagcgccugccacgacgggaucaacuggcucaccaucggcaucuccggccccgacaacggggccguggccgugcugaaguacaacggcaucaucaccgacaccaucaagagcuggcggaacaacauccugcgcacgcaggaguccgagugcgcgugcgucaacgggucgugcuucaccgugaugaccgacggcccguccaacggccaggccagcuacaagaucuuccggaucgagaaggggaagaucgugaaguccgucgagaugaacgcccccaacuaccacuacgaggagugcagcugcuaccccgacuccagcgagaucaccugcgugugccgcgacaacuggcacggcuccaaccggcccugggugucguucaaccagaaccucgaguaccagaucggguacaucugcuccggcaucuucggggacaacccgcgccccaacgacaagacgggcagcugcggccccgucuccagcaacggggccaacggcgugaagggguucuccuucaaguacggcaacgggguguggaucggccggaccaagagcaucagcucccgcaacggcuucgagaugaucugggaccccaacggguggaccggcaccgacaacaacuucucgaucaagcaggacaucgucgggaucaacgagugguccggcuacagcggguccuucauccagcacccggagcugacgggccuggacugcauccggcccugcuucuggguggagcucauccgcggccggcccaaggagaacaccaucuggaccagcggguccagcaucuccuucugcggcgucaacagcgacaccguggggugguccuggcccgacggcgccgagcugccguucacgaucgacaaguga

SEQ ID NO: 16267 - RNA, 1365 nt, Artificial Sequence
  derived and/or modified CDS sequence (AUadapt) from InfluenzaA__H1N1(PR8)-NA
augaaucccaaccagaagaucaucaccaucggcucgaucugccugguggucgggcucaucucccugauccugcagaucggcaacaucaucagcaucuggaucucccacagcauccagaccgggucccagaaccacacgggcaucugcaaccagaacaucaucaccuacaagaacagcaccugggugaaggacaccacguccgugauccucaccgggaacucgucccuguguccgauccggggcugggccaucuacagcaaggacaacuccauccgcaucggcagcaagggggacgucuucgugauccgggagcccuucaucuccugcagccaccuggagugccgcaccuucuuccucacccagggcgcccugcugaacgacaagcacuccagcgggacggugaaggaucggucccccuaccgcgcgcucaugucgugccccgucggcgaggccccgucccccuacaacagccgguucgagagcguggccugguccgccagcgccugccacgacgggaugggcuggcugaccaucggcaucuccgggcccgacaacggcgcgguggccguccugaaguacaacgggaucaucaccgagaccaucaagagcuggcgcaagaagauccuccggacgcaggaguccgagugcgccugcgugaauggcucgugcuucaccaucaugaccgacggccccuccgacgggcuggccagcuacaagaucuucaagaucgagaagggcaaggugaccaaguccaucgagcugaacgcgccgaacagccacuacgaggagugcuccugcuaccccgacacggggaaggucaugugcgugugucgcgacaacuggcacggcagcaaccggcccuggguguccuucgaccagaaccucgacuaccagaucggguacaucugcucgggcgucuucggcgacaacccccgcccggaggacgggaccggcuccugcgggcccguguacguggauggcgccaacggggucaagggcuucagcuaccgguacggcaacgggguguggaucggccgcaccaagucccacagcucccggcacggguucgagaugaucugggaccccaacggcuggaccgagacggacagcaaguucagcgugcgccaggacgucguggccaugaccgacugguccggguauucgggcuccuucgugcagcaccccgagcugaccggccuggacugcaugcggccgugcuucugggucgagcucauccgcgggcggcccaaggagaagaccaucuggacgagcgccuccagcaucuccuucugcggcgugaacagcgacaccgucgacugguccuggcccgacggggccgagcugcccuucagcaucgacaaguga

SEQ ID NO: 16268 - RNA, 1350 nt, Artificial Sequence
  derived and/or modified CDS sequence (AUadapt) from InfluenzaA__H5N1(Bavaria2006)-NA
augaaucccaaccaaaagaucaucaccaucggcagcaucugcauggugaucgggaucgucucccugaugcuccagaucggcaacaugaucagcaucugggugucccacagcauccagaccgggaaucagcggcaggccgagccgaucuccaacacgaaguuccugaccgagaaggccguggcgagcgucacccuggccggcaacuccagccucugccccaucuccgggugggccguguacaguaaagacaacuccauccgcaucggcagccggggcgacguguucgucauccgcgagcccuucaucuccugcagucaccuggagugccggaccuucuuccugacgcagggggcccuccugaacgacaagcacuccaacggcaccaucaaggaucgcagcccccaccggacccugauguccugcccggugggggaggcccccagccccuacaacucccgcuucgagaguguggcguggagcgccuccgccugccacgacggcaccagcuggcucacgaucgggaucuccggccccgacaacggcgccgucgcggugcugaaguauaacgggaucaucaccgacaccaucaagagcuggcggaacaacauccugcgcacccaagaguccgagugcgccugcgugaacggcaguugcuucacggucaugaccgacgggccguccagcggccaggccuccuacaagaucuucaagauggagaagggcaagguggugaagagcgucgaacucgaugcccccaacuaccacuacgaggagugcuccugcuaccccgaugccggggagaucaccugcgugugccgggacaacuggcacggcagcaaccgccccuggguguccuucaaucagaaccuggaguaccagaucggguacaucugcagcggcgucuucggggacaauccgcggcccaacgacggcaccggcuccugcgggcccgugagccccaacggcgcguacggggugaagggcuucuccuuuaaguacgggaacggcgucuggaucggccgcacgaagagcaccaacucccggagcggguucgaaaugaucugggacccgaacggcuggaccgggaccgauagcuccuucagcgugaagcaggacaucguggccaucacggacugguccggcuacagcggguccuuuguccagcaccccgagcugaccggccucgacugcauccgccccugcuucuggguggagcugauccggggccgccccaaggagagcaccaucuggaccuccgggagcuccaucaguuucugcggcgucaacuccgacacggugagcugguccuggccggacggggccgagcugcccuucaccaucgacaaguga

SEQ ID NO: 16269 - RNA, 1350 nt, Artificial Sequence
  derived and/or modified CDS sequence (AUadapt) from InfluenzaA__H5N1(Vietnam2004)-NA
augaaucccaaccagaagaucaucaccaucggcucgaucugcauggugaccgggaucgucucccugaugcuccagaucggcaacaugaucagcaucugggugucccacaguauccacacggggaaccagcaccaguccgagccgaucagcaacaccaaccugcugaccgagaaggccguggccuccgucaagcucgcgggcaauagcucccugugccccaucaacgggugggccguguacagcaaggacaauuccauccggaucggcagcaagggcgacguguucgucauccgcgagcccuucaucuccugcagccaucuggagugccggaccuucuuccucacgcagggggcccugcugaacgacaagcacuccaauggcaccgugaaggaccgcagcccccaccggacccucauguccugcccggugggggaggcccccagccccuacaauucccgcuucgagagcgucgccuggagcgcguccgccugccacgacggcaccagcuggcugacgaucgggaucuccggccccgauaacggcgccguggccgugcugaaguacaacgggaucaucaccgacaccaucaagagcuggcggaacaauauccuccgcacccaggaguccgagugcgcgugcgucaacggcucgugcuucacggugaugaccgaugggccguccaacggccaggccagccacaagaucuucaagauggagaagggcaagguggucaaguccguggagcuggacgcccccaacuaucacuacgaggagugcagcugcuaccccgaugccggggagaucaccugcgugugccgggacaacuggcacggcuccaaccgccccugggucaguuucaaccagaaccuggaguaccagaucggguacaucugcuccggcguguucggggauaacccgcggcccaacgacggcaccggcagcugcgggcccguguccagcaauggcgccgggggcgucaagggguucuccuucaaguacggcaacggcguguggaucgggcgcacgaagagcaccaacucccggaguggcuucgagaugaucugggaccccaacggguggaccgagaccgacagcuccuucagugugaagcaggacaucgucgcgaucacggacugguccggcuacagcggguccuucgugcagcacccggagcucaccggccuggauugcauccgccccugcuucugggucgagcugauccggggccgccccaaggagagcaccaucuggaccuccgggagcuccaucagcuuuugcggcgugaacuccgacacggugggguggagcuggcccgacggcgccgagcucccguucaccaucgacaaguga

SEQ ID NO: 16270 - RNA, 1413 nt, Artificial Sequence
  derived and/or modified CDS sequence (AUadapt) from InfluenzaA__H5N8(A-chicken-Poland-79A-2016)-NA
augaaucccaaccaaaagaucgccaccaucggcagcaucucccuggggcucguggucuucaacgugcugcugcacgccgugagcaucauccucaugguccuggcgcugggcaaguccgagaacaacgggaucugcaagggcaccaucgugcgcgaguacaacgagacggugcggaucgagaaggucacccagugguacaauaccagcgugguggaguacgucccgcacuggaacgagggggccuacaucaacaacaccgaacccaucugcgacgugaagggcuucgcccccuucuccaaggacaacggcauccgcaucgggagucggggccacaucuucgugauccgcgagcccuucgucuccugcagcccgguggagugccggacguucuuccucacccagggggcccugcugaacgacaagcacuccaacggcaccgugaaggaccgcagucccuuccggacccucauguccgucgagguggggcagagccccaacguguaccaggcccgcuucgaggcggucgccugguccgccacggccugccacgacggcaaaaaguggaugaccaucggcgugaccgggcccgacagcaaggcgguggccgucgugcacuacggcggggugccgaccgacgucgugaauuccugggccggcgacauccugcggacgcaggagagcuccugcacgugcauccagggcaacugcuacugggucaugaccgacgggcccgccaaccgccaggcccaguaccggaucuacaaggcgaaccagggcaagaucaucgaccagaccgaugugagcuucuccgggggccacaucgaagagugcagcugcuaccccaacgacgggaagguggagugcgucugccgcgacaacuggaccggcaccaaucggcccgugcuggugaucagcccggaccucuccuaccgcgucggcuaccugugcgccgggcugcccagcgacacgccccggggcgaggacgcccaguucgugggguccugcaccagccccaugggcaaccagggguacggcgugaagggcuuuggguuccgccagggcaccgacgucuggguggggcggaccaucucccgcaccagccgguccggcuucgagaucauccgcaucaagaacggguggacccagacgagcaaagagcagauccggcgccagguggucguggacaaccucaacugguccggcuacagcggcuccuucacccugccgguggagcugagcgggcgcgagugucucguccccugcuucuggguggagaugauccggggccgccccgaggagcggaccaucuggaccuccagcuccagcaucgugaugugcggggucgaccacgagaucgccgacugguccuggcacgacggcgccauccugcccuucgacaucgacaagauguga

SEQ ID NO: 16271 - RNA, 1413 nt, Artificial Sequence
  derived and/or modified CDS sequence (AUadapt) from InfluenzaA__H5N8(A-wildduck-Germany-BW-R8455-2016)-NA
augaaucccaaccaaaagaucgccaccaucggcagcaucucccuggggcucguggucuucaacgugcugcugcacgccgugagcaucauccucaugguccuggcgcugggcaaguccgagaacaacgggaucugcaagggcaccaucgugcgcgaguacaacgagacggugcggaucgagaaggucacccagugguacaacaccagcgugguggaauaugucccgcacuggaacgagggggccuacaucaacaacaccgagcccaucugcgacgugaagggcuucgcccccuucuccaaggacaacggcauccgcguggggagccggggccacaucuucgucauccgcgagcccuucguguccuguagcccgguggagugccggacguucuuccucacccagggggcccugcugaacgacaagcacuccaacggcaccgucaaggaccgcagccccuuccggacccucauguccguggaaguggggcagagccccaacgucuaccaggcccgcuuugaggcgguggccugguccgccacggccugccacgacggcaagaaguggaugaccaucggcgugaccgggcccgacagcaaggcggucgccguggugcacuacggcggggucccgaccgacguggucaacuccugggccggcgacauccugcggacgcaggagagcuccugcacgugcauccagggcaacugcuauugggugaugaccgacgggcccgccaaccgccaagcccaguaccggaucuacaaggcgaaccagggcaagaucaucgaccagaccgacgugagcuucuccgggggccacaucgaggagugcagcugcuaccccaacgaugggaaggucgagugcgugugccgcgacaacuggaugggcaccaaccggcccgugcuggucaucagcccggaccucuccuaccgcgugggcuaccugugcgccgggcugcccagcgacacgccccggggcgaagacgcccaguucgugggguccuguaccagccccaugggcaaccagggguacggcgucaagggcuucggguuccgccagggcaccgacguguggguggggcggaccaucucccgcaccagccgguccggcuucgagaucauccgcaucaagaacggguggacccagaccagcaaggagcaaauccggcgccaggucgugguggacaaccucaacugguccggcuacagcggcuccuuuacgcugccggucgagcugagcgggcgcgagugccucgugcccugcuucuggguggagaugauccggggccgccccgaggagcggaccaucuggaccuccagcuccagcaucgucaugugcgggguggaccacgagaucgccgacugguccuggcacgacggcgccauccugcccuucgacaucgacaagauguga

SEQ ID NO: 16272 - RNA, 1413 nt, Artificial Sequence
  derived and/or modified CDS sequence (AUadapt) from InfluenzaA__H5N8(A-domestic goose-Poland-33-2016)-NA
augaaucccaaccaaaagaucgccaccaucggcagcaucucccuggggcucgccguguucaacguccugcugcacgcggugagcaucauccucauggugcuggcccugggcaaguccgagaacaacgggaucugcaagggcaccaucguccgcgaguacaacgagacggugcggaucgagaaggugacccagugguauaacaccagcgucguggaauacgugccgcacuggaacgaggggaccuacaucaacaacacggagcccaucugcgacgucaagggcuucgcccccuucuccaaggauaacggcauccgcguggggagccggggccacaucuucgugauccgcgagcccuucgucuccugcagcccgguggagugccggaccuucuuccucacccagggggcccugcugaacgauaagcacuccaacggcaccgugaaggaccgcagccccuuccggacgcucauguccgucgaaguggggcagagccccaacguguaccaggcccgcuucgaggcggucgccugguccgccaccgccugccacgacggcaagaaguggaugaccaucggcgugaccgggcccgauagcaaggcgguggccgucgugcacuacggcggggugccgacggacgucgugaacuccugggccggcgacauccugcggacccaggagagcuccugcacgugcauccagggcaacugcuauugggucaugaccgacgggcccgccaaccgccaagcccaguaccggaucuacaaggcgaaccagggcaagaucaucgaccagaccgacgugagcuucuccgggggccacaucgaggagugcagcuguuaccccaacgacgggaagguggagugcgucugccgcgacaacuggaccggcaccaaccggcccgugcuggugaucagcccggaccucuccuaccgcgucggcuaucugugcgccgggcugcccagcgacacgccccggggcgaagacgcccaguucgugggguccugcaccagccccaugggcaaccagggguacggcgugaagggcuucggguuccgccagggcaccgacgucuggguggggcggaccaucucccgcaccagucgguccggcuucgagaucauccgcaucaagaacggguggacgcagaccagcaaggagcaaauccggcgccagguggucguggacaaccucaacugguccggcuacagcggcuccuucacccugccgguggagcugagcgggcgcgagugccucguccccuguuucuggguggagaugauccggggccgccccgaggagcggaccaucuggacguccagcuccagcaucgugaugugcggggucgaccacgagaucgccgacugguccuggcacgacggcgccgugcugcccuucgacaucgacaagauguga

SEQ ID NO: 16273 - RNA, 1413 nt, Artificial Sequence
  derived and/or modified CDS sequence (AUadapt) from InfluenzaA__H5N8(A-mute swan-Croatia-9-2017)-NA
augaaucccaaccaaaagaucgccaccaucggcagcaucucccuggggcucguggucuucaacgugcugcugcacgccgugagcaucauccucaugguccuggcgcugggcaaguccgagaacaacgggaucugcaagggcaccaucgugcgcgaguacaacgagacggugcggaucgagaagaugauccagugguacaacaccagcgucguggaguaugugccgcacuggaacgagggggccuacaucaacaacaccgagcccaucugcgacgucaagggcuucgcccccuucuccaaggacaacggcauccgcaucgggagccggggccacaucuucgugauccgcgaacccuucguguccuguagcccggucgagugccggaccuucuuccucacgcagggggcccugcugaacgacaagcacuccaacggcaccgugaaggaccgcagccccuuccggacccucauguccguggaggucgggcagagccccaacguguaccaggcccgcuuugaggcgguggccugguccgccaccgccugccacgacggcaagaaguggaugacgaucggcgucaccgggcccgacagcaaggcgguggccgugguccacuacggcggggugccgaccgacguggucaacuccugggccggcgacauccugcggacccaggagagcuccugcacgugcauccagggcaacugcuauugggugaugaccgacgggcccgccaaccgccaagcccaguaccggaucuacaaggcgaaccagggcaagaucaucgaccagaccgacgucagcuucuccgggggccacaucgaggagugcagcugcuaccccaacgaugggaagguggagugccugugccgcgacaacuggaccggcacgaaccggcccgugcucgucaucagcccggaccuguccuaccgcgugggcuaccugugcgccgggcuccccagcgacacgccccggggcgaggacgcccaguucgugggguccuguaccagccccaugggcaaccagggguacggcgucaagggcuucggguuccgccagggcaccgacguguggguggggcggaccaucucccgcaccagccgguccggcuucgaaaucauccgcaucaagaacggguggacccagaccagcaaggagcagauccggcgccaggucgugguggacaaccugaacugguccggcuacagcggcuccuuuacgcugccggucgagcucagcgggcgcgagugccuggugcccugcuucuggguggagaugauccggggccgccccgaggagcggaccaucuggaccuccagcuccagcaucgucaugugcgggguggaccacgagaucgccgacugguccuggcacgacggcgccauccugcccuucgacaucgacaagauguga

SEQ ID NO: 16274 - RNA, 1410 nt, Artificial Sequence
  derived and/or modified CDS sequence (AUadapt) from InfluenzaA__EPI239900__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggucgugcuucaccgucaugaccgacggcccguccaacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugucguucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 16275 - RNA, 1410 nt, Artificial Sequence
  derived and/or modified CDS sequence (AUadapt) from InfluenzaA__EPI221062__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcgugcgcaucggcuccaagggggacguguucgucauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgucggccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccaacggccaggccagcuacaagaucuuccgcaucgagaaggggaagaucgugaaguccguggagaugaacgcccccaacuaccacuacgaggagugcucgugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccucgaacggggccaacggcgucaagggguucuccuacaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacucgggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 16276 - RNA, 1410 nt, Artificial Sequence; identical to SEQ ID NO: 16274
  derived and/or modified CDS sequence (AUadapt) from InfluenzaA__EPI534079__NA

SEQ ID NO: 16277 - RNA, 1410 nt, Artificial Sequence; identical to SEQ ID NO: 16274
  derived and/or modified CDS sequence (AUadapt) from InfluenzaA__AGM53851__NA

SEQ ID NO: 16278 - RNA, 1410 nt, Artificial Sequence
  derived and/or modified CDS sequence (AUadapt) from InfluenzaA__EPI731464__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggggcucgucccucugcccggucagcggcugggccaucuacuccaaggacaacagcgugcgcaucggguccaagggcgacguguucgucauccgggagcccuucaucagcugcagcccccuggagugccgcaccuucuuccugacccagggggcccuccugaacgacaagcacuccaacggcaccaucaaggaccggucccccuaccgcacgcugaugucgugcccgaucggggaggugcccucccccuacaacagccgguucgagagcguggccugguccgcgagcgccugccacgacggcaucaacuggcucaccaucggcaucuccgggcccgacaacggcgccgucgccgugcugaaguacaacgggaucaucaccgacaccaucaagagcuggcgcaacaacauccugcggacgcaggaguccgagugcgcgugcgugaacggcucgugcuucaccgucaugaccgacggcccguccaacgggcaggccagcuacaagaucuuccgcaucgagaagggcaagaucgugaaguccguggagaugaacgcccccaacuaccacuacgaggagugcagcugcuaccccgacuccagcgagaucacgugcgucugccgggacaacuggcacggguccaaccgccccugggugucguucaaccagaaccucgaguaccagaucggcuacaucugcuccgggaucuucggcgacaacccgcggcccaacgacaagaccggcagcugcgggcccguguccagcaacggcgccaacggggucaagggcuucuccuucaaguacgggaacggcguguggaucggccgcaccaagagcaucagcucccggaacggguucgagaugaucugggaccccaacggcuggaccgggaccgacaacaacuucucgaucaagcaggacaucgugggcaucaacgagugguccggguacagcggcuccuucguccagcacccggagcugacgggccuggacugcauccgccccugcuucuggguggagcucauccgggggcgccccaaggagaacaccaucuggaccagcggcuccagcaucuccuucugcggggucaacagcgacaccgugggcugguccuggcccgacggcgccgagcugccguucacgaucgacaaguga

SEQ ID NO: 16279 - RNA, 1410 nt, Artificial Sequence; identical to SEQ ID NO: 16274
  derived and/or modified CDS sequence (AUadapt) from InfluenzaA__EPI696973__NA

SEQ ID NO: 16280 - RNA, 1410 nt, Artificial Sequence
  derived and/or modified CDS sequence (AUadapt) from InfluenzaA__EPI662593__NA
augaaccccaaccagaagaucaucaccaucggcucgaucugcaugaccaucgggauggccaaccugauccuccagaucggcaacaucaucuccaucugggugagccacuccauccagaucgggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccucgcugugcccggucuccggcugggccaucuacagcaaggacaacuccgugcgcaucggcagcaagggggacguguucgucauccgggagcccuucaucuccugcagcccccucgagugccgcaccuucuuccugacccagggcgcccugcucaacgacaagcacuccaacgggaccaucaaggaccggagccccuaccgcacgcugauguccugcccgaucggcgaggugcccagccccuacaacucgcgguucgaguccguggccuggagcgcguccgccugccacgacgggaucaacuggcugaccaucggcaucagcggccccgacuccggggccgucgccgugcucaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucaucaaguccgucgagaugaaggcccccaacuaccacuacgaggagugcucgugcuaccccgacuccagcgagaucacgugcgugugccgggacaacuggcacggcuccaaccgccccugggugagcuucaaccagaaccuggaguaccagaugggguacaucugcuccggcgucuucggggacaacccgcggcccaacgacaagaccggcagcugcggccccguguccagcaacggggccaacggcgugaagggguucagcuucaaguacggcaacggggucuggaucggccgcaccaaguccaucucgucccggaagggcuucgagaugaucugggaccccaacggguggaccggcaccgacaacaaguucagcaucaagcaggacaucguggggaucaacgagugguccggcuacagcggguccuucgugcagcacccggagcucacgggccuggacugcauccgccccugcuucugggucgagcugauccggggccgccccgaggagaacaccaucuggaccagcggguccagcaucuccuucugcggcgugaacagcgacaccgucgggugguccuggcccgacggcgccgagcucccguucacgaucgacaaguga

SEQ ID NO: 16281 - RNA, 1410 nt, Artificial Sequence; identical to SEQ ID NO: 16280
  derived and/or modified CDS sequence (AUadapt) from InfluenzaA__EPI830229__NA

SEQ ID NO: 16282 - RNA, 1410 nt, Artificial Sequence
  derived and/or modified CDS sequence (AUadapt) from InfluenzaA__AGU92879__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcgugcgcgugggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggucgugcuucaccgugaugaccgacggcccguccaacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugucguucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccgagaccgacaacaacuucucgaucaagcaggacaucgucggcaucaacgagugguccggguacagcggcuccuucauccagcacccggagcugacggggcuggacugcauccgccccugcuucuggguggagcucauccggggccgccccaaggagaacaccaucuggaccagcggcuccagcaucuccuucugcggggucaacagcgacaccgugggcugguccuggcccgacggggccgagcugccguucacgaucgacaaguga

SEQ ID NO: 16283 - RNA, 1410 nt, Artificial Sequence
  derived and/or modified CDS sequence (AUadapt) from InfluenzaA__AGU92857__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaaguucgccgggaacagcucccugugcccggucucgggcugggccaucuacuccaaggacaacagcgugcgcgugggcuccaagggggacgucuucgugauccgggagcccuucaucagcugcagcccccucgagugccgcaccuucuuccugacccagggcgcccugcucaacgacaagcacuccaacgggaccaucaaggaccggucccccuaccgcacgcugaugagcugcccgaucggcgaggugcccucccccuacaacagccgguucgagucggucgccugguccgcgagcgccugccacgacgggaucaacuggcugaccaucggcaucuccggccccgacaacggggccguggccgugcucaaguacaacggcaucaucaccgacaccaucaagagcuggcgcaacaacauccugcggacgcaggaguccgagugcgcgugcgucaacgggagcugcuucaccgugaugaccgacggcccguccaacggccaggccagcuacaagaucuuccgcaucgagaaggggaagaucgugaaguccgucgagaugaacgcccccaacuaccacuacgaggagugcucgugcuaccccgacuccagcgagaucacgugcgugugccgggacaacuggcacggcuccaaccgccccugggugagcuucaaccagaaccuggaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucucgucccggaacggcuucgagaugaucugggaccccaacggguggaccggcaccgacaacaacuucagcaucaagcaggacaucgucgggaucaacgagugguccggcuacagcggguccuucauccagcacccggagcucacgggccuggacugcauccgccccugcuucuggguggagcugauccggggccgccccaaggagaacaccaucuggaccagcggguccagcaucuccuucugcggcgucaacagcgacaccguggggugguccuggcccgacggcgccgagcucccguucacgaucgacaaguga

SEQ ID NO: 16284 - RNA, 1410 nt, Artificial Sequence
  derived and/or modified CDS sequence (AUadapt) from InfluenzaA__AGU92846__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcgugcgcgugggcuccaagggggacgucuucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgccugguccgcgucggccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggagcugcuucaccgugaugaccgacggcccguccaacggccaggccagcuacaagaucuuccgcaucgagaaggggaagaucgugaaguccgucgagaugaacgcccccaacuaccacuacgaggagugcucgugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccucgaacggggccaacggcgugaagggguucgccuucaaguacggcaacgggguguggaucggccgcaccaaguccaucagcagccggaacggcuucgagaugaucugggaccccaacggguggaccggcaccgacaacaacuucuccaucaagcaggacaucgucgggaucaacgaguggagcggcuacuccgggucguucauccagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgcggagcugccguucacgaucgacaaguga

SEQ ID NO: 16285 - RNA, 1410 nt, Artificial Sequence
  derived and/or modified CDS sequence (AUadapt) from InfluenzaA__AGU92835__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcgugcgcgugggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggucgugcuucaccgugaugaccgacggcccguccaacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugucguucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucucgaucaagcaggacaucgucgggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccguggggugguccuggcccgacggcgccgagcugccguucacgaucgacaaguga

SEQ ID NO: 16286 - RNA, 1410 nt, Artificial Sequence
  derived and/or modified CDS sequence (AUadapt) from InfluenzaA__AGU92703__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcgugcgcgugggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggucgugcuucaccgugaugaccgacggcccguccaacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugucguucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucucgaucaagcaggacaucgucgggaucaacgagugguccggcuacagcggguccuucauccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 16287 - RNA, 1410 nt, Artificial Sequence
  derived and/or modified CDS sequence (AUadapt) from InfluenzaA__EPI643117__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccucguccugccacgacggcaaggccuggcugcacgugugcaucaccggggacgacaagaacgcgaccgccagcuucaucuacaacggccggcucguggacuccguggucucgugguccaaggacauccugcgcacccaggagagcgagugcaucugcaucaacgggacgugcaccguggugaugaccgacggcuccgccucgggcaaggccgacaccaagauccuguucaucgaggaggggaagaucguccacacgagcacccucuccggcucggcgcagcacguggaggagugcuccugcuacccccgguacccgggggugcgcugcgucugccgggacaacuggaagggcucgaaccgccccaucguggacaucaacaucaaggaccacuccaucgugagcuccuacgucugcucgggccuggugggggacaccccgcggaagaacgacuccagcuccucgucccacugccuggaccccaacaacgaggagggcgggcacggcgugaaggggugggccuucgacgacggcaacgacgucuggaugggccgcaccaucaacgagacgucgcggcucggguacgagaccuucaaggugaucgagggcugguccaaccccaagagcaagcugcagaccaaccgccaggucaucguggaccgcggggaccgguccggcuacucggggaucuucuccguggagggcaagagcugcaucaaccggugcuucuacgucgagcugauccgcggccggaaggaggagaccgaggugcucuggacgucgaacuccaucguggucuucugcgggaccagcggcaccuacgggaccggcuccuggcccgacggggccgaccugaaccugaugcccaucuga

SEQ ID NO: 16288 - RNA, 1410 nt, Artificial Sequence
  derived and/or modified CDS sequence (AUadapt) from InfluenzaA__EPI675797__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaagguccgcgaccggacccccuaccgcacccugcugaugaacgagcucggcgugcccuuccaccuggggaccaagcaggucugcaucgccuggucguccucguccugccacgacggcaaggccuggcugcacgugugcaucacgggggacgacaagaacgcgaccgccagcuucaucuacaacggccggcucguggacuccguggucucgugguccaaggacauccugcgcacccaggagagcgagugcaucugcaucaacgggaccugcacgguggugaugaccgacggcuccgccucgggcaaggccgacaccaagauccuguucaucgaggaggggaagaucguccacaccagcacgcucuccggcucggcgcagcacguggaggagugcuccugcuacccccgguacccgggggugcgcugcgucugccgggacaacuggaagggcucgaaccgccccaucguggacaucaacaucaaggaccacuccaucgugagcuccuacgucugcucgggccuggugggggacaccccgcggaagaacgacuccagcuccucgucccacugccuggaccccaacaacgaggagggcgggcacggcgugaaggggugggccuucgacgacggcaacgacgucuggaugggccgcaccaucaacgagaccucgcggcucggguacgagacguucaaggugaucgagggcugguccaaccccaagagcaagcugcagaccaaccgccaggucaucguggaccgcggggaccgguccggcuacucggggaucuucuccguggagggcaagagcugcaucaaccggugcuucuacgucgagcugauccgcggccggaaggaggagaccgaggugcucuggaccucgaacuccaucguggucuucugcgggacgagcggcaccuacgggaccggcuccuggcccgacggggccgaccugaaccugaugcccaucuga

SEQ ID NO: 16289 - RNA, 1410 nt, Artificial Sequence; identical to SEQ ID NO: 16287
  derived and/or modified CDS sequence (AUadapt) from InfluenzaA__EPI578429__NA

SEQ ID NO: 16290 - RNA, 1410 nt, Artificial Sequence; identical to SEQ ID NO: 16287
  derived and/or modified CDS sequence (AUadapt) from InfluenzaA__EPI614405__NA

SEQ ID NO: 16291 - RNA, 1350 nt, Artificial Sequence
  derived and/or modified CDS sequence (AUadapt) from InfluenzaA__AAT73329__NA
augaaucccaaccagaagaucaucaccaucggcucgaucugcauggugaccgggaucgucucccugaugcuccagaucggcaacaugaucagcaucugggugucccacagcauccacacggggaaucagcaccaguccgagccgaucagcaacaccaacuuccugaccgagaaggccguggccuccgucaagcuggcgggcaacagcucccucugccccaucaaugggugggccguguacagcaaggacaacuccauccgcaucggcagcaagggcgacguguucgucauccgggagcccuucaucuccuguucgcaccuggagugccgcaccuucuuccugacgcagggggcccuccugaacgacaagcacuccaauggcaccgugaaggaccggagcccccaccgcacccugauguccugcccggugggggaggcccccagccccuacaacucccgguucgagagcgucgccuggagugcguccgccugccacgacggcaccagcuggcucacgaucgggaucuccggccccgacaacggcgccguggccgugcugaaguacaacgggaucaucaccgauaccaucaagagcuggcgcaacaacauccugcggacccaggaguccgagugcgcgugcgucaacggcucgugcuuuacggugaugaccgacgggccguccaacggccaggccagccacaagaucuucaagauggagaagggcaagguggucaaguccguggagcucgacgcccccaacuaccauuacgaggagugcagcugcuaccccaacgccggggagaucacgugcgugugccgcgauaacuggcacggcuccaaccggcccugggucagcuucaaccagaaccuggaguaccagaucggguacaucuguuccggcguguucggggacaacccgcgccccaacgacggcaccggcagcugcgggcccguguccagcaauggcgccuacggggucaagggcuucuccuucaaguacgggaacggcguguggaucggccggaccaagagcaccaacucccgcucgggguuugagaugaucugggaccccaacggcuggaccgagaccgacagcuccuucagcgugaagcaggacaucgucgcgaucacggacugguccggguauagcggcuccuucgugcagcacccggagcugaccgggcucgacugcauccggcccugcuucugggucgagcugauccgcggccggcccaaggagagcaccaucuggaccuccggcaguuccaucagcuucugcggggugaacuccgacacggugggcuggagcuggcccgacggggccgagcugccguucaccaucgacaaguga

SEQ ID NO: 16292 - RNA, 1350 nt, Artificial Sequence; identical to SEQ ID NO: 16291
  derived and/or modified CDS sequence (AUadapt) from InfluenzaA__AAW80723__NA

SEQ ID NO: 16293 - RNA, 1350 nt, Artificial Sequence; identical to SEQ ID NO: 16291
  derived and/or modified CDS sequence (AUadapt) from InfluenzaA__EF541467__NA

SEQ ID NO: 16294 - RNA, 1398 nt, Artificial Sequence
  derived and/or modified CDS sequence (AUadapt) from InfluenzaA__EPI439509__NA
augaaucccaaccagaagauccugugcaccucggccaccgccaucaucaucggcgcgaucgccgugcucaucgggaucgccaaccugggccugaacaucgggcuccaccugaagccgggcugcaacugcucccacucgcagcccgagacgaccaacaccucccagaccaucaucaacaacuauuacaacgagacgaacaucaccaacauccagauggaggagcgcaccucgcggaacuucaacaaccugaccaaggggcucugcacgaucaacuccuggcacaucuacggcaaggacaacgccguccgcaucggcgagaguuccgacgugcuggugacccgggagcccuacgucucgugcgaccccgacgagugccgcuucuacgcccugucccaggggaccaccauccggggcaagcacucgaacgggacgauccacgaccgcucccaguaccgggcgcucaucaguuggccgcuguccucgccgcccaccguguacaacucccgcguggagugcaucggcuggucguccaccucgugccacgacgggaagucccggaugucgaucugcaucucgggccccaacaacaacgccuccgccgucgugugguauaaccgccggcccguggccgagaucaacaccugggcgcgcaacauccugcggacgcaggagucggagugcgucugccacaacggcgugugccccguggucuucaccgacggguccgccaccggccccgccgacacccgcaucuacuacuucaaggaggggaagauccucaagugggagagucugacgggcaccgccaagcacaucgaggagugcuccugcuacggcgagcggaccgggaucacgugcacgugccgcgacaacuggcagggcucgaaccggcccgugauccagaucgacccgguggccaugacccacaccucccaguacaucugcucgcccguccugaccgauaacccccgccccaacgacccgaacaucgggaagugcaacgaccccuaccccggcaacaacaacaacggggugaagggcuucuccuaccucgacggcgcgaauaccuggcuggggcggaccaucucgaccgccucccgcucgggcuacgagaugcugaaggugcccaacgcccucaccgacgaccgguccaagccgauccaggggcagacgaucguccugaacgccgacuggucgggcuacuccgggucguucauggacuacugggccgagggcgacuguuaccgcgcgugcuucuacguggagcugauccgcggccggcccaaggaggacaaggugugguggaccuccaacucgaucgucuccaugugcucgucgaccgaguuccucgggcaguggaacuggcccgacggcgccaagaucgaguacuuccuguga

SEQ ID NO: 16295 - RNA, 1410 nt, Artificial Sequence
  derived and/or modified CDS sequence (AUadapt) from InfluenzaA__EPI482776__NA
augaacaccaaccagcgcaucaucaccaucggcacggugugcaugaucgucgggaucaucucgcugcuccugcagaucggcaacaucgugucccuguggaucagccacuccauccagaccgggugggagaaccacaccgugaugugcaaccagagcgucaucaccuacgugaacaacacgugggugaaccggaccuacgucaacaucuccaacaucaagaucgccaccauccaggacgugaccagcaucauccucgccggcaacuccagccugugccccguguccgggugggcggucuacagcaaggacaacuccauccgcaucggcagcaagggcgacaucuucgugauccgggagccguucaucuccugcagccagcuggagugccgcacguucuuccucacccagggggcccugcugaacgacaagcacuccaacggcaccgugaaggaccggagccccuaccgcacccucauguccugccccaucggggaggcccccagcccguacaacucccgguucgagagcgucgccuggagcgccuccgcgugccacgacggcaugggguggcugacgaucggcaucagcggccccgacaacggggccguggccgugcugaaguacaacggcaucaucaccgacaccaucaaguccuggcgcaacaagauccuccggacccaggagagcgagugcgucugcaugaacggguccugcuucacggugcugaccgacggccccagcaacggccaggccuccuacaagaucuucaagguggagaaggggaagaucaucaagagcaucgagcuggacgcgcccaacuaccacuacgaggagugcuccugcuacccggacaccggcaaggucaugugcgugugccgcgacaacuggcacgccagcaaccggcccuggguguccuucaaccagaaccucgacuaccagaucggguacaucugcagcggcgucuucggggacaacccccgcuccaacgacggcaagggcaacugcgggcccgugcugagcaacggcgccaacggggugaagggcuucuccuaccgguacgggaacggcgucuggaucggccgcaccaagagcaucaacucccggagcggguucgagaugaucugggacccgaacggcuggacggagaccgacuccagcuucagcaugaagcaggacaucaucgcccugaacgacugguccggguacagcggcuccuucgugcagcaccccgagcucaccgggaugaacugcauccgccccugcuucugggucgagcugauccggggccagcccaaggagagcaccaucugggccuccggcagcuccaucagcuucugcggggugaacuccgagacggcgagcugguccuggccggacggcgccgaccugcccuucaccaucgacaaguga

SEQ ID NO: 16296 - RNA, 1410 nt, Artificial Sequence
  derived and/or modified CDS sequence (AUadapt) from InfluenzaA__EPI745533__NA
augaaccccaaccagaagaucaucaccaucggcucggugugcaucaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucuccuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcucgggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggucgggcuacuccgggagcuucgugcagcacccggagcugacgggccuggacugcaucaagcccugcuucugggucgagcucauccgcggccggcccaaggagaacaccaucuggaccuccgggagcuccaucagcuucugcggcgugaacuccgacaccgucggguggagcuggcccgacggcgccgagcugccguucacgaucgacaaguga

SEQ ID NO: 16297 - RNA, 1410 nt, Artificial Sequence; identical to SEQ ID NO: 16274
  derived and/or modified CDS sequence (AUadapt) from InfluenzaA__AEE69012__NA

SEQ ID NO: 16298 - RNA, 1410 nt, Artificial Sequence; identical to SEQ ID NO: 16274
  derived and/or modified CDS sequence (AUadapt) from InfluenzaA__EPI176609__NA

SEQ ID NO: 16299 - RNA, 1410 nt, Artificial Sequence; identical to SEQ ID NO: 16274
  derived and/or modified CDS sequence (AUadapt) from InfluenzaA__EPI176472__NA

SEQ ID NO: 16300 - RNA, 1410 nt, Artificial Sequence
  derived and/or modified CDS sequence (AUadapt) from InfluenzaA__EPI280340__NA
augaaccccaaccagaagaucaucaccaucggcucggugugcaucaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucuccuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcucgggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaacggcuucgagaucaucugggaccccaacggguggaccggcaccgacaacaacuucuccaucaagcaggacaucguggggaucaacgaguggucgggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 16301 - RNA, 1410 nt, Artificial Sequence; identical to SEQ ID NO: 16274
  derived and/or modified CDS sequence (AUadapt) from InfluenzaA__EPI240318__NA

SEQ ID NO: 16302 - RNA, 1410 nt, Artificial Sequence; identical to SEQ ID NO: 16274
  derived and/or modified CDS sequence (AUadapt) from InfluenzaA__EPI183133__NA

SEQ ID NO: 16303 - RNA, 1410 nt, Artificial Sequence; identical to SEQ ID NO: 16274
  derived and/or modified CDS sequence (AUadapt) from InfluenzaA__EPI369141__NA

SEQ ID NO: 16304 - RNA, 1410 nt, Artificial Sequence
  derived and/or modified CDS sequence (AUadapt) from InfluenzaA__EPI482787__NA
augaacaccaaccagcgcaucaucaccaucggcacggugugccugaucgucgggaucgugucgcuccugcugcagaucggcaacaucgugucccucuggaucagccacuccauccagaccgggaagcggagccaccccgagaccugcucccagaacgucaucaccuacgagaacaacacgugggugaaccagaccuacgugaacaucagcaacaccaacaucgucgacggccagggggugaccuccaucauccuggccggcaacagcccgcugugccccaucuccggcugggccaucuacucgaaggacaacuccauccgcaucgggagcaagggcgacaucuucgugauccgggagcccuucaucuccugcagccaccucgagugccgcacguucuuccugacccagggggcgcugcucaacgaccggcacuccaacggcaccgucaaggaccgcagccccuaccggacccugauguccugcccgaucggggaggcccccagccccuacaacucccgcuucgagagcguggccuggucggccuccgccugccacgacggcaugggcuggcugacgaucgggaucagcggccccgacaacggggcgguggccguccucaaguacaacggcaucaucaccgacaccaucaaguccuggcggaacaagauccugcgcacccaggagagcgagugcgugugcaucaacggcuccugcuucacgaucaugaccgacgggccgagcaacggccaggccuccuacaagaucuucaagauggagaaggggaagaucaucaagagcguggagcuggacgcccccaacuaccacuacgaggagugcuccugcuaccccgacaccggcaaggucgugugcgugugccgggacaacuggcacgcgucgaaccgccccugggucaccuucgaccagaaccucaacuaccagaucggguacaucugcuccggcguguucggcgacaacccgcggagcaacgacgggaagggcaacugcgggcccgugcccuccaacggcgccaacggggucaagggcuucagcuuccgcuacggcaacgggguguggaucggccggacgaaguccaucagcucccgcagcggguucgagaugaucugggaccccaacggcuggaccgagaccgacuccagcuucucgaucaagcaggacaucaucgcccugaccgacugguccggguacagcggcuccuucgugcagcacccggagcugacgggcaugaacugcaucaagcccugcuucugggucgagcucauccgggggcagcccaaggagagcaccaucuggaccuccggcagcuccaucagcuucugcgggguggacuccgagaccgucagcugguccuggcccgacggcgccgaccugccguucacgaucgacaaguga

SEQ ID NO: 16305 - RNA, 1410 nt, Artificial Sequence
  derived and/or modified CDS sequence (AUadapt) from InfluenzaA__EPI482790__NA
augaacaccaaccagcgcaucaucaccaucggcacggugugccugaucgucgggaucaucucgcuccugcugcagaucggcaacauggugucccucuggaucagccacuccauccagaccgggggcaagaaccacaccgagaugugcaaccagaacgugaucaccuacgucaacaacacgugggugaaccggaccuacgugaacaucagcaacaccaagaucgucaacgugcaggacguggucuccgugauccugaccgggaacagcucccugugccccaucagcggcugggccaucuacuccaaggacaacucgauccgcaucggcuccaagggggacaucuucgugauccgggagccguucaucagcugcucccaccucgagugccgcacguucuuccugacccagggcgcccugcucaacgacaagcacagcaacgggaccgucaaggaccggucccccuaccgcacccugaugagcugccccgugggcgaggcgcccuccccguacaacagccgguucgaguccguggccuggucggccagcgccugccacgacgggaugggcuggcugacgaucggcaucuccgggcccgacaacggcgccgucgcggugcucaaguacaacgggaucaucaccgacaccaucaagagcuggcgcaacaagauccugcggacccaggaguccgagugcgugugcaugaacggcagcugcuucacgguccugaccgacggccccuccaacgggcaggccagcuacaagaucuucaagauggagaagggcaagaucaucaaguccaucgagcucgacgcccccaacuaccacuacgaggagugcagcugcuacccggacgccgggaaggugaugugcgugugccgcgacaacuggcacgcguccaaccggcccugggucucguucgaccagaaccuggacuaccagaucggcuacaucugcuccgggguguucggcgacaacccccgcagcaacgacggcaaggggaacugcggccccgugcacuccaacggggccaacggcgucaagggguucagcuaccgguacggcaacggcguguggaucgggcgcaccaaguccaucaacagccgguccggcuucgagaugaucugggacccgaacggguggaccggcacggacagcuccuucucgaugaagcaggacaucaucgcccugaccgacuggagcggguacuccggcagcuucguccagcaccccgagcucaccggcaugaacugcauccgccccugcuucuggguggagcugauccgggggcagcccaaggagaacaccaucugggccuccggcagcuccaucagcuucugcggggugaacggcgagacggccuccuggagcuggccggacggcgcggaccugcccuucaccaucgacaaguga

SEQ ID NO: 16306 - RNA, 1410 nt, Artificial Sequence
  derived and/or modified CDS sequence (AUadapt) from InfluenzaA__EPI291797__NA
augaacaccaaccagcgcaucaucaccaucggcacggugugcaugaucgucgggaucaucucgcugcuccugcagaucggcaacaucgugucccuguggaucagccacuccauccagaccgggugggagaaccacaccgagaugugcaaccagagcgugaucaccuacgucaacaacacgugggugaaccggaccuacgugaacaucuccaacaccaacaucgccaccauccaggacgucacgagcaucauccucgccggcaacuccagccugugccccguguccgggugggcgaucuacagcaaggacaacuccauccgcaucggcagcaagggcgacaucuucgugauccgggagccguucaucuccugcagccagcuggagugccgcaccuucuuccucacccagggggcccugcugaacgacaagcacuccaacggcaccgucaaggaccggagccccuaccgcacgcucauguccugccccaucggggaggcccccucgccguacaacucccgguucgagagcguggccuggagcgccuccgcgugccacgacggcaugggguggcugaccaucggcaucagcggccccgacaacggggccguggccguccugaaguacaacggcaucaucaccgacaccaucaaguccuggcgcaacaagauccuccggacgcaggagagcgagugcgugugcaugaacggguccugcuucaccgugcugaccgacggccccagcaacggccaggccuccuacaagaucuucaaggucgagaaggggaagaucaucaagagcaucgagcuggacgcgcccaacuaccacuacgaggagugcuccugcuacccggacaccggcaaggugaugugcgugugccgcgacaacuggcacgccagcaaccggcccugggucuccuucaaccagaaccucgacuaccagaucggguacaucugcagcggcguguucggggacaacccccgcuccaacgacggcaagggcaacugcgggcccgugcugucgaacggcgccaacggggucaagggcuucuccuaccgguacgggaacggcguguggaucggccgcaccaagagcaucaacucccggagcggguucgagaugaucugggacccgaacggcuggacggagaccgacuccagcuucagcaugaagcaggacaucaucgcccugaccgacugguccggguacagcggcuccuucgugcagcaccccgagcucacggggaugaacugcauccgccccugcuucugggucgagcugauccggggccagcccaaggagagcaccaucugggccuccggcagcuccaucagcuucugcggggugaacuccgagaccgcgagcugguccuggccggacggcgccgaccugcccuucaccaucgacaaguga

SEQ ID NO: 16307 - RNA, 1410 nt, Artificial Sequence; identical to SEQ ID NO: 16306
  derived and/or modified CDS sequence (AUadapt) from InfluenzaA__EPI482798__NA

SEQ ID NO: 16308 - RNA, 1410 nt, Artificial Sequence
  derived and/or modified CDS sequence (AUadapt) from InfluenzaA__EPI638969__NA
augaacaccaaccagcgcaucaucaccaucggcacggugugcaugaucgucgggaugaucucgcugcuccugcagaucggcuccaucgugagccuguggaucucccacagcauccagaccgggugggagaaccacaccggcgugugcaaccaguccgucaucaccuacgugaacaacacgugggugaaccggaccuacgucaacaucagcaacaucaagaucgccaccauccaggacgugacccccaucauccucgccgggaacuccagccugugcccggugaacggcugggcggucuacuccaaggacaacagcauccgcaucggcuccaagggggacaucuucgugauccgggagcccuucaucagcugcucccagcuggagugccgcacguucuuccucacccagggcgcccugcugaacgacaagcacagcaacgggaccgugaaggaccggucccccuaccgcacccucaugagcugccccaucggcgaggccccgucccccuacaacucgcgguucgaguccgucgccuggagcgccagcgcgugccacgacgggaugggcuggcugacgaucggcaucuccgggcccgacaacggcgccguggccgugcugaaguacaacgggaucaucaccgacaccaucaagagcuggcgcaacaagauccuccggacccaggaguccgagugcgucugcaugaacggcagcugcuucacggugcugaccgacggccccuccaacgggcaggccagcuacaagaucuucaagguggagaagggcaagaucaucaaguccaucgagcuggacgcgccgaacuaccacuacgaggagugcagcugcuaccccgacaccgggaaggucaugugcgugugccgcgacaacuggcacgccuccaaccggcccugggugagcuucaaccagaaccucgacuaccagaucggcuacaucugcuccggggucuucggcgacaacccccgcagcaccgacggcaaggggaacugcggcccggugcuguccaacggggccaacggcgugaagggguucucguaccgguacggcaacggcgucuggaucgggcgcacgaaguccaucaacagccgguccggcuucgagaugaucugggaccccaacggguggaccgagaccgacagcuccuucagcaugaagcaggacaucaucgcccugaacgacuacagcggcuacuccgggagcuucgugcagcaccccgagcucaccggcaugaacugcauccgccccugcuucugggucgagcugauccggggccagccgaaggaguccacgaucugggccagcggguccagcaucuccuucugcggcgugaacagcgagaccgcguccuggagcuggcccgacggggccgaccugcccuucgccaucgacaaguga

SEQ ID NO: 16309 - RNA, 1410 nt, Artificial Sequence
  derived and/or modified CDS sequence (AUadapt) from InfluenzaA__ABI19012__NA
augaacaccaaccagcgcaucaucaccaucggcacggugugccugaucgucgggaucaucucgcuccugcugcagaucggcaacauggugucccucuggaucagccacuccauccagaccgggggcaagaaccacaccgagaugugcaaccagaacgugaucaccuacgucaacaacacgugggugaaccggaccuacgugaacaucagcaacaccaagaucgucaacgugcaggacguggucuccgugauccugaccgggaacagcucccugugccccaucagcggcugggccaucuacuccaaggacaacucgauccgcaucggcuccaagggggacaucuucgugauccgggagccguucaucagcugcucccaccucgagugccgcacguucuuccugacccagggcgcccugcucaacgacaagcacagcaacgggaccgucaaggaccggucccccuaccgcacccugaugagcugccccaucggcgaggcgcccuccccguacaacagccgguucgaguccguggccuggucggccagcgccugccacgacgggaugggcuggcugacgaucggcaucuccgggcccgacaacggcgccguggcgguccucaaguacaacgggaucaucaccgacaccaucaagagcuggcgcaacaagauccugcggacccaggaguccgagugcgugugcaugaacggcagcugcuucacggugcugaccgacggccccuccaacgggcaggccagcuacaagaucuucaagauggagaagggcaagaucaucaaguccaucgagcucgacgcccccaacuaccacuacgaggagugcagcugcuacccggacgccgggaaggucaugugcgugugccgcgacaacuggcacgcguccaaccggcccugggugucguucgaccagaaccuggacuaccagaucggcuacaucugcuccggggucuucggcgacaacccccgcagcaacgacggcaaggggaacugcggccccgugcacuccaacggggccaacggcgugaagggguucagcuaccgguacggcaacggcgucuggaucgggcgcaccaaguccaucaacagccgguccggcuucgagaugaucugggacccgaacggguggaccggcacggacagcuccuucucgaugaagcaggacaucaucgcccugaccgacuggagcggguacuccggcagcuucgugcgccaccccgagcucaccggcaugaacugcauccggcccugcuucugggucgagcugauccgcgggcagcccaaggagaacaccaucugggccuccggcagcuccaucagcuucugcggggugaacggcgagacggccuccuggagcuggccggacggcgcggaccugcccuucaccaucgacaaguga

SEQ ID NO: 16310 - RNA, 1410 nt, Artificial Sequence
  derived and/or modified CDS sequence (AUadapt) from InfluenzaA__EPI687791__NA
augaaccccaaccagaagaucaucaccaucggcucgaucugcaugaccaucgggauggccaaccugauccuccagaucggcaacaucaucuccaucugggugagccacuccauccagaucgggaaccagagccagaucgagacgugcaaccaguccgucaucaccuacgagaacaacaccugggugaaccagaccuacgugaacaucagcaacacgaacuucgccgcgcgccaguccgucgugagcgugaagcuggccggcaacuccucgcugugcccggucuccgggugggccaucuacagcaaggacaacuccgugcggaucggcagcaagggcgacguguucgucauccgcgagcccuucaucuccugcagcccccucgagugccggaccuucuuccugacccagggggcccugcucaacgacaagcacuccaacggcaccaucaaggaccgcagccccuaccggacgcugauguccugcccgaucggggaggugcccagccccuacaacucgcgcuucgaguccguggccuggagcgcguccgccugccacgacggcaucaacuggcugaccaucgggaucagcggccccgacuccggcgccgucgccgugcucaaguacaacgggaucaucaccgacaccaucaagagcuggcggaacaacauccugcgcacgcaggaguccgagugcgcgugcgugaacggcagcugcuucaccaucaugaccgacgggccguccgacggccaggccagcuacaagaucuuccggaucgagaagggcaagaucaucaaguccgucgagaugaaggcccccaacuaccacuacgaggagugcucgugcuaccccgacuccagcgagaucacgugcgugugccgcgacaacuggcacggguccaaccggcccugggugagcuucaaccagaaccuggaguaccagaugggcuacaucugcuccggggucuucggcgacaacccgcgccccaacgacaagaccgggagcugcggccccguguccagcaacggcgccaacggggugaagggcuucagcuucaaguacgggaacggcgucuggaucgggcggaccaaguccaucucgucccgcaagggcuucgagaugaucugggaccccaacggcuggaccgggaccgacaacaaguucagcaucaagcaggacaucgugggcaucaacgagugguccggguacagcggcuccuucgugcagcacccggagcucacggggcuggacugcauccggcccugcuucugggucgagcugauccgcggccggcccgaggagaacaccaucuggaccagcggcuccagcaucuccuucugcggggugaacagcgacaccgucggcugguccuggcccgacggggccgagcucccguucacgaucgacaaguga

SEQ ID NO: 16311 - RNA, 1410 nt, Artificial Sequence
  derived and/or modified CDS sequence (AUadapt) from InfluenzaA__EPI841266__NA
augaaccccaaccagaagaucaucaccaucggcucgaucugcaugaccaucgggauggccaaccugauccuccagaucggcaacaucaucuccaucugggugagccacuccauccagaucgggaaccagagccagaucgagacgugcaaccaguccgucaucaccuacgagaacaacaccugggugaaccagaccuacgugaacaucagcaacacgaacuucgccgcgcgccaguccgucgugagcgugaagcuggccggcaacuccucgcugugcccggucuccgggugggccaucuacagcaaggacaacuccgugcggaucggcagcaagggcgacguguucgucauccgcgagcccuucaucuccugcagcccccucgagugccggaccuucuuccugacccagggggcccugcucaacgacaagcacuccaacggcaccaucaaggaccgcagccccuaccggacgcugauguccugcccgaucggggaggugcccagccccuacaacucgcgcuucgaguccguggccuggagcgcguccgccugccacgacggcaucaacuggcugaccaucgggaucagcggccccgacuccggcgccgucgccgugcucaaguacaacgggaucaucaccgacaccaucaagagcuggcggaacaacauccugcgcacgcaggaguccgagugcgcgugcgugaacggcagcugcuucaccaucaugaccgacgggccguccgacggccaggccagcuacaagaucuuccggaucgaggagggcaagaucaucaaguccgucgagaugaaggcccccaacuaccacuacgaggagugcucgugcuaccccgacuccagcgagaucacgugcgugugccgcgacaacuggcacggguccaaccggcccugggugagcuucaaccagaaccuggaguaccagaugggcuacaucugcuccggggucuucggcgacaacccgcgccccaacgacaagaccgggagcugcggccccguguccagcaacggcgccaacggggugaagggcuucagcuucaaguacgggaacggcgucuggaucgggcggaccaaguccaucucgucccgcaagggcuucgagaugaucugggaccccaacggcuggaccgggaccgacaacaaguucagcaucaagcaggacaucgugggcaucaacgagugguccggguacagcggcuccuucgugcagcacccggagcucacggggcuggacugcauccggcccugcuucugggucgagcugauccgcggccggcccgaggagaacaccaucuggaccagcggcuccagcaucuccuucugcggggugaacagcgacaccgucggcugguccuggcccgacggggccgagcucccguucacgaucgacaaguga

SEQ ID NO: 16312 - RNA, 1410 nt, Artificial Sequence
  derived and/or modified CDS sequence (AUadapt) from InfluenzaA__EPI291844__NA
augaacaccaaccagcgcaucaucaccaucggcacggugugccugaucgucgggaucaucucgcuccugcugcagaucggcaccauggugucccucuggaucagccacuccauccagaccgggggcaagaaccacaccgagaugugcaaccagaacgugaucacguacgucaacaacaccugggugaaccggaccuacgugaacaucagcaacaccaagaucgucaacgugcaggacguggucuccgugauccugacggggaacagcucccugugccccaucagcggcugggccaucuacuccaaggacaacucgauccgcaucggcuccaagggggacaucuucgugauccgggagccguucaucagcugcucccaccucgagugccgcaccuucuuccugacccagggcgcccugcucaacgacaagcacagcaacgggaccgucaaggaccggucccccuaccgcacgcugaugagcugccccaucggcgaggcgcccuccccguacaacagccgguucgaguccguggccuggucggccagcgccugccacgacgggaugggcuggcugaccaucggcaucuccgggcccgacaacggcgccguggcgguccucaaguacaacgggaucaucaccgacaccaucaagagcuggcgcaacaagauccugcggacgcaggaguccgagugcgugugcaugaacggcagcugcuucaccgugcugaccgacggccccuccaacgggcaggccagcuacaagaucuucaagauggagaagggcaagaucaucaaguccaucgagcucgacgcccccaacuaccacuacgaggagugcagcugcuacccggacgccgggaaggucaugugcgugugccgcgacaacuggcacgcguccaaccggcccugggugucguucgaccagaaccuggacuaccagaucggcuacaucugcuccggggucuucggcgacaacccccgcagcaacgacggcaaggggaacugcggccccgugcacuccaacggggccaacggcgugaagggguucagcuacaaguacggcaacggcgucuggaucgggcggaccaaguccaucaacagccgcuccggcuucgagaugaucugggacccgaacggguggacgggcaccgacagcuccuucucgaugaagcaggacaucaucgcccugaccgacuggagcggguacuccggcagcuucgugcagcaccccgagcucaccggcaugaacugcauccggcccugcuucugggucgagcugauccgcgggcagcccaaggagaacacgaucugggccuccggcagcuccaucagcuucugcggggugaacggcgagaccgccuccuggagcuggccggacggcgcggaccugcccuucaccaucgacaaguga

SEQ ID NO: 16313 - RNA, 1410 nt, Artificial Sequence
  derived and/or modified CDS sequence (AUadapt) from InfluenzaA__EPI558120__NA
augaacaccaaccagcgcaucaucaccaucggcacggugugcaugaucgucgggaucaucucgcugcuccugcagaucggcaacaucgugucccuguggaucagccacuccauccagaccgggugggagaaccacaccgagaugugcaaccagagcgugaucaccuacgucaacaacacguggaugaaccggaccuacgugaacaucuccaacaucaagaucgccaccauccaggacgugaccagcaucguccucgccggcaacuccagccugugccccguguccgggugggcgguguacagcaaggacaacuccauccgcaucggcagcaagggcgacaucuucgucauccgggagccguucaucuccugcagccagcuggagugccgcacguucuuccucacccagggggcccugcugaacgacaagcacuccaacggcaccgugaaggaccggagccccuaccgcacccucauguccugccccaucggggaggcccccagcccguacaacucccgguucgagagcguggccuggagcgccuccgcgugccacgacggcaugggguggcugacgaucggcaucagcggccccgacaacggggccgucgccgugcugaaguacaacggcaucaucaccgacaccaucaaguccuggcgcaacaagauccuccggacccaggagagcgagugcgugugcaucaacggguccugcuucacgguccugaccgacggccccucgaacggccaggccuccuacaagaucuucaagguggagaaggggaagaucaucaagagcaucgagcuggacgcgcccaacuaccacuacgaggagugcuccugcuacccggacaccggcaaggugaugugcaucugccgcgacaacuggcacgccagcaaccggcccugggucuccuucgaccagaaccucgacuaccagaucggguacaucugcagcggcguguucggggacaacccccgcuccaacgacggcaagggcaacugcgggcccgugcugagcaacggcgccaacggggucaagggcuucuccuaccgguacgggaacggcguguggaucggccgcaccaagagcaucaacucccggagcggguucgagaugaucugggacccgaacggcuggacggagaccgacuccagcuucagcaugaagcaggacaucaucgcccugaacgacugguccggguacagcggcuccuucgugcagcaccccgagcucaccgggaugaacugcauccgccccugcuucugggucgagcugauccggggccagcccaaggagagcaccaucugggccuccggcagcuccaucagcuucugcggggugaacuccgagacggcgagcugguccuggccggacggcgccgaccugcccuucaccaucgacaaguga

SEQ ID NO: 16314 - RNA, 1410 nt, Artificial Sequence
  derived and/or modified CDS sequence (AUadapt) from InfluenzaA__EPI564138__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggacauccugcgcacccaggagucggagugcgugugcaucaacgggacgugcaccguggucaugaccgacggcuccgccagcggcaaggccgacaccaagauccuguucaucgaggaggggaagaucgugcacacgucgaagcucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagaccucgcggcucggguacgagacguucaaggucguggagggcugguccaaccccaagagcaagcugcagaucaaccgccaggugaucgucgaccgcggggaccgguccggcuacucggggaucuucuccguggagggcaagagcugcaucaaccggugcuucuacguggagcugauccgcggccggaaggaggagaccgagguccucuggaccucgaacuccaucgugguguucugcgggaccagcggcacguacgggaccggcuccuggcccgacggggccgaccugaaccugaugcccaucuga

SEQ ID NO: 16315 - RNA, 1410 nt, Artificial Sequence
  derived and/or modified CDS sequence (AUadapt) from InfluenzaA__ANM92825__NA
augaaccccaaccagaagaucaucaccaucggcucgaucugcaugaccaucgggauggccaaccugauccuccagaucggcaacaucaucuccaucugggugagccacuccauccagaucgggaaccagagccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccugugcccggucuccggcugggccaucuacagcaaggacaacuccgugcgcaucggcagcaagggggacguguucgucauccgggagcccuucaucuccugcagcccccucgagugccgcaccuucuuccugacccagggcgcccugcucaacgacaagcacuccaacgggaccaucaaggaccggucgcccuaccgcacgcugauguccugcccgaucggcgaggugcccagccccuacaacagccgguucgaguccguggccuggagcgcguccgccugccacgacgggaucaacuggcugaccaucggcaucagcggccccgacuccggggccgucgccgugcucaaguacaacggcaucaucaccgacaccaucaagucguggcgcaacaacauccugcggacgcaggaguccgagugcgcgugcgugaacgggagcugcuucaccaucaugaccgacggcccguccgacggccaggccagcuacaagaucuuccgcaucgagaaggggaagaucaucaaguccgucgagaugaaggcccccaacuaccacuacgaggagugcagcugcuaccccgacuccagcgagaucacgugcgugugccgggacaacuggcacggcuccaaccgccccugggugucguucaaccagaaccuggaguaccagaugggguacaucugcuccggcgucuucggggacaacccgcggcccaacgacaagaccggcaacugcggccccgugagcuccaacggggccaacggcgugaagggguucagcuucaaguacggcaacggggucuggaucggccgcaccaagagcaucuccagccggaagggcuucgagaugaucugggaccccaacggguggaccggcaccgacaacaaguucuccaucaagcaggacaucguggggaucaacgaguggucgggcuacuccgggagcuucgugcagcacccggagcucacgggccuggacugcauccgccccugcuucugggucgagcugauccggggccgccccgaggagaacaccaucuggaccuccgggagcuccaucagcuucugcggcgugaacuccgacaccgucggguggagcuggcccgacggcgccgagcucccguucacgaucgacaaguga

SEQ ID NO: 16316 - RNA, 1410 nt, Artificial Sequence
  derived and/or modified CDS sequence (AUadapt) from InfluenzaA__EPI291694__NA
augaacaccaaccagcgcaucaucaccaucggcacggugugccugaucgucgggaucgugucgcuccugcugcagaucggcaacaucgugucccucuggaucagccacuccauccagaccggggagaagaaccacagcgaggucugcaaccagaacaucaucaccuacgagaacaagaccugggugaaccagacguacgugaacaucuccaacaccaacaucgccgagggccagggggucaccagcaucauccuggccggcaacuccagccugugccccguguccggcugggcgaucuacucgaaggacaacuccauccggaucgggagcaagggcgacaucuucgugauccgcgagccguucaucuccugcagccaccucgagugccggaccuucuuccugacgcagggggcccugcucaacgaccgccacuccaacggcaccgucaaggaccggagccccuaccgcacccugauguccugccugaccggggaggcccccagccccuacaacucccgguucgagagcguggccuggucggccuccgcgugccacgacggcaugggcuggcucacgaucgggaucagcggcccggacaacggggccguggccguccugaaguacaacggcaucaucaccgacaccaucaaguccuggcgcaacaagauccugcggacccaggagagcgagugcgugugcaucaacggcuccugcuucacgaucaugaccgacgggcccagcaacggccaggccuccuacaagaucuucaagauggagaaggggaagaucaucaagagcguggagcucgacgcgcccaacuaccacuacgaggagugcuccugcuaccccgacaccggcaaggucgugugcgugugccgcgacaacuggcacgccucgaaccggccgugggucuccuucgaccagaaccuggacuaccagaucggguacaucugcagcggcguguucggcgacaacccccgcuccaacgacgggaagggcaacugcgggcccgugcccagcaacggcgccaacggggucaagggcuucuccuuccgguacggcaacgggguguggaucggccgcaccaagagcaucaucucccggagcggguucgagaugaucugggacccgaacggcuggacggagaccgacuccagcuucucgaucaagcaggacaucaucgcccugaccgacugguccggguacagcggcuccuucgugcagcaccccgagcucaccggcaugaacugcauccgccccugcuucugggucgagcugauccgggggcagcccaaggagagcacgaucuggaccuccggcagcuccaucagcuucugcgggguggacuccgagaccgccagcugguccuggccggacggcgcggaccugcccuucaccaucgacaaguga

SEQ ID NO: 16317 - RNA, 1410 nt, Artificial Sequence
  derived and/or modified CDS sequence (AUadapt) from InfluenzaA__EPI241027__NA
augaacaccaaccagcgcaucaucaccaucggcacgaucugccugaucguggggaucaucucgcuccugcugcagaucggcaacaucauccuccuguggaugucccacagcauccagaccggggagaagucccaccccaaggucugcaaccagagcgugaucaccuacgagaacaacaccugggugaaccagacguacgucaacaucuccaacaccaacaucgccgccggccagggggugaccccgaucauccuggcgggcaacagcucccucugccccaucagcggcugggccaucuacuccaaggacaacagcauccggaucggguccaagggcgacaucuucgugaugcgcgagcccuucaucagcugcucccaccuggagugccggaccuucuuccugacgcagggggcccuccugaacgaccgccacucgaacggcaccgucaaggaccggucccccuaccgcacccugaugagcugcccgaucggggaggcccccucccccuacaacagccgguucgaguccguggccuggagcgcgagcgccugccacgacggcaugggcuggcucaccaucgggaucuccggccccgacaacggggccguggccguccugaaguacaacggcaucaucacggacaccaucaagagcuggcgcaacaagauccugcggacccaggaguccgagugcgugugcaucaacggcagcugcuucaccaucaugacggacgggccguccaacggccaggcgucguacaagcuguucaagauggagaaggggaagaucauccgcuccaucgagcucgacgcccccaacuaccacuacgaggagugcagcugcuaccccgacaccggcaagguggucugcgugugccgggacaacuggcacgccuccaaccgccccugggugagcuucgaccagaaccuggacuaccagaucggguacaucugcuccggcgucuucggcgacaacccgcggagcaacgacgggaagggcaacugcgggcccgugcucuccaacggcgccaacggggugaagggcuucagcuuccgcuacggcaacggggucuggaucggccggaccaaguccaucagcucccgcagcggguucgagaugaucugggaccccaacggcuggaccgagacggacuccucguucagcaugaagcaggacaucaucgcccugaccgacugguccggguacagcggcuccuucgugcagcaccccgagcugaccggcaugaacugcauccggccgugcuucuggguggagcucauccgcgggcagcccaaggagagcaccaucuggacguccggcagcuccaucagcuucugcggggucaacuccggcaccgcgagcugguccuggcccgacggcgccgaccugcccuucaccaucgacaaguga

SEQ ID NO: 16318 - RNA, 1410 nt, Artificial Sequence
  derived and/or modified CDS sequence (AUadapt) from InfluenzaA__EPI177405__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 16319 - RNA, 1410 nt, Artificial Sequence; identical to SEQ ID NO: 16318
  derived and/or modified CDS sequence (AUadapt) from InfluenzaA__EPI242475__NA

SEQ ID NO: 16320 - RNA, 1410 nt, Artificial Sequence
  derived and/or modified CDS sequence (AUadapt) from InfluenzaA__EPI590131__NA
augaacgccaaccagcgcaucaucaccaucggcaccgugugccugaucaucgggaucaucucgcuccugcugcagaucggcaacauggucucccucuggaucagccacuccauccagaccgggggcaagaaccacacggagaugugcaaccagaacgugaucaccuacgugaacaacaccugggucaaccggacguacgugaacaucagcaacaccaagaucgugaacguccaggacgugguguccgucauccugaccgggaacagcucccugugcagcaucuccggcugggccaucuacagcaaggacaacuccauccgcaucggcucgaagggggacaucuucgugauccgggagcccuucaucuccugcagccaccucgagugccgcaccuucuuccugacgcagggcgcgcugcucaacgacaagcacuccaacgggaccgugaaggaccggagcccguaccgcacccugauguccugccccaucggcgaggcccccagccccuacaacucccgguucgagagcgucgccuggagcgccuccgccugccacgacgggaucggcuggcugaccaucggcaucagcgggccggacaacggcgcgguggccgugcucaaguacaacgggaucaucacggacaccaucaaguccuggcgcaacaagauccugcggacccaggagucggagugcgucugcaugaacggcuccugcuucgccgugcugaccgacggccccagcaacgggcaggccuccuacaagaucuucaaggugaagcagggcaagaucaucaagagcaucgagcucgacgcgcccaacuaccacuacgaggagugcuccugcuaccccgacgccgggaaggucaugugcgugugccgcgacaacuggcacgccagcaaccggccguggguguccuucgaccaggaccugaacuaccagaucggcuacaucugcagcggggucuucggcgacaacccccgcuccaacgacggcaaggggaacugcggccccgugcacagcaacggggccaacggcgugaagggguucuccuaccgguacggcaacggcgucuggaucgggcgcaccaagagcauccacucccggucgggcuucgagaugaucugggaccccaacggguggacgggcaccgacuccagcuucagcaugaagcaggacaucaucgcccugaccgacugguccggguacagcggcuccuucgugcagcacccggagcucacgggcaugaacugcauccgccccugcuucugggucgagcugauccgggggcagcccaaggagaacaccaucugggcgagcggcuccagcaucuccuucugcggggugaacggcgagaccgccagcugguccuggcccgacggcgccgaccugccguucaccaucgacaaguga

SEQ ID NO: 16321 - RNA, 1410 nt, Artificial Sequence
  derived and/or modified CDS sequence (AUadapt) from InfluenzaA__EPI68596__NA
augaacaccaaccagcgcaucaucaccaucggcacggugugccugaucgucgggaucgugucgcuccugcugcagaucggcaacaucgugucccucuggaucagccacuccauccagaccggggagaagaaccacagcgagaucugcucccagaacgucaucaccuacgagaacaacaccugggugaaccagacguacgugaacaucagcaacaccaacaucgccgacggccagggggucaccuccaucauccuggccggcaacagcucccugugccccaucagcggcugggcgaucuacuccaaggacaacagcauccggaucggguccaagggcgacaucuucgugauccgcgagccguucaucucgugcucccaccucgagugccggaccuucuuccugacgcagggggcccugcucaacgaccgccacagcaacggcaccgugaaggaccggucccccuaccgcacccugaugagcugccccaucggggaggcccccuccccguacaacagccgguucgagagcgucgccugguccgccagcgcgugccacgacggcaugggcuggcugaccaucgggaucuccggccccgacaacggggccguggccgugcucaaguacaacggcaucaucacggacaccaucaagagcuggcgcaacaagauccugcggacccaggaguccgagugcgucugcaucaacggcucgugcuucaccaucaugacggacgggcccuccaacggccaggccagcuacaagaucuucaagauggagaaggggaagaucaucaaguccguggagcuggacgcgcccaacuaccacuacgaggagugcagcugcuacccggacaccggcaagguggucugcgugugccgcgacaacuggcacgccuccaaccggcccugggugagcuucgaccagaaccucgacuaccagaucggguacaucugcuccggcgucuucggcgacaacccccgcagcaacgacgggaagggcaacugcgggcccgugcuguccaacggcgccaacggggugaagggcuucagcuuccgguacggcaacggggucuggaucggccgcaccaaguccaucagcucccggucgggguucgagaugaucugggacccgaacggcuggaccgagacggacagcuccuucagcaucaagcaggacaucaucgcccugaccgacugguccggguacagcggcuccuucgugcagcaccccgagcucaccggcaugaacugcauccgccccugcuucuggguggagcugauccgggggcagcccaaggagagcaccaucuggacguccggcagcuccaucagcuucugcggggucgacuccgagaccgccagcugguccuggccggacggcgcggaccugcccuucaccaucgacaaguga

SEQ ID NO: 16322 - RNA, 1365 nt, Artificial Sequence
  derived and/or modified CDS sequence (AUadapt) from InfluenzaA__EPI115409__NA
augaaucccaaccagaagaucaucaccaucggcucgaucugccugguggucgggcucaucucccugauccugcagaucggcaacaucaucagcaucuggaucucccacagcauccagaccgggucccagaaccacacgggcaucugcaaccagaacaucaucaccuacaagaacagcaccugggugaaggacaccacguccgugauccucaccgggaacucgucccuguguccgauccgcggcugggccaucuacagcaaggacaacuccauccggaucggcagcaagggggacgucuucgugauccgcgagcccuucaucuccugcagccaccuggagugccggaccuucuuccucacccagggcgcccugcugaacgacaagcacuccagcgggacggugaaggaucgcucccccuaccgggcgcucaugucgugccccgucggcgaggccccgucccccuacaacagccgcuucgagagcguggccugguccgccagcgccugccacgacgggaugggcuggcugaccaucggcaucuccgggcccgacaacggcgcgguggccguccugaaguacaacgggaucaucaccgagaccaucaagagcuggcggaagaagauccuccgcacgcaggaguccgagugcgccugcgugaauggcucgugcuucaccaucaugaccgacggccccuccgacgggcuggccagcuacaagaucuucaagaucgagaagggcaaggugaccaaguccaucgagcugaacgcgccgaacagccacuacgaggagugcuccugcuaccccgacacggggaaggucaugugcgugugucgggacaacuggcacggcagcaaccgccccuggguguccuucgaccagaaccucgacuaccagaucggguacaucugcucgggcgucuucggcgacaacccccggccggaggacgggaccggcuccugcgggcccguguacguggauggcgccaacggggucaagggcuucagcuaccgcuacggcaacgggguguggaucggccggaccaagucccacagcucccgccacggguucgagaugaucugggaccccaacggcuggaccgagacggacagcaaguucagcgugcggcaggacgucguggccaugaccgacugguccggguauucgggcuccuucgugcagcaccccgagcugaccggccuggacugcaugcgcccgugcuucugggucgagcucauccgggggcgccccaaggagaagaccaucuggacgagcgccuccagcaucuccuucugcggcgugaacagcgacaccgucgacugguccuggcccgacggggccgagcugcccuucagcaucgacaaguga

SEQ ID NO: 16323 - RNA, 1365 nt, Artificial Sequence; identical to SEQ ID NO: 16322
  derived and/or modified CDS sequence (AUadapt) from InfluenzaA__ABD77678/m1__NA

SEQ ID NO: 16324 - RNA, 1410 nt, Artificial Sequence; identical to SEQ ID NO: 16274
  derived and/or modified CDS sequence (AUadapt) from InfluenzaA__EPI185224__NA

SEQ ID NO: 16325 - RNA, 1410 nt, Artificial Sequence; identical to SEQ ID NO: 16280
  derived and/or modified CDS sequence (AUadapt) from InfluenzaA__EPI697745__NA

SEQ ID NO: 16326 - RNA, 1410 nt, Artificial Sequence; identical to SEQ ID NO: 16280
  derived and/or modified CDS sequence (AUadapt) from InfluenzaA__EPI768524__NA

SEQ ID NO: 16327 - RNA, 1410 nt, Artificial Sequence
  derived and/or modified CDS sequence (AUadapt) from InfluenzaA__EPI726929__NA
augaaccccaaccagaagaucaucaccaucggcucgaucuccaugaccaucgggauggccaaccugauccuccagaucggcaacaucaucagcaucugggugucccacagcauccagaucgggaaccagucccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccugugcccggucagcggcugggccaucuacuccaaggacaacagcgugcgcaucggcuccaagggggacguguucgucauccgggagcccuucaucagcugcagcccccucgagugccgcaccuucuuccugacccagggcgcccugcucaacgacaagcacuccaacgggaccaucaaggaccggucccccuaccgcacgcugaugucgugcccgaucggcgaggugcccagccccuacaacucccgguucgagagcguggccugguccgcgagcgccugccacgacgggaucaacuggcugaccaucggcaucuccggccccgacagcggggccgucgccgugcucaaguacaacggcaucaucaccgacaccaucaaguccuggcgcaacaacauccugcggacgcaggagucggagugcgcgugcgugaacggguccugcuucaccaucaugaccgacggcccgagcgacggccaggccuccuacaagaucuuccgcaucgagaaggggaagaucaucaagagcgucgagaugaaggcccccaacuaccacuacgaggagugcuccugcuaccccgacagcuccgagaucacgugcgugugccgggacaacuggcacggcagcaaccgccccuggguguccuucaaccagaaccuggaguaccagaugggguacaucugcucgggcgucuucggggacaacccgcggcccaacgacaagaccggcuccugcggccccgugagcagcaacggggccaacggcgugaagggguucuccuucaaguacggcaacggggucuggaucggccgcaccaagagcaucuccagccggaagggcuucgagaugaucugggaccccaacggguggaccggcaccgacaacaaguucuccaucaagcaggacaucguggggaucaacgaguggucgggcuacuccgggagcuucgugcagcacccggagcucacgggccuggacugcauccgccccugcuucugggucgagcugauccggggccgccccgaggagaacaccaucuggaccuccgggagcuccaucagcuucugcggcgugaacuccgacaccgucggguggagcuggcccgacggcgccgagcucccguucacgaucgacaaguga

SEQ ID NO: 16328 - RNA, 1410 nt, Artificial Sequence; identical to SEQ ID NO: 16327
  derived and/or modified CDS sequence (AUadapt) from InfluenzaA__EPI813816__NA

SEQ ID NO: 16329 - RNA, 1410 nt, Artificial Sequence
  derived and/or modified CDS sequence (AUadapt) from InfluenzaA__EPI466627__NA
augaaccccaaccagaagaucaucaccaucggcucggugugcaugaccaucgggauggccaaccugauccuccagaucggcaacaucaucuccaucugggucagccacuccauccagcuggggaaccagagccagaucgagacgugcaaccaguccgugaucaccuacgagaacaacaccugggugaaccagaccuacgucaacaucagcaacacgaacuucgccgcgggccaguccguggugagcgucaagcuggccgggaacuccucgcucugcccgguguccggcugggccaucuacagcaaggacaacuccgugcgcaucggcagcaagggggacgucuucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccagccccuacaacucgcgguucgaguccgucgccuggagcgcguccgccugccacgacgggaucaacuggcucaccaucggcaucagcggccccgacuccggggccguggccgugcugaaguacaacggcaucaucaccgacaccaucaagagcuggcgcaacaacauccugcggacgcaggaguccgagugcgcgugcgucaacgggagcugcuucaccaucaugaccgacggcccguccgacggccaggccagcuacaagaucuuccgcaucgagaaggggaagaucgugaaguccguggagaugaacgcccccaacuaccacuacgaggagugcucgugcuaccccgacuccagcgagaucacgugcgucugccgggacaacuggcacggcuccaaccgccccugggugagcuucaaccagaaccucgaguaccagaucggguacaucugcuccggcguguucggggacaacccgcggcccaacgacaagaccggcagcugcggccccgucuccagcaacggggccaacggcgugaagggguucagcuucaaguacggcaacgggguguggaucggccgcaccaaguccaucucgucccggaagggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucugggucgagcucauccggggccgccccgaggagaacaccaucuggaccagcggguccagcaucuccuucugcggcgugaacagcgacaccguggggugguccuggcccgacggcgccgagcugccguucacgaucgacaaguga

SEQ ID NO: 16330 - RNA, 1410 nt, Artificial Sequence
  derived and/or modified CDS sequence (AUadapt) from InfluenzaA__EPI541965__NA
augaaccccaaccagaagaucaucaccaucggcucggugugcaugaccaucgggauggccaaccugauccuccagaucggcaacaucaucuccaucugggucagccacuccauccagcuggggaaccagagccagaucgagacgugcaaccaguccgugaucaccuacgagaacaacaccugggugaaccagaccuacgucaacaucagcaacacgaacuucgccgcgggccagccggugguguccgucaagcuggccgggaacucgucccucugccccgugagcggcugggccaucuacuccaaggacaacagcgugcgcaucggcuccaagggggacgucuucgugauccgggagcccuucaucagcugcagcccccuggagugccgcaccuucuuccuggcccagggcgcccuccugaacgacaagcacucgaacgggaccaucaaggaccgguccccguaccgcacccugaugagcugccccaucggcgaggugcccucccccuacaacagccgguucgagagcgucgcgugguccgccagcgccugccacgacgggaucaacuggcucacgaucggcaucuccggcccggacucgggggccguggcggugcugaaguacaacggcaucaucaccgacaccaucaaguccuggcgcaacaacauccugcggacccaggagagcgagugcgccugcgucaacggguccugcuucacgaucaugaccgacggccccagcgacggccaggccuccuacaagaucuuccgcaucgagaaggggaagaucgugaaguccguggagaugaacgcccccaacuaccacuacgaggagugcuccugcuaccccgacagcuccgagaucacgugcgucugccgggacaacuggcacggcagcaaccgcccguggguguccuucaaccagaaccucgaguaccagaucggguacaucugcucgggcguguucggggacaacccccggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggacccgaacggguggaccggcaccgacaacaacuucuccaucaagcaggacaucgucgggaucaacgaguggucgggcuacuccgggagcuucgugcagcaccccgagcugaccggccuggacugcauccgccccugcuucugggucgagcucauccggggccgccccgaggagaacacgaucuggaccuccgggagcuccaucagcuucugcggcgugaacuccgacaccgugggguggagcuggccggacggcgcggagcugcccuucaccaucgacaaguga

SEQ ID NO: 16331 - RNA, 1410 nt, Artificial Sequence
  derived and/or modified CDS sequence (AUadapt) from InfluenzaA__EPI652004__NA
augaaccccaaccagaagaucaucaccaucggcucggugugcaugaccaucgggauggccaaccugauccuccagaucggcaacaucaucuccaucugggucagccacuccauccagaucgggaaccagagccagaucgagacgugcaaccaguccgugaucaccuacgagaacaacaccugggugaaccagaccuacgucaacaucagcaacacgaacuucgccgcgggccaguccguggugagcgucaagcuggccgggaacuccucgcugugcccgguguccggcugggccaucuacagcaaggacaacuccgugcgcaucggcagcaagggggacgucuucgugauccgggagcccuucaucuccugcagcccccucgagugccgcaccuucuuccuggcccagggcgcccugcucaacgacaagcacuccaacgggaccaucaaggaccggagccccuaccgcacccugauguccugcccgaucggcgaggugcccagccccuacaacucgcgguucgaguccgucgcguggagcgccuccgccugccacgacgggaucaacuggcugacgaucggcaucagcggccccgacuccggggccguggcggugcucaaguacaacggcaucaucaccgacaccaucaagagcuggcgcaacaacauccugcggacccaggaguccgagugcgccugcgucaacgggagcugcuucacgaucaugaccgacggcccguccgacggccaggccagcuacaagaucuuccgcaucgagaaggggaagaucgugaaguccguggagaugaacgcccccaacuaccacuacgaggagugcucgugcuaccccgacuccagcgagaucacgugcgucugccgggacaacuggcacggcuccaaccgccccugggugagcuucaaccagaaccuggaguaccagaucggguacaucugcuccggcguguucggggacaacccgcggcccaacgacaagaccggcagcugcggccccgucuccagcaacggggccaacggcgugaagggguucagcuucaaguacggcaacgggguguggaucggccgcaccaaguccaucucgucccggaagggcuucgagaugaucugggaccccaacggguggaccggcaccgacaacaacuucagcaucaagcaggacaucgucgggaucaacgagugguccggcuacagcggguccuucgugcagcacccggagcucaccggccuggacugcauccgccccugcuucugggucgagcugauccggggccgccccgaggagaacacgaucuggaccagcggguccagcaucuccuucugcggcgugaacagcgacaccguggggugguccuggcccgacggcgcggagcucccguucaccaucgacaaguga

SEQ ID NO: 16332 - RNA, 1410 nt, Artificial Sequence
  derived and/or modified CDS sequence (AUadapt) from InfluenzaA__EPI62526__NA
augaacaccaaccagcgcaucaucaccaucggcacggugugccugaucgucgggaucgugucgcuccugcugcagaucggcaacaucgugucccucuggaucagccacuccauccagaccggggagaagaaccaccccgagaucugcagccagaacgucaucaccuacgagaacaacaccugggugaaccagacguacgugaacaucuccaacaccaacaucgucgacggccagggggugaccagcaucauccuggccggcaacuccagccugugcccgaucuccggcugggccaucuacagcaaggacaacuccauccggaucgggagcaagggcgacaucuucgugauccgcgagcccuucaucuccugcucgcaccucgagugccggaccuucuuccugacgcagggggcgcugcucaacgaccgccacuccaacggcaccgucaaggaccggagccccuaccgcacccugauguccugccccaucggggaggccccgagccccuacaacucccgguucgagagcguggccuggagcgccuccgccugccacgacggcaugggcuggcugaccaucgggaucagcggccccgacaacggggcgguggccguccucaaguacaacggcaucaucacggacaccaucaaguccuggcgcaacaagauccugcggacccaggagagcgagugcgugugcaucaacggcuccugcuucaccaucaugacggacgggcccucgaacggccaggccuccuacaagaucuucaagauggagaaggggaagaucaucaagagcguggagcuggacgccccgaacuaccacuacgaggagugcuccugcuaccccgacaccggcaaggucgugugcgugugccgcgacaacuggcacgcgagcaaccggcccugggucuccuucgaccagaaccucgacuaccagaucggguacaucugcagcggcguguucggcgacaacccccgcuccaacgacgggaagggcaacugcgggccggugcugagcaacggcgccaacggggucaagggcuucuccuuccgguacggcaacgggguguggaucggccgcaccaagagcaucuccagccgguccggguucgagaugaucugggaccccaacggcuggaccgagacggacucgagcuucuccaucaagcaggacaucaucgcccugaccgacuggagcggguacuccggcagcuucgugcagcaccccgagcucaccggcaugaacugcauccgccccugcuucugggucgagcugauccgggggcagccgaaggaguccaccaucuggacgagcggcuccagcaucuccuucugcgggguggacagcgagaccgccuccuggagcuggcccgacggcgccgaccugcccuucaccaucgacaaguga

SEQ ID NO: 16333 - RNA, 1410 nt, Artificial Sequence; identical to SEQ ID NO: 16274
  derived and/or modified CDS sequence (AUadapt) from InfluenzaA__EPI189183__NA

SEQ ID NO: 16334 - RNA, 1410 nt, Artificial Sequence; identical to SEQ ID NO: 16274
  derived and/or modified CDS sequence (AUadapt) from InfluenzaA__EPI180576__NA

SEQ ID NO: 16335 - RNA, 1410 nt, Artificial Sequence
  derived and/or modified CDS sequence (AUadapt) from InfluenzaA__EPI346918__NA
augaacaccaaccagcgcaucaucaccaucggcacggugugcaugaucgucgggaucaucucgcugcuccugcagaucggcaacaucgugucccuguggaucagccacuccauccagaccgggugggagaaccacaccgagaugugcaaccagaacgugaucaccuacgucaacaacacgugggugaaccggaccuacgugaacgucagcaacaccaacaucgccaccauccaggacgugacguccaucgugcucgccggcaacagcucccugugccccgucagcgggugggcgaucuacuccaaggacaacagcauccgcaucggcuccaagggcgacaucuucgugauccgggagccguucaucucgugcucccagcuggagugccgcaccuucuuccucacccagggggcccugcugaacgacaagcacagcaacggcaccgugaaggaccggucccccuaccgcacgcucaugagcugccccaucggggaggcccccuccccguacaacagccgguucgaguccgucgccuggagcgccagcgcgugccacgacggcaugggguggcugaccaucggcaucuccggccccgacaacggggccguggccgugcugaaguacaacggcaucaucaccgacaccaucaagagcuggcgcaacaagauccuccggacgcaggaguccgagugcgucugcaugaacgggucgugcuucaccgugcugaccgacggccccuccaacggccaggccagcuacaagaucuucaagguggagaaggggcgcaucaucaaguccaucgagcuggacgcgcccaacuaccacuacgaggagugcagcugcuacccggacaccggcaaggucaugugcgugugccgggacaacuggcacgccuccaaccgccccugggugagcuucaaccagaaccucgacuaccagaucggguacaucugcuccggcgucuucggggacaacccccggagcaacgacggcaagggcaacugcgggcccgugcuguccaacggcgccaacggggugaagggcuucagcuaccgcuacgggaacggcgucuggaucggccggacgaaguccaucaacagccgccggggguucgagaucaucugggacccgaacggcuggaccgagaccgacuccucguucuccaugaagcaggacaucaucgcccugaccgacuggagcggguacagcggcuccuucgugcagcaccccgagcucacggggaugaacugcauccgccccugcuucugggucgagcugauccggggccagcccaaggagagcaccaucugggccuccggcagcuccaucagcuucugcggggugaacuccgagaccgcgagcugguccuggccggacggcgccgaccugcccuucaccaucgacaaguga

SEQ ID NO: 16336 - RNA, 1410 nt, Artificial Sequence
  derived and/or modified CDS sequence (AUadapt) from InfluenzaA__EPI240976__NA
augaaccccaaccagaagaucaucaccaucggcucggugucccugaccaucgagacggucugcuuccucaugcagaucgccauccuggccaccaccgugacccugcacuucaagcagcacgagugcgacucgccggcguccaaccaggugaugcccugcgagcccaucaucaucgagcgcaacaucacggagaucgucuaccucaacaacaccaccaucgagaaggagaucugccccgaggugguggaguaccggaacuggagcaagccgcagugccagaucaccggguucgcccccuucuccaaggacaacucgauccgccuguccgccggcggggacaucugggucacgcgggagcccuacgugucgugcgaccccggcaagugcuaccaguucgcccuggggcagggcaccacccucgacaacaagcacuccaacggcaccauccacgaccgcaucccgcaccggacgcugcugaugaacgagcucggggugcccuuccaccugggcaccaagcaggucugcguggccuggagcuccucguccugccacgacgggaaggcguggcugcacgugugcgucaccggcgacgaccgcaacgccaccgccucguucaucuacgacgggcggcucguggacuccaucggcagcuggucccagaacauccugcgcacgcaggagucggagugcgugugcaucaacgggaccugcaccgucgugaugaccgacggcuccgccucgggccgggcggacacgcgcauccuguucaucaaggaggggaagaucgugcacaucagcccccucuccggcucggcccagcacaucgaggagugcuccugcuacccccgguacccggacguccgcugcaucugccgggacaacuggaagggcagcaaccgccccgugaucgacaucaacauggaggacuacuccaucgacucguccuacgugugcucggggcuggucggcgacacgccccggaacgacgacuccagcuccaacucgaacugccgcgaccccaacaacgagcgggggaacccgggcgugaaggggugggccuucgacaacggcgacgacguguggaugggccgcaccaucuccaaggacucgcgguccggguacgagaccuucaaggucaucggcggguggagcacccccaacuccaagucgcaggugaaccgccaggucaucguggacaacaacaacugguccggcuacucggggaucuucagcguggagggcaaguccugcaucaaccggugcuucuacgucgagcugauccgcggccgcccccaggagacccgggugugguggaccucgaacuccaucguggucuucugcgggaccagcggcacguacgggaccggcuccuggcccgacggggccaacaucaacuucaugccgaucuga

SEQ ID NO: 16337 - RNA, 1410 nt, Artificial Sequence
  derived and/or modified CDS sequence (AUadapt) from InfluenzaA__EPI3165__NA
augaaccccaaccagaagaucaucaccaucggcucggugucccugaccaucgccacggucugcuuccucaugcagaucgccauccuggugaccaccgugacccugcacuucaagcaguacgagugcgacucgccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacucgauccgccuguccgccggcggggacaucugggugacgcgggagcccuacgugagcugcgaccacggcaagugcuaccaguucgcccuggggcagggcaccacccucgacaacaagcacuccaacgacaccauccacgaccgcaucccccaccggacgcugcugaugaacgagcucggcgucccguuccaccuggggacccgccaggugugcaucgccuggucguccucguccugccacgacggcaaggcguggcugcacgugugcaucaccggggacgacaagaacgccaccgccagcuucaucuacgacggccggcucgucgacuccaucgggucguggucccagaacauccugcgcacgcaggagagcgagugcgugugcaucaacgggaccugcaccguggucaugaccgacggcuccgccucgggccgggcggacacgcgcauccuguucaucgaggagggcaagaucgugcacaucucgccccucuccgggagcgcccagcacguggaggagugcuccugcuacccccgguaccccggcguccgcugcaucugccgggacaacuggaagggcucgaaccgcccggugguggacaucaacauggaggacuacuccaucgacagcuccuacgucugcucggggcuggugggcgacacgccccggaacgacgaccgcuccucgaacuccaacugccggaaccccaacaacgagcgcgggaaccagggcgugaaggggugggccuucgacaacggcgacgacgucuggaugggccggaccaucagcaaggaccugcgcuccggguacgagaccuucaaggugaucggcggguggucgacccccaacuccaagagccagaucaaccggcaggucaucguggacuccgacaaccgcucgggcuacuccgggaucuucucgguggagggcaagagcugcaucaaccgcugcuucuacgucgagcucauccggggccgcaagcaggagacccgggugugguggaccuccaacucgaucguggucuucugcgggaccuccggcacguacgggaccggcagcuggccggacggggccaacaucaacuucaugcccaucuga

SEQ ID NO: 16338 - RNA, 1410 nt, Artificial Sequence
  derived and/or modified CDS sequence (AUadapt) from InfluenzaA__EPI957__NA
augaaccccaaccagaagaucaucaccaucggcucggugucccugaccaucgccacggucugcuuccucaugcagaucgccauccuggugaccaccgugacccugcacuucaagcaguacgagugcgacucgccggcguccaaccaggucaugcccugcgagcccaucaucaucgagcgcaacaucacggagaucguguaccucaacaacaccaccaucgacaaggagaagugccccaagguggucgaguaccggaacuggagcaagccgcagugccagaucaccggguucgcccccuucuccaaggacaacucgauccgccuguccgccggcggggacaucugggugacgcgggagcccuacgugucgugcgaccacggcaagugcuaccaguucgcccuggggcagggcaccacccucgacaacaagcacuccaacgacaccauccacgaccgcaucccccaccggacgcugcugaugaacgagcucggcgucccguuccaccuggggacccgccaggugugcaucgccuggagcuccucguccugccacgacggcaaggcguggcugcacgugugcaucaccggggacgacaagaacgccaccgccucguucaucuacgacggccggcucgucgacuccaucgggagcuggucccagaacauccugcgcacgcaggagucggagugcgugugcaucaacgggaccugcaccguggucaugaccgacggcuccgccucgggccgggcggacacgcgcauccuguucaucgaggagggcaagaucgugcacaucagcccccucuccgggucggcccagcacguggaggagugcuccugcuacccccgguaccccggcguccgcugcaucugccgggacaacuggaagggcagcaaccgcccggugguggacaucaacauggaggacuacuccaucgacucguccuacgucugcucggggcuggugggcgacacgccccggaacgacgaccgcuccagcaacuccaacugccggaaccccaacaacgagcgcgggaaccagggcgugaaggggugggccuucgacaacggcgacgacgucuggaugggccggaccaucucgaaggaccugcgcuccggguacgagaccuucaaggugaucggcggguggucgacccccaacuccaagagccagaucaaccggcaggucaucguggacuccgacaaccgcucgggcuacuccgggaucuucucgguggagggcaagagcugcaucaaccgcugcuucuacgucgagcucauccggggccgcaagcaggagacccgggugugguggaccuccaacucgaucguggucuucugcgggaccuccggcacguacgggaccggcagcuggccggacggggccaacaucaacuucaugcccaucuga

SEQ ID NO: 16339 - RNA, 1410 nt, Artificial Sequence
  derived and/or modified CDS sequence (AUadapt) from InfluenzaA__EPI507593__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggaccucgaacuccaucgucguguucugcgggacgagcggcaccuacgggaccggcuccuggcccgacggggccgaccugaaccugaugcccaucuga

SEQ ID NO: 16340 - RNA, 1410 nt, Artificial Sequence; identical to SEQ ID NO: 16339
  derived and/or modified CDS sequence (AUadapt) from InfluenzaA__EPI461954__NA

SEQ ID NO: 16341 - RNA, 1410 nt, Artificial Sequence; identical to SEQ ID NO: 16339
  derived and/or modified CDS sequence (AUadapt) from InfluenzaA__EPI461954__NA

SEQ ID NO: 16342 - RNA, 1410 nt, Artificial Sequence
  derived and/or modified CDS sequence (AUadapt) from InfluenzaA__EPI668104__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuucuaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggacauccugcgcacccaggagucggagugcgugugcaucaacgggacgugcaccguggucaugaccgacggcaacgccuccggcaaggccgacaccaagauccuguucaucgaggaggggaagaucgugcacacgagcaagcucucgggcuccgcgcagcacguggaggagugcucgugcuacccccgguacccggggguccgcugcgugugccgggacaacuggaagggcuccaaccgccccaucguggacaucaacaucaaggaccacagcaucgucuccucguacgugugcuccggccuggugggggacacgccccggaagaacgacagcuccucguccagccacugccuggaccccaacaacgaggagggcgggcacggcgucaaggggugggccuucgacgacggcaacgacguguggaugggccgcaccaucaacgagaccucccggcucggguacgagaccuucaaggucguggagggcuggucgaacccgaaguccaagcugcagaucaaccgccaggugaucgucgaccgcggggaccggagcggcuacuccgggaucuucucgguggagggcaaguccugcaucaaccggugcuucuacguggagcugauccgcggccggaaggaggagaccgagguccucuggaccagcaacucgaucgugguguucugcgggaccuccggcacguacgggaccggcagcuggcccgacggggccgaccugaaccugaugcccaucuga

SEQ ID NO: 16343 - RNA, 1410 nt, Artificial Sequence
  derived and/or modified CDS sequence (AUadapt) from InfluenzaA__EPI578445__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccucguccugccacgacggcaaggccuggcugcacgugugcaucaccggggacgacaagaacgcgaccgccagcuucaucuacaacggccggcucguggacuccguggucucgugguccaaggacauccugcgcacccaggagagcgagugcgugugcaucaacgggacgugcaccguggucaugaccgacggcaacgccuccggcaaggccgacaccaagauccuguucaucgaggaggggaagaucgugcacacgucgaagcucagcggcuccgcgcagcacguggaggagugcucgugcuacccccgguacccggggguccgcugcgugugccgggacaacuggaagggcuccaaccgccccaucguggacaucaacaucaaggaccacucgaucgucuccagcuacgugugcuccggccuggugggggacacgccccggaagaacgacucguccagcuccucgcacugccuggaccccaacaacgaggagggcgggcacggcgucaaggggugggccuucgacgacggcaacgacguguggaugggccgcaccaucaacgagaccucccggcucggguacgagaccuucaaggucguggagggcuggucgaacccgaaguccaagcugcagaucaaccgccaggugaucgucgaccgcggggaccggagcggcuacuccgggaucuucucgguggagggcaaguccugcaucaaccggugcuucuacguggagcugauccgcggccggaaggaggagaccgagguccucuggaccagcaacucgaucgugguguucugcgggaccuccggcacguacgggaccggcagcuggcccgacggggccgaccugaaccugaugcccaucuga

SEQ ID NO: 16344 - RNA, 1410 nt, Artificial Sequence; identical to SEQ ID NO: 16343
  derived and/or modified CDS sequence (AUadapt) from InfluenzaA__EPI551883__NA

SEQ ID NO: 16345 - RNA, 1410 nt, Artificial Sequence
  derived and/or modified CDS sequence (AUadapt) from InfluenzaA__EPI344388__NA
augaaccccaaccagaagaucaucaccaucggcucggugucccugaucaucgccaccaucugcuuccucaugcagaucgccauccuggucacgaccgugacccugcacuucaagcagcacgacuacaacucgccgcccaacaaccaggcgaugcucugcgagcccaccaucaucgagcgcaacacgaccgagaucguguaccugaccaacaccacgaucgagaaggagaucugccccaagcuggccgaguaccggaacugguccaagccgcagugcaacaucaccggguucgcccccuucagcaaggacaacuccauccgccucucggccggcggggacaucugggucacccgggagcccuacguguccugcgaccccgacaagugcuaccaguucgcccugggccaggggaccacgcugaacaacggccacucgaacaacaccgugcacgaccgcaccccguaccggacccuccugaugaacgagcugggcguccccuuccaccucgggacgcgccaggugugcauggcgugguccagcuccucgugccacgacggcaaggccuggcugcacgugugcaucaccgggaacgacaacaacgccaccgccuccuucaucuacaacggccggcuggucgacagcaucggguccuggucgaagaacauccuccgcacccaggaguccgagugcgugugcaucaacggcacgugcaccguggucaugaccgacggcucggcguccgggaaggccgacaccaagauccuguucguggaggagggcaagaucgugcacaucagcacgcugucgggguccgcccagcacgucgaggagugcagcugcuacccccgguuccccggcgugcgcugcgugugccgggacaacuggaagggcuccaaccgcccgaucgucgacaucaacgugaagaacuacucgaucguguccucguacgucugcuccgggcucgugggcgacacgccccgcaagagcgacuccgugucguccagcuacugccuggaccccaacaacgagaagggcgggcacggggucaagggcugggccuucgacgacggcaacgacguguggauggggcggaccaucaacgagacccugcggcucggcuacgagaccuucaaggucaucgaggggugguccaaggccaacucgaagcugcagaccaaccgccaggugaucguggagaagggcgaccgguccggguacucgggcaucuucuccgucgagggcaagagcugcaucaaccgcugcuucuacguggagcugauccgggggcgcaaggaggagaccaaggugugguggaccuccaacucgaucgucguguucugcggcacgagcgggaccuacggcaccggguccuggcccgacggcgcggacaucaaccucaugccgaucuga

SEQ ID NO: 16346 - RNA, 1410 nt, Artificial Sequence; identical to SEQ ID NO: 16345
  derived and/or modified CDS sequence (AUadapt) from InfluenzaA__EPI347601__NA

SEQ ID NO: 16347 - RNA, 1410 nt, Artificial Sequence
  derived and/or modified CDS sequence (AUadapt) from InfluenzaA__EPI642512__NA
augaaccccaaccagaagaucaucaccaucggcucgaucucccugaucaucgccaccaucugcuuccucaugcagaucgccauccuggugaucacggucacccugcacuucaagcagcacaacugcgacucguccccgaacaaccaggugauguucugcgagcccaccaucaucgagcgcaacaagaccgagaucguguaccucaucaacacgaccgucgagaaggagaucugccccaagcccaccgaguaccggaacuggagcaagccgcagugcaacaucaccggguucgcgcccuucuccaaggacaacucgauccgccuguccgccggcggggacaucugggugacgcgggagcccuacgugagcugcgaccccgacaagugcuaccaguucgcccugggccaggggaccacccucaacaacggccacuccaacgacaccguccacgaccgcacgccguaccggacccugcugaugaacgagcucggcgugcccuuccaccuggggacccgccaggugugcaucgccuggucguccagcuccugccacgacggcaaggccuggcugcacgucugcaucaccggggacgacggcaacgcgacggccucguucaucuacaacgggcggcucguggacuccaucggcagcugguccaagaacauccugcgcacccaggagucggagugcgugugcaucaacgggaccugcaccgucgugaugacggacggcuccgccagcggcaaggccgacaccaagauccuguucaucgaggaggggaagaucauccacaucucgacccucuccggcucggcgcagcacguggaggagugcuccugcuacccccgguaccccggcguccgcugcgugugccgggacaacuggaaggggagcaaccgcccgaucguggacaucaacgucaaggacuacuccaucgugucguccuacgugugcagcggccuggucggggacacgccccggaagaacgacuccuucucguccagccacugccuggaccccaacaacgaggagggcgggcacggcgugaagggcugggccuucgacgacgggaacgacguguggaugggccgcaccaucuccgagaagucccggcucggguacgagaccuucaaggucgugaagggcuggucggagcccaacagcaagcugcagaccaaccgccaggucaucguggggcggggcaaccgcuccggcuacucggggaucuucuccaucgagggcaagaacugcaucaaccggugcuucuacguggagcugauccgcgggcggaaggaggagaccaaggucugguggacgagcaacucgaucgugguguucugcggcaccuccgggaccuacggcaccggcagcuggccggacggggccgacaucaaccucaugcccaucuga

SEQ ID NO: 16348 - RNA, 1410 nt, Artificial Sequence
  derived and/or modified CDS sequence (AUadapt) from InfluenzaA__AIE52540__NA
augaaccccaaccagaagaucaucaccaucggcucggugucccugaucaucgccaccaucugcuuccucaugcagaucgccauccuggucacgaccgugacccugcacuucaagcagcacgacuacaacucgccgcccaacaaccaggugaugcucugcgagcccaccaucaucgagcgcaacacgaccgagaucgucuaccugaccaacaucaccaucgagaaggagaucugccccaagcuggcggaguaccggaacugguccaagccgcagugcaacaucacgggguucgcccccuucagcaaggacaacuccauccgccucucggccggcggggacaucugggugacccgggagcccuacguguccugcgaccccgacaagugcuaccaguucgcccugggccaggggaccacccugaacaaccgccacagcaacaacacgguccacgaccgguccccguaccgcacccuccugaugaacgagcugggcgugcccuuccaccucggcacccgccaggugugcaucgccuggucguccagcuccugccacgacgggaaggcguggcugcacgucugcaucaccggcgacgacaacaacgccacggccucguucaucuacaacgggcggcugguggacuccaucggcagcugguccaagaacauccuccggacccaggagucggagugcgugugcaucaacgggaccugcaccgucgugaugacggacggcuccgccagcggcaaggcggacaccaagauccuguucaucgaggaggggaagaucgugcacaucucgacccuguccggcucggcccagcacgucgaggagugcuccugcuacccccgcuaccccggggugcggugcgugugccgcgacaacuggaagggcagcaaccggccgaucgucgacaucaacaugaaggacuacuccaucgccucguccuacgugugcagcggccucgugggggacacgccccgcaagaacgacuccuucucguccagccacugccuggaccccaacaacgagaagggcgggcacggcgucaaggggugggccuucgacgacggcaacgacguguggaugggccggaccaucuccgaggaguuccgccugggguacgagaccuucaaggugaucaagggcuggucgaaccccaacuccaagcuccagaccaaccggcaggucaucguggagaaggggaaccgcagcggcuacuccggggucuucucgaucgaggacaaguccugcaucaaccggugcuucuacguggagcugauccgcggccggaaggaggagaccaaggugugguggacgagcaacucgaucgucguguucugcggcaccuccgggaccuacggcaccgggagcuggccggacggcgccgacaucaaccugaugcccaucuga

SEQ ID NO: 16349 - RNA, 1410 nt, Artificial Sequence; identical to SEQ ID NO: 16348
  derived and/or modified CDS sequence (AUadapt) from InfluenzaA__EPI465399__NA

SEQ ID NO: 16350 - RNA, 1410 nt, Artificial Sequence; identical to SEQ ID NO: 16348
  derived and/or modified CDS sequence (AUadapt) from InfluenzaA__EPI328899__NA

SEQ ID NO: 16351 - RNA, 1410 nt, Artificial Sequence; identical to SEQ ID NO: 16348
  derived and/or modified CDS sequence (AUadapt) from InfluenzaA__EPI328901__NA

SEQ ID NO: 16352 - RNA, 1410 nt, Artificial Sequence
  derived and/or modified CDS sequence (AUadapt) from InfluenzaA__EPI574645__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccagguggugcugugcgagcccacgaucaucgagcgcaacaucaccgagaucgucuaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggugacccgggagcccuacgugagcugcgacccggacaagugcuaccaguucgcccuggggcagggcaccacgcucaacaacggccacuccaacaacaccguccgcgaccggacccccuaccgcacccugcugaugaacgagcucggggugcccuuccaccugggcacgaagcaggucugcaucgccuggucguccucguccugccacgacgggaaggccuggcugcacgugugcaucaccggcgacgacaagaacgcgaccgccagcuucaucuacaacgggcggcucguggacuccguggucucgugguccaaggacauccugcgcacccaggagagcgagugcgugugcaucaacggcacgugcaccguggucaugaccgacggcuccgccucggggaaggccgacaccaagauccuguucaucgaggagggcaagaucauccacacgagcacccucuccgggucggcgcagcacguggaggagugcuccugcuacccccgguacccgggcgugcgcugcgucugccgggacaacuggaagggcucgaaccgccccaucguggacaucaacaucaaggaccacuccaucgugagcuccuacgucugcucggggcuggugggcgacaccccgcggaagaacgacuccagcuccucgucccacugccuggaccccaacaacgaggagggcgggcacggggugaagggcugggccuucgacgacggcaacgacgucuggauggggcgcaccaucaacgagacgucgcggcucggcuacgagaccuucaaggugaucgaggggugguccaaccccaagagcaagcugcagaucaaccgccaggucaucguggaccggggcgaccgcuccggguacucgggcaucuucuccguggagggcaagagcugcaucaaccggugcuucuacgucgagcugauccgcgggcggaaggaggagaacgaggugcucuggaccucgaacuccaucguggucuucugcggcaccagcgggacguacggcaccggguccuggcccgacggcgccgaccugaaccugaugcccaucuga

SEQ ID NO: 16353 - RNA, 1410 nt, Artificial Sequence
  derived and/or modified CDS sequence (AUadapt) from InfluenzaA__EPI563214__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggucgaagccccagugcuccaucaccggguucgcgcccuucagcaaggacaacuccauccgccugucggccggcggggacaucugggucacccgggagcccuacguguccugcgacccggacaagugcuaccaguucgcccugggccaggggaccacgcucaacaacgugcacagcaacaacaccguccgcgaccggacccccuaccgcacccugcugaugaacgagcucggcgugcccuuccaccugggcacgaagcaggucugcaucgccugguccucguccagcugccacgacgggaaggccuggcugcacgugugcaucaccggcgacgacaagaacgcgaccgccuccuucaucuacaacgggcggcucguggacucgguggucuccuggagcaaggacauccugcgcacccaggaguccgagugcgugugcaucaacggcacgugcaccguggucaugaccgacgggucggccagcggcaaggccgacaccaagauccuguucaucgaggagggcaagaucguguacacguccaagcucucgggguccgcgcagcacguggaggagugcagcugcuacccccgguacccgggcguccgcugcgugugccgggacaacuggaagggguccaaccgccccaucguggacaucaacaucaaggaccacucgaucgucuccagcuacgugugcuccggccuggugggcgacacgccccggaagaacgacucguccagcuccucgcacugccuggaccccaacaacgaggagggcgggcacggggucaagggcugggccuucgacgacgggaacgacguguggaugggccgcaccaucaacgagaccucccggcucggcuacgagaccuucaaggucguggagggguggagcaacccgaaguccaagcugcagaucaaccgccaggugaucgucgaccggggcgaccgcucgggguacuccggcaucuucagcguggagggcaagucgugcaucaaccggugcuucuacguggagcugauccgcgggcggaaggaggagaccgagguccucuggaccuccaacagcaucgugguguucugcggcaccuccgggacguacggcaccgggagcuggcccgacggcgccgaccugaaccugaugcccaucuga

SEQ ID NO: 16354 - RNA, 1410 nt, Artificial Sequence; identical to SEQ ID NO: 16353
  derived and/or modified CDS sequence (AUadapt) from InfluenzaA__EPI553998__NA

SEQ ID NO: 16355 - RNA, 1410 nt, Artificial Sequence
  derived and/or modified CDS sequence (AUadapt) from InfluenzaA__EPI551568__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggucgaagccccagugcuccaucaccggguucgcgcccuucagcaaggacaacuccauccgccugucggccggcggggacaucugggucacccgggagcccuacguguccugcgacccggacaagugcuaccaguucgcccugggccaggggaccacgcucaacaacgugcacagcaacaacaucguccgcgaccggacccccuaccgcacccugcugaugaacgagcucggcgugcccuuccaccugggcaccaagcaggucugcaucgccugguccucguccagcugccacgacgggaaggccuggcugcacgugugcaucacgggcgacgacaagaacgcgaccgccuccuucaucuacaacgggcggcucguggacagcguggucuccuggucgaaggacauccugcgcacccaggaguccgagugcgugugcaucaacgggaccugcacgguggucaugaccgacgggagcgccucgggcaaggccgacaccaagauccuguucaucgaggagggcaagaucguguacaccuccaagcucagcggguccgcgcagcacguggaggagugcucgugcuacccccgguacccgggcguccgcugcgugugccgggacaacuggaagggguccaaccgccccaucguggacaucaacaucaaggaccacagcaucgucuccucguacgugugcuccggccuggugggcgacacgccccggaagaacgacagcuccagcuccucgcacugccuggaccccaacaacgaggagggcggccacggggucaagggcugggccuucgacgacgggaacgacguguggaugggccgcaccaucaacgagaccucccggcucggcuacgagaccuucaaggucguggagggguggagcaacccgaaguccaagcugcagaucaaccgccaggugaucgucgaccggggcgaccgcucgggguacuccggcaucuucagcguggagggcaagucgugcaucaaccggugcuucuacguggagcugauccgcgggcggaaggaggagacggagguccucuggaccuccaacagcaucgugguguucugcggcaccuccgggaccuacggcacggggagcuggcccgacggcgccgaccugaaccugaugcccaucuga

SEQ ID NO: 16356 - RNA, 1410 nt, Artificial Sequence
  derived and/or modified CDS sequence (AUadapt) from InfluenzaA__EPI629737__NA
augaaccccaaccagaagaucaucgccaucggcucggugucccugaccaucagcaccaucugcuucuucaugcagaucgccauccucaucacgaccgucacccugcacuucaagcaguacgaguucaacuccccgcccaacaaccaggugaugcugugcgagcccaccaucaucgagcgcaacaucacggagaucguguaccucaccaacaccaccaucgagaaggagaucugccccaagccggcggaguaccggaacuggucgaagccccagugcuccaucacgggguucgcccccuucagcaaggacaacuccauccgccugucggccggcggggacaucugggucacccgggagcccuacguguccugcgacccggacaagugcuaccaguucgcccugggccaggggaccacccucaacaacgugcacagcaacaacacgguccgcgaccggacccccuaccgcacccugcugaugaacgagcucggcgugcccuuccaccugggcaccaagcaggucugcaucgccugguccucguccagcugccacgacgggaaggcguggcugcacgugugcaucacgggcgacgacaagaacgccaccgccuccuucaucuacaacgggcggcucguggacucgguggucuccuggagcaaggacauccugcgcacccaggaguccgagugcgugugcaucaacgggaccugcacgguggucaugaccgacgggucggccagcggcaaggcggacaccaagauccuguucaucgaggagggcaagaucguguacaccuccaagcucucgggguccgcccagcacguggaggagugcagcugcuacccccgguacccgggcguccgcugcgugugccgggacaacuggaagggguccaaccgccccaucguggacaucaacaucaaggaccacucgaucgucuccagcuacgugugcuccggccuggugggcgacacgccccggaagaacgacucguccagcuccucgcacugccuggaccccaacaacgaggagggcggccacggggucaagggcugggccuucgacgacgggaacgacguguggaugggccgcaccaucaacgagaccucccggcucggcuacgagaccuucaaggucguggagggguggagcaacccgaaguccaagcugcagaucaaccgccaggugaucgucgaccggggcgaccgcucgggguacuccggcaucuucagcguggagggcaagucgugcaucaaccggugcuucuacguggagcugauccgcgggcggaaggaggagacggagguccucuggaccuccaacagcaucgugguguucugcggcaccuccgggaccuacggcacggggagcuggcccgacggcgccgaccugaaccugaugcccaucuga

SEQ ID NO: 16357 - RNA, 1410 nt, Artificial Sequence; identical to SEQ ID NO: 16353
  derived and/or modified CDS sequence (AUadapt) from InfluenzaA__EPI631886__NA

SEQ ID NO: 16358 - RNA, 1410 nt, Artificial Sequence; identical to SEQ ID NO: 16353
  derived and/or modified CDS sequence (AUadapt) from InfluenzaA__EPI577025__NA

SEQ ID NO: 16359 - RNA, 1410 nt, Artificial Sequence
  derived and/or modified CDS sequence (AUadapt) from InfluenzaA__EPI404926__NA
augaaccccaaccagaagaucaucaccaucggcucggugucccugaccaucucgacgaucugcuucuucaugcagaucgccauccucaucaccaccgucacccugcacuucaagcaguacgaguucgacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccggcucguggacuccguggucagcugguccaaggagauccugcgcacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgguacccggggguccgcugcgugugccgggacaacuggaagggcagcaaccgccccaucguggacaucaacaucaaggaccacuccaucgucucguccuacgugugcagcggccuggugggggacaccccgcggaagaacgacuccucguccagcucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaucaaccgccaggugaucguggaccgcggggaccgguccggcuacucggggaucuucuccgucgagggcaagagcugcaucaaccggugcuucuacguggagcugauccgcggccggaaggaggagaccgaggugcucuggaccucgaacuccaucgucguguucugcgggacgagcggcaccuacgggaccggcuccuggcccgacggggccgaccugaaccugaugcccaucuga

SEQ ID NO: 16360 - RNA, 1410 nt, Artificial Sequence; identical to SEQ ID NO: 16359
  derived and/or modified CDS sequence (AUadapt) from InfluenzaA__EPI492687__NA

SEQ ID NO: 16361 - RNA, 1410 nt, Artificial Sequence
  derived and/or modified CDS sequence (AUadapt) from InfluenzaA__EPI530648__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccucguccugccacgacggcaaggccuggcugcacgugugcaucaccggggacgacaagaacgcgaccgccagcuucaucuacaacggccggcucguggacuccguggucucgugguccaaggacauccugcgcacccaggagagcgagugcgugugcaucaacgggacgugcaccguggucaugaccgacggcuccgccucgggcaaggccgacaccaagauccuguucaucgaggaggggaagaucgugcacacgagcacccucuccggcucggcgcagcacguggaggagugcuccugcuacccccgguacccggggguccgcugcgugugccgggacaacuggaagggcucgaaccgccccaucguggacaucaacaucaaggaccacuccaucgucagcuccuacgugugcucgggccuggugggggacaccccgcggaagaacgacuccagcuccucgucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaccaaccgccaggugaucguggaccgcggggaccgguccggcuacucggggaucuucuccgucgagggcaagagcugcaucaaccggugcuucuacguggagcugauccgcggccggaaggaggagaccgaggugcucuggacgucgaacuccaucgucguguucugcgggaccagcggcaccuacgggaccggcuccuggcccgacggggccgaccugaaccugaugcccaucuga

SEQ ID NO: 16362 - RNA, 1410 nt, Artificial Sequence; identical to SEQ ID NO: 16343
  derived and/or modified CDS sequence (AUadapt) from InfluenzaA__EPI684314__NA

SEQ ID NO: 16363 - RNA, 1410 nt, Artificial Sequence
  derived and/or modified CDS sequence (AUadapt) from InfluenzaA__EPI614459__NA
augaaccccaaccagaagaucaucaccaucggcucggugucccugaccaucucgacgaucugcuucuucaugcagaucgccauccucaucaccaccgucacccugcacuucaagcaguacaaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccucguccugccacgacggcaaggccuggcugcacgugugcaucaccggggacgacaagaacgcgaccgccagcuucaucuacaacggccggcucguggacuccguggucucgugguccaaggacauccugcgcacccaggagagcgagugcgugugcaucaacgggacgugcaccguggucaugaccgacggcuccgccucgggcaaggccgacaccaagauccuguucaucgaggaggggaagaucgugcacacgagcacccucuccggcucggcgcagcacguggaggagugcuccugcuacccccgguacccggggguccgcugcgugugccgggacaacuggaagggcucgaaccgccccaucguggacaucaacaucaaggaccacuccaucgucagcuccuacgugugcucgggccuggugggggacaccccgcggaagaacgacuccagcuccucgucccacugccuggaccccaacaacgaggagggcgggcacggcgucaaggggugggccuucgacgacggcaacgacguguggaugggccgcaccaucaacgagacgucgcggcucggguacgagaccuucaaggucaucgagggcugguccaaccccaagagcaagcugcagaccaaccgccaggugaucguggaccgcggggaccgguccggcuacucggggaucuucuccgucgagggcaagagcugcaucaaccggugcuucuacguggagcugauccgcggccggaaggaggagaccgaggugcucuggacgucgaacuccaucgucguguucugcgggaccagcggcaccuacgggaccggcuccuggcccgacggggccgaccugaaccugaugcccaucuga

SEQ ID NO: 16364 - RNA, 1410 nt, Artificial Sequence; identical to SEQ ID NO: 16363
  derived and/or modified CDS sequence (AUadapt) from InfluenzaA__EPI541466__NA

SEQ ID NO: 16365 - RNA, 1410 nt, Artificial Sequence; identical to SEQ ID NO: 16363
  derived and/or modified CDS sequence (AUadapt) from InfluenzaA__EPI696968__NA

SEQ ID NO: 16366 - RNA, 1410 nt, Artificial Sequence; identical to SEQ ID NO: 16363
  derived and/or modified CDS sequence (AUadapt) from InfluenzaA__EPI674598__NA

SEQ ID NO: 16367 - RNA, 1410 nt, Artificial Sequence; identical to SEQ ID NO: 16361
  derived and/or modified CDS sequence (AUadapt) from InfluenzaA__EPI530678__NA

SEQ ID NO: 16368 - RNA, 1410 nt, Artificial Sequence
  derived and/or modified CDS sequence (AUadapt) from InfluenzaA__EPI530680__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggucguccucguccugccacgacggcaaggccuggcugcacgugugcaucaccggggacgacaagaacgcgaccgccagcuucaucuacaacggccggcucguggacuccguggucucgugguccaaggacauccugcgcacccaggagagcgagugcgugugcaucaacgggacgugcaccguggucaugaccgacggcuccgccucgggcaaggccgacaccaagauccuguucaucgaggaggggaagaucgugcacacgagcacccucuccggcucggcgcagcacguggaggagugcuccugcuacccccgguacccggggguccgcugcgugugccgggacaacuggaagggcucgaaccgccccaucguggacaucaacaucaaggaccacuccaucgucagcuccuacgugugcucgggccuggugggggacaccccgcggaagaacgacuccagcuccucgucccacugccuggaccccaacaacgaggagggcgggcacggcgucaaggggugggccuucgacgacggcaacggcguguggauggggcgcaccaucaacgagacgucgcggcucggcuacgagaccuucaaggucaucgaggggugguccaaccccaagagcaagcugcagaccaaccgccaggugaucguggaccggggcgaccgcuccggguacucgggcaucuucuccgucgagggcaagagcugcaucaaccggugcuucuacguggagcugauccgcgggcggaaggaggagaccgaggugcucuggacgucgaacuccaucgucguguucugcggcaccagcgggaccuacggcaccggguccuggcccgacggcgccgaccugaaccugaugcccaucuga

SEQ ID NO: 16369 - RNA, 1410 nt, Artificial Sequence
  derived and/or modified CDS sequence (AUadapt) from InfluenzaA__EPI7603__NA
augaaccccaaccagaagaucaucaccaucggcucggugucccugaccaucgccacgaugugcuuccucaugcagaucgccauccuggucaccaccgugacccugcacuucaagcaguacgagugcaacucgccgcccaacaaccaggugauccucugcgagcccacgaucaucgagcgcaacaucaccgagaucgucuaccugaccaacaccacgaucgagaaggagaucugccccaagcuggcggaguacaagaacugguccaagccgcagugcaagaucaccggguucgcccccuucagcaaggacaacuccauccggcucucggccggcggggacaucugggugacccgcgagcccuacguguccugcgaccccgacaagugcuaccaguucgcccugggccaggggaccacgcugaacaaccggcacucgaacgacaccguccacgaccgcaccccguaccggacccuccugaugaacgagcugggcgugcccuuccaccucggcacgaagcaggucugcaucgccugguccagcuccucgugccacgacgggaaggcguggcugcacgugugcgugaccggccacgacgagaacgccaccgccuccuucaucuacgacgggcgccugguggacagcaucggcuccuggucgaagaagauccuccggacccaggaguccgagugcgucugcaucaacgggacgugcaccguggugaugaccgacggcucggccuccggccgcgcggacaccaagauccuguucaucgaggaggggaagaucguccacaucagcccccugcucggcucggcccagcacguggaggagugcuccugcuacccccgguacccgggggugcgcugcgucugccgggacaacuggaagggcagcaaccgccccaucguggacaucaacgugaaggacuacuccaucgucucguccuacgugugcucgggccuggugggggacacgccccggaagaacgaccgcuccagcuccucgaacugccugaaccccaacaacgaggagggcgggcacggcgucaaggggugggccuucgacgacggcaacgacguguggaugggccggaccaucuccgagaagcuccgcagcggguacgagaccuucaaggucaucgagggcugguccaagccgaacucgaagcugcagaucaaccggcaggucaucguggaccgcggggaccgguccggcuacucggggaucuucuccguggagggcaagagcugcaucaaccgcugcuucuacguggagcugauccggggccgcaagcaggagaccgaggugugguggacguccaacucgaucgucguguucugcgggaccagcggcaccuacgggaccggcuccuggcccgacggggccgacaucaaccucaugcccaucuga

SEQ ID NO: 16370 - RNA, 1410 nt, Artificial Sequence; identical to SEQ ID NO: 16361
  derived and/or modified CDS sequence (AUadapt) from InfluenzaA__EPI814527__NA

SEQ ID NO: 16371 - RNA, 1410 nt, Artificial Sequence; identical to SEQ ID NO: 16361
  derived and/or modified CDS sequence (AUadapt) from InfluenzaA__EPI674737__NA

SEQ ID NO: 16372 - RNA, 1410 nt, Artificial Sequence; identical to SEQ ID NO: 16361
  derived and/or modified CDS sequence (AUadapt) from InfluenzaA__EPI614443__NA

SEQ ID NO: 16373 - RNA, 1410 nt, Artificial Sequence; identical to SEQ ID NO: 16361
  derived and/or modified CDS sequence (AUadapt) from InfluenzaA__EPI551812__NA

SEQ ID NO: 16374 - RNA, 1410 nt, Artificial Sequence; identical to SEQ ID NO: 16361
  derived and/or modified CDS sequence (AUadapt) from InfluenzaA__EPI696961__NA

SEQ ID NO: 16375 - RNA, 1410 nt, Artificial Sequence; identical to SEQ ID NO: 16361
  derived and/or modified CDS sequence (AUadapt) from InfluenzaA__EPI740789__NA

SEQ ID NO: 16376 - RNA, 1410 nt, Artificial Sequence
  derived and/or modified CDS sequence (AUadapt) from InfluenzaA__EPI377498__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacucgauccgccuguccgccgggggcgacaucugggucacccgggagcccuacgugagcugcgacccggacaagugcuaccaguucgcccuggggcagggcaccacgcucaacaacgugcacuccaacaacaccguccacgaccgcacccccuaccggacccugcugaugaacgagcucggcgugcccuuccaccuggggacgaagcaggucugcaucgccuggucguccagcuccugccacgacggcaaggccuggcugcacgugugcaucaccggggacgacaagaacgcgaccgccucguucaucuacaacggccgccucguggacuccguggucagcugguccaaggagauccugcggacccaggagucggagugcgugugcaucaacgggacgugcaccguggucaugaccgacggcuccgccagcggcaaggccgacaccaagauccuguucaucgaggaggggaagaucgugcacacgucgacccucuccggcucggcgcagcacguggaggagugcuccugcuacccccgcuacccggggguccggugcgugugccgcgacaacuggaagggcagcaaccggcccaucguggacaucaacaucaaggaccacuccaucgucucguccuacgugugcagcggccuggugggggacaccccgcgcaagaacgacuccucguccagcucccacugccuggaccccaacaacgaggagggcgggcacggcgucaaggggugggccuucgacgacggcaacgacguguggaugggccggaccaucaacgagacgucgcgccucggguacgagaccuucaaggucaucgagggcugguccaaccccaagagcaagcugcagaucaaccggcaggucaucguggaccgcggggaccgguccggcuacucggggaucuucuccguggagggcaagagcugcaucaaccgcugcuucuacguggagcugauccggggccgcaaggaggagaccgaggugcucuggaccucgaacuccaucgucguguucugcgggacgagcggcaccuacgggaccggcuccuggcccgacggggccgaccugaaccugaugcccaucuga

SEQ ID NO: 16377 - RNA, 1410 nt, Artificial Sequence; identical to SEQ ID NO: 16376
  derived and/or modified CDS sequence (AUadapt) from InfluenzaA__EPI377498__NA

SEQ ID NO: 16378 - RNA, 1410 nt, Artificial Sequence; identical to SEQ ID NO: 16376
  derived and/or modified CDS sequence (AUadapt) from InfluenzaA__EPI391246__NA

SEQ ID NO: 16379 - RNA, 1410 nt, Artificial Sequence; identical to SEQ ID NO: 16376
  derived and/or modified CDS sequence (AUadapt) from InfluenzaA__EPI407122__NA

SEQ ID NO: 16380 - RNA, 1410 nt, Artificial Sequence; identical to SEQ ID NO: 16376
  derived and/or modified CDS sequence (AUadapt) from InfluenzaA__EPI407125__NA

SEQ ID NO: 16381 - RNA, 1410 nt, Artificial Sequence; identical to SEQ ID NO: 16343
  derived and/or modified CDS sequence (AUadapt) from InfluenzaA__EPI562038__NA

SEQ ID NO: 16382 - RNA, 1410 nt, Artificial Sequence; identical to SEQ ID NO: 16343
  derived and/or modified CDS sequence (AUadapt) from InfluenzaA__EPI562038__NA

SEQ ID NO: 16383 - RNA, 1410 nt, Artificial Sequence
  derived and/or modified CDS sequence (AUadapt) from InfluenzaA__EU716525__NA
augaaccccaaccagaagaucaucaccaucggcucggugucccugaccaucagcacgaucugcuucuucaugcagaccgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggacgacccugaacaacgugcacuccaacgacaccguccacgaccgcaccccguaccggacgcugcucaugaacgagcugggcgugcccuuccaccugggcaccaagcaggucugcaucgccuggagcuccucguccugccacgacgggaaggccuggcuccacgugugcaucaccggcgacgacaagaacgcgaccgccagcuucaucuacaacgggcgccugguggacuccaucgugucgugguccaaggagauccugcggacgcaggagagcgagugcgucugcaucaacgggaccugcaccguggugaugaccgacggguccgccucgggcaaggccgacacgaagauccucuucaucgaggagggcaagaucguccacaccagcauccuguccgggucggcgcagcacguggaggagugcuccugcuacccccgcuaccccggcgugcggugcgucugccgcgacaacuggaaggggagcaaccggccgaucguggacaucaacaucaaggaccacuccaucgugucguccuacgucugcagcggccuggugggcgacacgccccgcaagaacgacuccucguccagcucccacugccucgaccccaacaacgaggagggcggccacggggugaagggcugggccuucgacgacgggaacgacgucuggaugggccggaccaucucggagaagucccgccugggcuacgagaccuucaaggugaucgagggguggagcaaccccaaguccaagcugcagaucaaccggcaggucaucguggaccgcggcaaccggucgggguacuccggcaucuucagcguggagggcaagucgugcaucaaccgcugcuucuacgucgagcucauccgggggcgcaaggaggagaccgaggugcuguggaccuccaacagcaucguggucuucugcggcaccuccgggacguacggcaccgggagcuggccggacggcgccgacaucaaccugaugcccaucuga

SEQ ID NO: 16384 - RNA, 1350 nt, Artificial Sequence
  derived and/or modified CDS sequence (AUadapt) from InfluenzaA__EPI232422__NA
augaaucccaaccaaaagaucaucaccaucggcagcaucugcauggugaucgggaucgucucccugaugcuccagaucggcaacaugaucagcaucugggugucccacagcauccagaccgggaaucagcgccaggccgagccgaucuccaacacgaaguuccugaccgaaaaggccguggcgagcgucacccuggccggcaacuccagccucugccccaucuccgggugggccguguacaguaaggacaacuccauccggaucggcagccgcggcgacguguucgucauccgggagcccuucaucuccugcagucaccuggagugccgcaccuucuuccugacgcagggggcccuccugaacgacaagcacuccaacggcaccgugaaggaucggagcccccaccgcacccugauguccugcccggugggggaggcccccagccccuacaacucccgguucgaaagugucgcguggagcgccuccgccugccacgacggcaccagcuggcucacgaucgggaucuccggccccgacaacggcgccguggcggugcugaaguauaacgggaucaucaccgacaccaucaagagcuggcgcaacaacauccugcggacccaggaguccgagugcgccugcgucaacggcaguugcuucacggugaugaccgacgggccguccagcggccaggccuccuacaagaucuucaaaauggagaagggcaagguggucaagagcguggagcucgaugcccccaacuaccacuacgaggagugcuccugcuaccccgaugccggggagaucacgugcgugugccgcgacaacuggcacggcagcaaccggcccugggucuccuucaaucaaaaccuggaguaccagaucggguacaucugcagcggcguguucggggacaauccgcgccccaacgacggcaccggcuccugcgggcccgugagccccaacggcgcguacggggucaagggcuucuccuuuaaguacgggaacggcguguggaucggccggaccaagagcaccaacucccgcagcggguucgagaugaucugggacccgaacggcuggaccgggaccgauagcuccuucagcgugaagcaagacaucgucgccaucacggacugguccggcuacagcggguccuuugugcagcaccccgagcugaccggccucgacugcauccggcccugcuucugggucgagcugauccgcggccggcccaaggagagcaccaucuggaccuccgggagcuccaucaguuucugcggcgugaacuccgacacggugagcugguccuggccggacggggccgagcugcccuucaccaucgacaaguga

SEQ ID NO: 16385 - RNA, 1350 nt, Artificial Sequence
  derived and/or modified CDS sequence (AUadapt) from InfluenzaA__EPI227593__NA
augaaucccaaccaaaagaucaucaccaucggcagcaucugcauggugaucgggaucgucucccugaugcuccagaucggcaacaugaucagcaucugggugucccacaguauccagaccgggaaccagcgccaggccgagccgaucuccaacacgaaguuccugaccgagaaggccguggcgagcgucacccuggccggcaacuccagccucugccccaucuccgggugggccguguauagcaaggacaacuccauccggaucggcagccgcggcgacguguucgucauccgggagcccuucaucuccuguagccaccuggaaugccgcaccuucuuccugacgcagggggcccuccugaacgacaagcauuccaacggcaccgugaaggaccggagcccccaccgcacccugauguccugcccggugggggaggcccccagccccuacaauucccgguucgagagcgucgcguggagcgccuccgccugccacgacggcaccagcuggcucacgaucgggaucuccggccccgauaacggcgccguggcggugcugaaguacaacgggaucaucaccgacaccaucaagagcuggcgcaacaacauccugcggacccaggaguccgagugugccugcgucaacggcagcugcuucacggugaugaccgacgggccguccaacggccaggccaguuacaagaucuucaaaauggagaagggcaagguggucaaguccguggagcucgacgcccccaacuaccacuaugaggagugcagcugcuaccccgacgccggggagaucacgugcgugugccgcgauaacuggcacggcuccaaccggcccugggucagcuucaaccagaaccuggaguaucagaucggguacaucugcuccggcguguucggggacaacccgcgccccaacgacggcaccggcaguugcgggcccgugucccccaacggcgcguacggggucaagggcuucagcuucaaauacgggaauggcguguggaucggccggaccaaguccaccaacagccgcuccggguucgagaugaucugggacccgaacggcuggaccgggaccgacagcaguuucuccgugaagcaggacaucgucgccaucacggacuggagcggcuacuccgggagcuucgugcagcaucccgagcugaccggccucgacugcauccggcccugcuucugggucgagcugauccgcggccggcccaaggaguccaccaucuggaccagcggguccagcaucuccuucuguggcgugaacagcgacacgguguccuggagcuggccggacggggccgagcugcccuucaccaucgacaaguga

SEQ ID NO: 16386 - RNA, 1350 nt, Artificial Sequence
  derived and/or modified CDS sequence (AUadapt) from InfluenzaA__EPI435658__NA
augaaucccaaccagaagaucgugaccaucggcucgaucugcauggucaucgggaucaucucccugaugcuccagaucggcaacaucaucagcaucugggugucccacagcauccagaccgggaaucagcaccagacggagccgauccgcaacaccaacuuccugaccgagaacgccguggccuccgucacccuggcgggcaacagcucccucugucccauccgggggugggccgugcacagcaaggacaacuccauccgcaucggcagcaagggcgacguguucgucauccgggagcccuucaucuccuguagccaccuggagugccgcacguucuuccugacccagggggcccuccugaacgacaagcauuccaacggcaccgugaaggaccggagcccccaccgcacccugauguccugcccgaucggggaggcccccagccccuacaacucccgguuugagagcguggccugguccgcgagcgccugccacgacggcacgagcuggcucaucaucgggaucuccggccccgacaauggcgccgucgccgugcugaaguacaacgggaucaucaccgacaccaucaagagcuggcgcaacaacauccugcggacccaggaguccgagugcgcgugcgugaauggcagcugcuucacggucaugaccgacgggccguccaacggccaggccagcuacaagaucuuuaagaucgagaagggcaagguggugaaguccgucgagcucaacgcccccaacuaccacuacgaggagugcagcuguuaccccgacgccggggagaucaucugcgugugccgcgacaacuggcacggcuccaaccggcccugggugaguuucaaccagaaccuggaguaccagaucggguacaucugcuccggcgucuucggggauaacccgcgccccaacgacggcaccggcagcugcgggcccgugucccccaacggcgccuacggggugaagggcuucaguuucaaguacgggaacggcgucuggaucggccggaccaaguccacgcacagccgcuccggguucgagaugaucugggacccgaauggcuggaccgggaccgacagcgaguucuccaugaagcaggacaucguggcgaucaccgacuggagcggcuacagcggguccuuugugcagcaccccgagcugacgggccucgacugcauccggcccugcuucugggucgagcugauccgcggccggcccaaggagagcaccaucuggaccuccgggagcuccaucaguuucugcggcgugaacuccgacaccgucagcugguccuggccggacggggccgagcugcccuucacgaucgacaaguga

SEQ ID NO: 16387 - RNA, 1350 nt, Artificial Sequence; identical to SEQ ID NO: 16386
  derived and/or modified CDS sequence (AUadapt) from InfluenzaA__EPI492513__NA

SEQ ID NO: 16388 - RNA, 1350 nt, Artificial Sequence
  derived and/or modified CDS sequence (AUadapt) from InfluenzaA__EPI165066__NA
augaaucccaaccagaagaucaucaccaucggcucgaucugcauggugaccgggaucgucucccugaugcuccaggugggcagcaugaucuccaucugggugagccacuccauccauacggggaaccagcaccaggccgagccgaucagcaacaccaacuuccugaccgagaaggccgucgcguccgugaagcuggccggcaacaguucccucugccccaucaacgggugggccguguacagcaaggacaacuccauccgcaucggcaguaagggcgacgucuucgugauccgggagcccuucaucuccugcagccaccuggagugccgcaccuuuuuccugacgcagggggcccuccugaacgacaagcacuccaacggcaccgugaaggaccggaguccccaccgcacccugauguccugcccgaugggggaggcccccagccccuacaacucccgguucgagagcgucgcguggagugccuccgccugccacgacggcaccagcuggcucacgaucgggaucuccggccccgacaacggcgccguggcggugcugaaguauaacgggaucaucaccgacaccaucaagagcuggcgcaacaacauccugcggacccaggaguccgagugcgccugcgucaauggcagcugcuucacggugaugaccgacgggccguccaacggccaggccagccacaagaucuuuaagauggagaagggcaaggugaucaaguccgucgagcucgacgcccccaacuaccacuacgaggagugcaguugcuaccccgacgccggggagaucacgugcgugugccgcgacaacuggcauggcuccaaccggcccugggugagcuucaaccagaaccuggaguaccagaucggguauaucugcuccggcgucuucggggacaacccgcgccccaacgacggcaccggcagcugugggcccguguccagcaacggcgcguacggggugaagggcuucuccuucaaguacgggaauggcgucuggaucggccggaccaagagcaccaacucccgcagcggguucgagaugaucugggaccccaacggcuggaccgagaccgacagucgguucuccgugaagcaggacaucguggccaucacggacuggagcggguacuccggcagcuuuguccagcacccggagcugaccgggcucgacugcauccgccccugcuucuggguggagcugauccggggccgccccaaggaguccaccaucuggaccagcggcuccagcaucuccuuuugcggggucaacagcgacacggugggcugguccuggcccgacggggccgagcugccguucaccaucgacaaguga

SEQ ID NO: 16389 - RNA, 1350 nt, Artificial Sequence
  derived and/or modified CDS sequence (AUadapt) from InfluenzaA__EPI531308__NA
augaaucccaaccagaagaucaucaccaucggcucgaucugcauggugaccggggucgugucccugaugcuccaggugggcaacaugaucagcaucuggaucucccacaguauccacacggggaaccagcaccaggccgagccgaucuccaacaccaacuuccauaccgagaaggccgucgugagcgcgaagcuggccggcaacuccagccugugccccaucaacgggugggccguguacuccaaggauaacagcauccgcaucggcuccaagggcgacgucuucgugauccgggagcccuucaucagcuguucccaccucgagugccgcaccuucuuccugacgcagggggcccugcucaacgacaagcacaguaacggcaccgccaaggaccggagcccccaccgcacccugauguccugcccggugggggaggcgcccucccccuacaauagccgguucgaguccgucgccuggagcgccagcgccugccacgauggcaccuccuggcugacgaucgggaucagcggccccgacaacggcgcgguggccgugcucaaguacaacgggaucaucaccgacaccaucaaguccuggcgcaauaacguccugcggacccaggagucggagugcgccugcgugaacggcuacuguuucacggugaugaccgacgggccguccaacggccaggccagccacaagaucuucaagauggagaagggcaaggucaucaaguccguggagcuggacgcccccaauuaccacuacgaggagugcagcugcuaucccgacgcgggggagaucacgugcgugugccgcgacaacuggcacggcuccaaucggcccuggaucagcuucaaccagaaccucgaguaccagaucggguacaucuguuccggcgucuucggggacaacccgcgccccaacgacggcaagggcagcugugggcccguguccagcaacggcgccuacggggugaagggcuucuccuucaaguacgggaacggcgucuggaucggccggaccaagaguaccaacucccgcagcggguucgagaugaucugggaccccaacggcuggaccgagaccgacuccaguuucagcgugaagcaggacaucguggccaucaccgacugguccggguacagcggcuccuuuguccagcacccggagcugacggggcuggacugcauccggcccugcuucuggguggagcucauccgcggccggcccaaggagggcaccaucuggaccagcggguccaguaucuccuucugcggcgucagcggggacaccgugggcugguccuggcccgacggcgccgagcugccguucacgaucgacaaguga

SEQ ID NO: 16390 - RNA, 1350 nt, Artificial Sequence
  derived and/or modified CDS sequence (AUadapt) from InfluenzaA__EPI433308__NA
augaaucccaaccaaaagaucaucaccaucggcagcaucugcauggugaucgggaucgucucccugaugcuccagaucggcaaccugaucagcaucugggugucccacagcauccagcgcgggaaucugaaccagguggagccgaucuccaacaccagcuuccccacggagaaagccgucgccuccgugacccucgcgggcaacagcucccugugccccauccgggggugggccgugcauagcaaggacaacuccauccgcaucggcagcaagggcgacgucuucgugauccgggagcccuucaucuccugcagucaccuggagugccgcaccuucuuccucacccagggggcccugcugaacgacaagcacuccaauggcacggugaaagaccggagcccgcaccgcacccucauguccugccccgucggggaggcccccagccccuacaacucccgguucgagaguguggccuggagcgcguccgccugccacgacggcaccagcuggcugaccaucgggaucuccggcccggacaacggcgccguggccgucgugaaguauaacgggaucaucacggacaccaucaagagcuggggcaacaacauccugcgcacccaggaguccgaaugcgcgugcgugaacgggaguugcuucaccgucaugacggacggccccuccaacggccaggccagcuacaagaucuucaagauggagaaggggaaggugaucaaguccguggaacucgaugcccccaacuaccacuacgaggagugcagcugcuaucccgacgccggcgagaucacgugcgucugccgggacaacuggcacggguccaaccgcccgugggugagcuuuaaccagaaccuggaguaccagaucggcuacaucugcuccgggguguucggcgacaauccccggcccaacgacggcaccgggagcugcggccccgucuccccgaacggggccuacggcgugaaaggguucagcuuuaaguacggcaacggcguguggaucgggcgcaccaagucccccaacagccgguccggcuucgagaugaucugggaccccaacggguggagugagaccgacagcuccuucagcgucaagcaggacauccuggcggugaccgacugguccggcuacagcggguccuuuguccaacaccccgagcucaccggccuggacugcauccgcccgugcuucuggguggagcugauccggggccgccccgaggagagcaccaucuggacguccgggagcuccaucaguuucugcggcgugaacuccgacaccgucagcugguccuggcccgacggggccgagcuccccuucaccaucgacaaguga

SEQ ID NO: 16391 - RNA, 1350 nt, Artificial Sequence
  derived and/or modified CDS sequence (AUadapt) from InfluenzaA__EPI114974__NA
augaaucccaaccaaaagaucaucaccaucggcagcaucugcauggugaucgggaucgucucccugaugcuccagaucggcaacaugaucagcaucugggugucccacaguauccagaccgggaaccagcgccaggccgagccgaucuccaacacgaaguuccugaccgagaaggccguggcgagcgucacccuggccggcaacuccagccucugccccaucuccgggugggccguguauagcaaggacaacuccauccggaucggcagccgcggcgacguguucgucauccgggagcccuucaucuccuguagccaccuggagugccgcaccuucuuccugacgcagggggcccuccugaacgacaagcauuccaacggcaccgugaaggaccggagcccccaccgcacccugauguccugcccggugggggaggcccccagccccuacaauucccgguucgaaagcgucgcguggagcgccuccgccugccacgacggcaccagcuggcucacgaucgggaucuccggccccgauaacggcgccguggcggugcugaaguacaacgggaucaucaccgacaccaucaagagcuggcgcaacaacauccugcggacccaggaguccgagugugccugcgucaacggcagcugcuucacggugaugaccgacgggccguccaacggccaggccaguuacaagaucuucaagauggagaagggcaagguggucaaguccaucgagcucgacgcccccaacuaccacuaugaggagugcagcugcuaccccgacgccggggagaucacgugcgugugccgcgauaacuggcacggcuccaaccggcccugggugagcuucaaccaaaaccuggaguaucagaucggguacaucugcuccggcgucuucggggacaacccgcgccccaacgacggcaccggcaguugcgggcccgugucccccaacggcgcguacggggugaagggcuucagcuucaaguacgggaauggcgucuggaucggccggaccaaguccaccaacagccgcuccggguucgagaugaucugggacccgaacggcuggaccgggaccgacagcaguuucuccgugaagcaggacaucguggccaucacggacuggagcggcuacuccgggagcuucguccagcaucccgagcugaccggccucgacugcauccggcccugcuucuggguggagcugauccgcggccggcccaaggaguccaccaucuggaccagcggguccagcaucuccuucuguggcgucaacagcgacacgguguccuggagcuggccggacggggccgagcugcccuucaccaucgacaaguga

SEQ ID NO: 16392 - RNA, 1350 nt, Artificial Sequence
  derived and/or modified CDS sequence (AUadapt) from InfluenzaA__EPI622495__NA
augaaucccaaccaaaagaucaccaccaucggcagcaucugcauggugaucgggaucgucucccugaugcuccagaucggcaacauggugagcaucugggugucccacaguauccagacgcgcaaccagcggcaggccgagccgaucuccaacacccgcagccugaccgagaaggccgucgcguccgugacccuggccgggaacagcucccucugccccaucaguggcugggccguguacuccaaggacaacagcauccggaucggguccaagggcgacgucuucgugauccgcgagcccuucaucaguugcucccaccuggagugccggacguucuuccugacccagggcgcccuccugaacgauaagcacagcaacgggaccgugaaggaccgcagcccccaccggacccugauguccuguccggucggcgaggcccccucccccuacaacagccgcuucgagagcguggcgugguccgccagcgccugccaugacgggacguccuggcucaccaucggcaucagcgggcccgacaacggcgccguggcggucgugaaguacaacggcaucaucaccgauaccaucaaguccuggcggaacaacauccugcgcacgcaggagagcgagugcgugugcgucaacggguccugcuuuaccgugaugaccgacggcccgagcaacaagcaggccuccuacaagaucuucaaaauggagaaggggaagguggucaagagcaucgagcuggaugcccccaacuaccacuacgaggagugcuccugcuaucccgacgccggcgagaucacgugcgugugccgggacaacuggcacggcagcaaucgccccuggcucuccuucaaccagaaccuggaguaccagaucggguacaucugcaguggcguguucggggacaacccgcggcccaacgacggcaccggguccugcggccccgucagcuccaauggcgccuacggggugaagggcuucagcuucaaguacgggaacggcguguggaucgggcgcaccaaguccaccaauagccggagcggcuucgagaugaucugggaccccaacggcuggaccgggacggacuccaguuucuccaugaagcaggacaucgucgcgaucaccgacuggagcggcuacuccgggagcuucgugcagcauccggagcugaccggccucgacugcauccgccccugcuucugggucgagcuggugcgggggcgccccaaggagggcaccaucuggacguccggcagcuccaucagcuuuugcggggugaacuccgacaccgucagcugguccuggcccgacggcgccgagcugccguucaccaucgacaaguga

SEQ ID NO: 16393 - RNA, 1350 nt, Artificial Sequence
  derived and/or modified CDS sequence (AUadapt) from InfluenzaA__EPI349847__NA
augaaucccaaccaaaagaucaccaccaucggcagcaucugcauggugaucgggaucgucucccugaugcuccagaucggcaacauggugagcaucugggugucccacaguauccagacgcgcaaccagcggcaggccgagccgaucuccaacacccgcagccugaccgagaaggccgucgcguccgugacccuggccgggaacagcucccucugccccaucaguggcugggccguguacuccaaggacaacagcauccggaucggguccaagggcgacgucuucgugauccgcgagcccuuuaucagcugcucccaccuggagugccggacguucuuccugacccagggcgcccuccugaaugacaagcacagcaacgggaccgugaaggaccgcagcccccaucggacccugauguccugcccggucggcgaggcccccucccccuacaacagccgcuucgagagcguggcgugguccgccagugccugccacgacgggacguccuggcucaccaucggcaucagcgggcccgacaacggcgccguggcggucgugaaguauaacggcaucaucaccgacaccaucaaguccuggcggaacaacauccugcgcacgcaggagagcgagugcgugugugucaacggguccugcuucaccgugaugaccgacggcccgagcaacaagcaggccuccuauaagaucuucaagauggagaaggggaagguggucaagagcaucgagcuggacgcccccaacuaccacuaugaggagugcuccugcuaccccgacgccggcgagaucacgugcgugugccgggauaacuggcacggcagcaaccgccccuggcucuccuucaaccagaaucuggaguaccagaucggguacaucugcagcggcguguucggggacaauccgcggcccaacgacggcaccggguccugcggccccgucagccacaacggcgccuauggggugaagggcuucuccuucaaguacgggaacggcguguggaucgggcgcaccaagagcaccaacucccggaguggcuucgagaugaucugggaccccaacggcuggaccgggacggacagcuccuucaguaugaagcaggacaucgucgcgaucaccgacugguccggcuacagcggguccuucgugcagcacccggagcugaccggccucgauugcauccgccccugcuucugggucgagcuggugcgggggcgccccaaggagggcaccaucuggacgagcggcuccagcaucuccuucuguggggugaacagcgacaccgucuccuggagcuggcccgacggcgccgagcugccguucaccaucgacaaguga

SEQ ID NO: 16394 - RNA, 1350 nt, Artificial Sequence
  derived and/or modified CDS sequence (AUadapt) from InfluenzaA__EPI174804__NA
augaaucccaaccagaagaucaucaccaucggcagcaucugcauggugaucgggaucgucucccugaugcuccagaucggcaacauggugagcaucugggugucccacaguauccagacccgcaaccagcggcaggccgagccgaucuccaacaccaagagccugaccgagaaggccgucgcguccgugacccuggccgggaacagcucccucugccccaucaguggcugggccguguacuccaaggacaacagcauccgcaucggguccaagggcgacgucuucgugauccgggagcccuucaucaguugcucccaccuggagugccgcaccuucuuccugacgcagggcgcccuccugaacgauaagcacagcaacgggaccaucaaggaccggagcccccaccgcacccugauguccugcccggugggcgaggcccccucccccuauaacagccgguucgagagcgucgcgugguccgccagcgccugccaugacgggaccuccuggcucacgaucggcaucagcgggcccgacaacggcgccguggcggugcugaaguacaacggcaucaucaccgacaccaucaaguccuggcgcaauaacauccugcggacccaggagagcgagugcgccugcgucaacggguccugcuuugccgugaugacggacggcccgagcaaccgccaggccuccuacaagaucuucaagauggagaaggggaagguggucaagagcaucgagcucgacgcccccaauuaccacuacgaggagugcuccugcuaccccgaugcgggcgagaucacgugcgugugccgggacaacuggcacggcagcaaucgccccuggcuguccuucaaccagaaccuggaguaccagaucggguacaucugcagcggcguguuuggggacaacccgcggcccaacgacggcaccggguccugcggccccgucagcuccaauggcgccuacggggugaagggcuucagcuucaaguacgggaacggcguguggaucgggcgcaccaaguccacgaacagucggagcggcuucgagaugaucugggaccccaacggcuggaccgagaccgacuccagcuuuuccaugaagcaggacaucgucgccaucaccgacuggagcggguacuccggcagcuucgugcagcacccggagcucacggggcuggauugcauccgccccugcuucuggguggagcugguccggggccgccccaaggaguccaccaucuggaccagcggguccagcaucuccuucuguggcgugaacagcgacaccgucuccuggagcuggcccgacggcgccgagcucccguucacgaucgacaaguga

SEQ ID NO: 16395 - RNA, 1350 nt, Artificial Sequence
  derived and/or modified CDS sequence (AUadapt) from InfluenzaA__EPI492441__NA
augaaucccaaccaaaagaucauggccaucggcagcgugugcauggucaucgggaucgugucccugaugcuccagaucggcaacaccaucagcaucugggugucccacagcuuccagacccgcguccagcaucaggccgagccgauccggaacacgaacuuccugaccgagaacgcgguggccuccgugacccuggccgggaacagcucccucugccccauccgcggcugggccguccacaguaaggacaacuccauccggaucgggagcaagggcgacguguucgugauccgcgagcccuucaucuccugcagccaucuggagugccggaccuucuuccugacgcagggcgcccuccugaacgacaagcacuccaaccgcaccgucaaggaccggaguccccaccgcacccugauguccugcccggugggggaggugcccagccccuacaacucccgguucgagagcgucgcgugguccgccagcgccugucacgacggcaccagcuggcucacgaucgggaucuccggccccgacaacggggccguggcggugcugaaauacaacggcaucaucaccgacaccaucaagaguuggcgcaacaacauccugcggacccaggaguccgagugcgccugcgucaacggcuucugcuucacggugaugaccgaugggccgagcaacggccaggccuccuacaagaucuucaagaugaagaaggggaagguggucaagagcguggagcucaacgcccccaacuaccacuaugaggagugcuccugcuaccccgacgccggcgagaucaugugcgugugccgcgacaacuggcauggcagcaaccggcccugggucuccuucaaccagaaccuggaauaccagaucggguacaucugcaguggcguguucggggacaacccgcgccccaacgacggcaccggguccugcggccccgugagccccaacggcgcguaugggaucaagggcuucuccuucaaguacgggaacggcgucuggaucgggcggaccaagagcacgaacucccgcagcggcuucgagauggugugggauccgaacggcuggaccgacaccgacuccgacuucagcaucaagcaggacaucgucgccaucaccgacugguccggguauagcggcagcuucgugcagcaccccgagcugacggggcucgacugcauccggcccugcuucuggguggagcugauccgcggccggcccaaggaguccaccaucuggaccaguggguccagcaucuccuucugcggcgucaacagcgagaccguguccuggagcuggccggacggcgccgagcugcccuucacgaucgacaaguga

SEQ ID NO: 16396 - RNA, 1350 nt, Artificial Sequence
  derived and/or modified CDS sequence (AUadapt) from InfluenzaA__EPI164142__NA
augaaucccaaccagaagaucaucaccaucggcagcaucugcauggugaucgggaucgucucccugaugcuccagaucggcaacaugaucagcaucugggugucccacaguauccagaccgggaaccagcaccaggccgagccgauccgcaacgccaacuuccugacggagaacgcgguggccuccgucacccuggccggcaauagcucccucugccccgugcgggggugggccgugcacagcaaggacaacuccauccgcaucggcaguaagggcgacgucuucgugauccgggagcccuucaucuccugcagccaccuggagugucgcaccuucuuccugacccagggggcccuccugaacgacaagcacuccaacggcacggugaaggaucggagcccccaccgcacccugauguccugcccggucggggaggcgcccagccccuacaacucccgguuugagagcguggccugguccgccagcgccugccacgacggcaccagcuggcucaccaucgggaucuccggccccgacaauggcgcgguggccguccugaaguacaacgggaucaucacggacaccaucaagagcuggcgcaacaacauccugcggacccaggaguccgagugugccugcgugaacggcagcugcuucaccgugaugacggacgggccguccaauggccaggccagcuacaagaucuucaagauggagaagggcaaggucgugaaguccguggagcucaacgcccccaacuaccauuacgaggagugcagcugcuaccccgacgcgggggagaucacgugugucugccgcgacaacuggcacggcuccaaccggcccugggugagcuuuaaccagaaccuggaguaccagaucggguacaucugcuccggcguguucggggacaauccgcgccccaacgacggcaccggcagcugcgggcccgucucccccaacggcgccuacgggaucaagggcuuuagcuucaaguacgggaacggcguguggaucggccggaccaaguccaccaacagccgcuccggguuugagaugaucugggacccgaacggcuggaccgagaccgacagcaacuucuccgugaagcaggauaucgucgccaucaccgacuggagcggguacagcggcuccuucgugcagcaccccgagcugacggggcucgauugcauccggcccugcuucugggucgagcugauccgcggccggcccaaggagagcaccaucuggaccuccggcagcuccaucagcuuuugcggggugaacuccgacaccgugagcugguccuggccggacggcgccgagcugcccuucacgaucgacaaguga

SEQ ID NO: 16397 - RNA, 1350 nt, Artificial Sequence
  derived and/or modified CDS sequence (AUadapt) from InfluenzaA__EPI827076__NA
augaaucccaaccagaagaucgugaccaucggcucgaucugcauggucaucgggaucaucucccugaugcuccagaucggcaacaucaucagcaucugggugucccacagcauccagaccgggaaccagcaucagacggagccgauccgcaacaccaacuuccugaccgagaacgccguggccuccgucacccuggcgggcaacagcucccucugccccaucaaggggugggccgugcacagcaaggauaacuccauccggaucggcagcaagggcgacguguucgucauccgcgagcccuucaucuccugcagccaccuggagugccggacguuuuuccugacccagggggcccuccugaacgacaagcacuccaacggcaccgugaaggaccgcagcccccaccggacccugauguccuguccgaucggggaggcccccagccccuacaacucccgcuucgagucgguggccugguccgcgagcgccugccacgacggcacgaguuggcucaucaucgggaucuccggccccgacaacggcgccgucgccgugcugaaguacaacgggaucaucaccgacaccaucaagagcuggcggaacaacauccugcgcacccaggaguccgagugcgcgugugugaacggcagcugcuucgccgucaugacggacgggccguccaacggccaggccagcuacaagaucuucaagaucgagaagggcaagguggugaaguccgucgagcucaaugcccccaacuaccacuacgaggagugcagcugcuaccccgaugccggggagaucaucugcgugugccgggacaacuggcacggcuccaaccgccccugggugagcuucaaccagaaucuggaguaccagaucggguacaucugcuccggcgucuucggggacaacccgcggcccaacgacggcaccggcagcugugggcccguguccucgaacggcgcguacggggugaagggcuucuccuucaaguacgggaacggcgucuggaucggccgcaccaagagcacccauucccggagcggguucgagaugaucugggaccccaacggcuggacggggaccgacuccgaguucagcaugaagcaggacaucguggccaucaccgacuggaguggcuacuccgggagcuucgugcagcacccggagcugaccggccucgacugcauccgccccugcuucugggucgagcugauccggggccgccccaaggaguccacgaucuggaccagcggguccaguaucuccuucugcggcgugaacagcgacaccgucuccuggagcuggcccgacggggccgagcugccguucaccaucgacaaguga

SEQ ID NO: 16398 - RNA, 1350 nt, Artificial Sequence
  derived and/or modified CDS sequence (AUadapt) from InfluenzaA__EPI168491__NA
augaaucccaaccaaaagaucaucaccaucggcagcaucugcauggugaucgggaucgucucccugaugcuccagaucggcaacaugaucagcaucugggugucccacagcauccagaccgggaaccagugucaggacgagccgaucuccaacacgaaguuccugaccgagaaggccguggccagcgucacccuggcgggcaacuccagccucugccccaucuccgggugggccguguacagcaaagauaacuccauccgcaucggcagccggggcgacguguucgucauccgcgagcccuucaucuccugcagccaccuggagugccggaccuuuuuccugacgcagggggcccuccugaacgacaagcacuccaacggcaccgugaaggaccgcagcccccaccggacccugauguccuguccggugggggaggcccccagccccuacaacucccgcuucgagagcgucgccuggagcgcguccgccugccacgacggcaccaguuggcucacgaucgggaucuccggccccgacaacggcgccguggccgugcugaaguacaacgggaucaucaccgacaccaucaagagcuggcggaacaacauccugcgcacccaagaguccgagugcgcgugugucaacggcagcugcuucacggugaugaccgacgggccguccagcggccaggccuccuacaagaucuucaagauggagaagggcaagguggucaagagcguggaacucgaugcccccaacuaccacuacgaggagugcuccugcuaccccgacgccggggagaucacgugugugugccgggacaacuggcacggcagcaaccgccccugggucuccuucaaccagaaccuggaguaucagaucggguacaucugcagcggcguguucggggacaacccgcggcccaacgacggcaccggcuccugcgggcccguguuucccaacggcgccuacggggucaagggcuucagcuucaaguacgggaacggcguguggaucggccgcaccaaguccaccaacagucgguccggguucgaaaugaucugggacccgaacggcuggaccgggaccgacagcagcuucuccgugaagcaggacaucgucgcgaucacggacuggaguggcuacuccgggagcuucgugcagcaccccgagcugaccggccucgacugcauccgccccugcuucugggucgagcugauccggggccgccccaaggaguccaccaucuggaccagcggguccaguaucuccuucugcggcgugaacagcgacacgguguccuggagcuggccggacggggccgagcugcccuucaccaucgacaaguga

SEQ ID NO: 16399 - RNA, 1350 nt, Artificial Sequence
  derived and/or modified CDS sequence (AUadapt) from InfluenzaA__EPI827078__NA
augaaucccaaccaaaagaucaucaccaucggcagcaucugcauggugaucgggaucgccucccugaugcuccagaucggcaacaucaucagcaucuggaucucccacagcauccagaccgggaaccagugucagaacgaguccaucagcaacacgaaguuccuggccgagaaggcggucgccuccgugacccuggccggcaacagcucccucugcccggugagcgggugggccgucuacuccaaggauaacagcauccgcaucggcuccaagggcgacguguucgugauccgggagcccuucaucagcugcucccaccuggagugucgcaccuucuuccugacccagggggcccuccugaacgacaagcacagcaacggcacggucaaggaccggagcccccaucgcacccugauguccugccccgugggggaggcgccgucccccuacaacagccgguucgagagcguggccugguccgccagcgccugccaugacggcaccuccuggcucaccaucgggaucagcggccccgacuccggcgcggucgccgugcugaaguacaacgggaucaucacggacaccaucaagagcuggcgcaacaacaucaugcggacccaggaguccgagugugccugcgugaacggcagcugcuucaccaucaugacggacgggcccuccagcggccaggccuccuacaagaucuucaagauggagaagggcaaggucaucaagaguguggagcuggacgccccgaacuaccacuacgaggagugcuccugcuaccccgaugcgggggagaucacgugcgugugccgcgacaacuggcacggcagcaaccggcccuggaucuccuucaaccagaaucucgaguaccagaucggguacaucugcagcggcgucuucggggacaacccccgcccgaacgauggcaccggcuccugcgggcccguguuccccaacggcgccuacggggugaagggcuucagcuucaaguacgggaacggcgucuggaucggccggaccaaguccaccaauagccgcagcggguucgagaugaucugggaccccaacggcuggaccgggaccgacuccagcuucuccgugaagcaggauaucguggccaucaccgaguggagcggcuacuccgggagcuucguccagcacccggagcugacgggccuggacugcauccggcccugcuucuggguggagcucauccgcggccggcccaaggaguccaccaucuggaccaguggguccagcaucuccuucugcggcgugaacggggacaccgucagcugguccuggcccgacggcgccgagcugccguucacgaucgacaaguga

SEQ ID NO: 16400 - RNA, 1350 nt, Artificial Sequence
  derived and/or modified CDS sequence (AUadapt) from InfluenzaA__EPI594521__NA
augaaucccaaccaaaagaucaucaccaucggcagcaucugcguggggaucggcaucgucucccugaugcuccagaucgggaacauggugagcaucugggugaaccauuccauccagaccgagaaccagugccaggccgagagcaucuccaacacgaaguuccugaccgagaaggccgucgcgccggugacccugaugggcaacaguucccucugccccaucagcgggugggccgugcacuccaaggacaacagcauccgcaucggcuccaagggcgacgucuuugugauccgggagcccuucaucagcugcucccaccuggagugccgcaccuucuuucugacgcagggggcccuccugaacgacaagcacagcaacggcaccgugaaggaccggagcccccaucgcgcccugauguccugcccggucggggaagcccccucccccuacaacagccgguucgaguccguggcguggagcgccagugccugccacgacggcaccggguggcucaccaucggcaucuccggccccgacaacggggccguggcgguccugaaguacaacggcaucaucacggauaccaucaagagcuggcgcaacaacauccugcggacccaggaguccgagugcgccugcgugaacgggaguugcuucaccgugaugacggacggcccguccaacggccaggccagcuacaagaucuucaagcucgagaaggggaaggucgugaaguccguggagcuggaugcccccaacuaccacuacgaggagugcagcuguuaccccgacgccggcgagaucacgugcgucugccgcgacaacuggcauggguccaaccggcccugggugagcuucaaccaaaaccuggaguaccagaucggcuacaucuguuccgggguguucggcgacaacccgcgccccaacgacggcaccgggagcuguggccccgucucccccaacggggcguacggcgugaagggguucagcuucaaguacggcaacggcguguggaucgggcggaccaaguccaccaauagccgcuccggcuucgagaugaucugggacccgaacggguggaccgagaccgacagcuccuuuagcgucaagcaggacaucguggccaucaccgacuggagcggcuacuccgggagcuucguccagcaucccgagcucacgggccuggacugcauccggcccugcuucuggguggagcugauccgcggccggcccaaggaguccaccaucuggaccagcggguccagcaucuccuuuugcggcgugaacagcgacaccgucgggugguccuggccggacggcgccgaggugcccuucacgaucgacaaguga

SEQ ID NO: 16401 - RNA, 1410 nt, Artificial Sequence
  derived and/or modified CDS sequence (AUadapt) from InfluenzaA__EPI5787__NA
augaaccccaaccagaagaucaucaccaucggcucgaucugcaugguggucgggaucaucucccugaugcuccagaucggcaacaucaucagcaucugggugucccacucgauccagaccgggaaccagcaccaggccgagccgugcaaccaguccaucaucacguacgagaacaacaccugggugaaccagaccuacgucaacaucagcaacaccaacuuccugacggagaaggccguggcguccgugacccuggccggcaacagcucccucugccccaucucggggugggccguccacuccaaggacaacggcauccgcaucggcagcaagggggacguguucgugauccgggagcccuucaucuccugcagccaccuggagugccgcaccuucuuccugacccagggcgcccuccugaacgacaagcacuccaacgggacggucaaggaccggucgccccaccgcacccugauguccugcccggugggcgaggcccccagccccuacaacucccgguucgagagcguggcguggucggccuccgccugccacgacgggaccagcuggcucaccaucggcaucuccggccccgacaacggggccgucgcggugcugaaguacaacggcaucaucacggacaccaucaagagcuggcgcaacaacauccugcggacccaggaguccgagugcgccugcgugaacgggucgugcuucaccgucaugacggacggcccguccaacggccaggccagcuacaagaucuucaagauggagaaggggaagguggugaaguccgucgagcucaacgcccccaacuaccacuacgaggagugcucgugcuaccccgacgccggcgagaucacgugcgugugccgcgacaacuggcacggguccaaccggcccugggugagcuucaaccagaaccuggaguaccagaucggcuacaucugcuccggggucuucggcgacaacccgcgccccaacgacggcaccgggagcugcggccccgugucccccaacggggcguacggcgugaagggguucucguucaaguacggcaacggcgucuggaucgggcggaccaaguccaccaacagccgcuccggcuucgagaugaucugggacccgaacggguggaccggcaccgacagcucguucuccgugaagcaggacaucgucgccaucaccgacuggagcggguacuccggcagcuucgugcagcaccccgagcugacgggccucgacugcauccggcccugcuucuggguggagcugauccgcgggcggcccaaggaguccaccaucuggaccucgggcuccagcaucuccuucugcggggucaacagcgacaccgugggcugguccuggccggacgacgccgagcugcccuucacgaucgacaaguga

SEQ ID NO: 16402 - RNA, 1410 nt, Artificial Sequence; identical to SEQ ID NO: 16401
  derived and/or modified CDS sequence (AUadapt) from InfluenzaA__EPI5787__NA

SEQ ID NO: 16403 - RNA, 1350 nt, Artificial Sequence
  derived and/or modified CDS sequence (AUadapt) from InfluenzaA__EPI267031__NA
augaaucccaaccagaagaucgugaccaucggcucgaucugcauggucaucgggaucgugucccugaugcuccagaucggcaacaugaucagcaucugggugucccacagcauccagaccgggaaucagcaccagacggagccgauccgcaacaccaacuuccugaccgagaacaccgucgccuccgugacgcuggccggcaacagcucccucugucccauccgggggugggcggugcacagcaaggacaacuccauccgcaucggcagcaagggcgacgucuucgugauccgggagcccuucaucuccuguagccaccuggagugccgcaccuucuuccugacccagggggcccuccugaacgacaagcauuccaacggcaccgugaaggaccggagcccccaccgcacgcugauguccugcccgaucggggaggcccccagccccuacaacucccgguuugagagcgucgccugguccgccagcgcgugccacgacggcaccagcuggcucaccaucgggaucuccggccccgacaauggcgccguggccgugcugaaguacaacgggaucaucaccgacacgaucaagagcuggcgcaacaacauccugcggacccaggaguccgagugcgccugcgucaauggcucgugcuucaccgugaugaccgacgggccguccaacggccaggcgagcuacaagaucuuuaagauggagaagggcaagguggucaaguccguggagcucaacgcccccaacuaccacuacgaggagugcagcuguuaccccgacgccggggagaucaucugcgugugccgcgacaacuggcacggcuccaaccggcccugggucaguuucaaccagaaccuggaguaccagaucggguacaucugcuccggcguguucggggauaacccgcgccccaacgacggcaagggcagcugcgggcccgugucccccaacggcgccuacggggucaagggcuucaguuucaaguacgggaacggcguguggaucggccggacgaaguccacccacagccgcuccggguucgagaugaucugggacccgaauggcuggaccgggaccgacagcgaguucuccaugaagcaggacaucguggccaucacggacuggagcggcuacagcggguccuuuguccagcaccccgagcugaccggccucgacugcauccggcccugcuucuggguggagcugauccgcggccggcccaaggagagcaccaucuggaccuccgggagcuccaucaguuucugcggcgucaacuccgacacggugagcugguccuggccggacggggcggagcugcccuucaccaucgacaaguga

SEQ ID NO: 16404 - RNA, 1350 nt, Artificial Sequence
  derived and/or modified CDS sequence (AUadapt) from InfluenzaA__EPI376539__NA
augaaucccaaccagaagaucaucaccaucggcucgaucugcauggugaucgggaucgucucccugaugcuccagaucggcaacaugaucagcaucugggugauccacuccauccagaccgggaaucagcaccaggccgagagcaucuccaacacgaacccgcugaccgagaaggccguggcgagcgucacccuggccggcaacuccagccucugucccauccgcgggugggccgugcacuccaaggacaacaacauccggaucggcagcaagggcgacguguuugucauccgcgagcccuucaucuccugcagccaccuggagugccggaccuucuuccugacgcagggggcccuccugaaugacaagcacuccaacggcaccgugaaggaccgcagcccccaccggacccugauguccuguccggugggggaggcccccagccccuacaacucccgcuucgagagcgucgcgugguccgccagcgccugccaugacggcaccagcuggcucacgaucgggaucuccggccccgacaacgaggccguggcggugcugaaguacaacggcaucaucaccgauaccaucaagagcuggcggaacgacauccugcgcacccaggaguccgagugcgccugcgucaacgggagcuguuucacggugaugaccgacggcccguccaacgggcaggccucguacaagaucuucaagauggagaagggcaagguggucaaguccguggagcucgaugcccccaacuaccacuacgaggagugcagcugcuaucccgacgccggcgagaucacgugcgugugccgggacaacuggcacggguccaaucgccccugggucagcuucaaccagaaccuggaguaccagaucggcuacaucugcuccgggguguuuggcgacaacccgcggcccaacgacgggaccggcagcugcggccccaugucccccaauggggcguacggcgugaagggguucagcuucaaguacggcaacggggucuggaucggccgcaccaaguccaccaacagucgguccggcuucgagaugaucugggacccgaacggguggaccggcaccgacagcuccuucagugugaagcaggacaucguggccaucacggacuggagcggguacuccggcagcuucguccagcaccccgagcugaccgggcucgauugcauccgccccugcuucuggguggagcugauccggggccgccccaaggaguccaccaucuggaccagcggcuccagcaucuccuucuguggggucaacagcgacacgguguccuggagcuggccggacggcgccgagcugcccuucaccaucgacaaguga

SEQ ID NO: 16405 - RNA, 1350 nt, Artificial Sequence
  derived and/or modified CDS sequence (AUadapt) from InfluenzaA__EPI124069__NA
augaaucccaaccagaagaucaucaccaucggcucgaucugcauggugaucgggaucgucucccugaugcuccagaucggcaacaugaucagcaucugggugucccacaguauccagaccgggaaccagcaccaggccgaguccaucagcaacacgaacccgcugaccgagaaggccguggcguccgucacccuggccggcaacaguucccucugccccauccgcgggugggccgugcacagcaaggacaacaacauccggaucggcuccaagggcgauguguucgucauccgcgagcccuucaucagcugcucccaccuggagugccggaccuuuuuccugacgcagggggcccuccugaacgacaagcacagcaacggcaccgugaaggaucgcagcccccaccggacccugauguccugcccggugggggaggcccccucccccuacaacagccgcuuugaguccgucgcguggagcgccagcgccugccacgacggcaccuccuggcucacgaucgggaucagcggccccgauaacgaggccguggcggugcugaaguacaacggcaucaucaccgacaccaucaaguccuggcggaacaacauccugcgcacccaggagagugagugcgccugcgucaacggguccugcuucacggugaugaccgacggcccgagugacgggcaggccuccuacaagaucuucaagauggagaagggcaagguggucaagagcguggagcucgacgcccccaacuaccauuacgaggagugcuccugcuaccccgacgccggcgagaucacgugcgugugucgggacaacuggcacgggagcaaccgccccugggucuccuucaaucagaaccuggaguaccagaucggcuacaucugcagcgggguguucggcgauaacccgcggcccaacgacgggaccggcuccugcggccccaugagccccaacggggcguauggcgugaagggguucuccuucaaguacggcaacggggucuggaucggccgcaccaagagcaccaacucccggaguggcuucgagaugaucugggacccgaacggguggaccggcaccgacuccagcuucagugugaagcaggacaucguggccaucacggacugguccggguacagcggcuccuucguccagcaccccgagcugaccgggcucgauugcauccgccccugcuucuggguggagcugauccggggccgccccaaggagagcaccaucuggaccuccggcagcuccaucagcuuuugcggggucaacuccgacacggugagcugguccuggccggacggcgccgagcugcccuucaccaucgacaaguga

SEQ ID NO: 16406 - RNA, 1350 nt, Artificial Sequence
  derived and/or modified CDS sequence (AUadapt) from InfluenzaA__EPI342499__NA
augaaucccaaccagaagaucaucaccaucggcucgaucugcauggugaucgggaucgucucccugaugcuccagaucggcaacaugaucagcaucuggaucucccacagcauccagaaggggaaccagcaccgcaccgaguccaucaguaacacgaacccgcugaccgagaaggccguggccuccgugacccugaccggcaacagcucccucugccccauccgggggugggcgguccacagcaaggacaacaauauccgcaucggcuccaagggcgacguguucgugauccgggagcccuucaucagcugcucccaccuggagugccgcacguucuuccugacccagggggcccuccugaacgauaagcacucgaacggcaccgucaaggaccggagcccccaccgcacccugauguccugcccgcucggggaggcccccucccccuacaacagucgguucgaguccguggccuggucggccagcgcgugccacgacggcacgggguggcugaccaucggcaucuccggccccgacaacgaggccguggccguccugaaguacaaugggaucaucaccgacaccaucaagagcuggcgcaacaacauccuccggacgcaggaguccgagugcgccugcgugaacggcagcugcuucaccgugaugaccgaugggccguccaacggccaggcgucguacaagaucuucaagaugcgcaagggcaaggucgugaaguccguggagcuggacgcccccaacuaccacuacgaggaguguagcugcuaccccgacaccggggagaucacgugcgucugccgggacaacuggcacggcuccaaccgccccuggaucaguuucaaccagaaccuggaguaccagaucggguacaucugcuccggcaucuucggggacaacccgcggcccaaugacggcaccggcucgugcgggcccaugucccccaacggcgccuacggggugaagggcuucagcuucaaguacgggaauggcguguggaucggccgcaccaaguccaccaacagccgguccggguucgagaugaucugggacccgaacggcuggacggagaccgacagcuccuucucggucaagcaggacaucguggccaucaccgauuggagcggguacuccggcagcuucgugcagcaccccgagcucaccgggcuggacugcauccgccccugcuucugggucgagcugauccggggccgccccaaggaguccacgaucuggaccaguggcuccagcaucuccuucugcggggugaacagcgacaccguguccuggagcuggccggacggcgccgagcuccccuucaccaucgacaaguga

SEQ ID NO: 16407 - RNA, 1350 nt, Artificial Sequence
  derived and/or modified CDS sequence (AUadapt) from InfluenzaA__EPI103069__NA
augaaucccaaccaaaagaucaucaccaucggcagcaucugcauggugaucgggaucgucucccugaugcuccagaucggcaacaugaucagcaucugggugucccacagcauccagaccgggaaucagcgccaggccgagccgaucuccaacacgaaguuccugaccgagaaggccguggcgagcgucacccuggccggcaacuccagccucugccccaucuccgggugggccguguacaguaaagacaacuccauccggaucggcagccgcggcgacguguucgucauccgggagcccuucaucuccugcagucaccuggagugccgcaccuucuuccugacgcagggggcccuccugaacgacaagcacuccaacggcaccaucaaggaucggagcccccaccgcacccugauguccugcccggugggggaggcccccagccccuacaacucccgguucgagaguguggcguggagcgccuccgccugccacgacggcaccagcuggcucacgaucgggaucuccggccccgacaacggcgccgucgcggugcugaaguauaacgggaucaucaccgacaccaucaagagcuggcgcaacaacauccugcggacccaagaguccgagugcgccugcgugaacggcaguugcuucacggucaugaccgacgggccguccagcggccaggccuccuacaagaucuucaagauggagaagggcaagguggucaagagcguggaacucgaugcccccaacuaccacuacgaggagugcuccugcuaccccgaugccggggagaucacgugcgugugccgcgacaacuggcacggcagcaaccggcccuggguguccuucaaucagaaccuggaguaccagaucggguacaucugcagcggcgucuucggggacaauccgcgccccaacgacggcaccggcuccugcgggcccgugagccccaacggcgcguacggggugaagggcuucuccuuuaaguacgggaacggcgucuggaucggccggaccaagagcaccaacucccgcagcggguucgaaaugaucugggacccgaacggcuggaccgggaccgauagcuccuucagcgugaagcaggacaucguggccaucacggacugguccggcuacagcggguccuuuguccagcaccccgagcugaccggccucgacugcauccggcccugcuucuggguggagcugauccgcggccggcccaaggagagcaccaucuggaccuccgggagcuccaucaguuucugcggcgucaacuccgacacggugagcugguccuggccggacggggccgagcugcccuucaccaucgacaaguga

SEQ ID NO: 16408 - RNA, 1350 nt, Artificial Sequence; identical to SEQ ID NO: 16384
  derived and/or modified CDS sequence (AUadapt) from InfluenzaA__EPI227595__NA

SEQ ID NO: 16409 - RNA, 1410 nt, Artificial Sequence
  derived and/or modified CDS sequence (AUadapt) from InfluenzaA__EPI569385__NA
augaaccccaaccagaagaucaucaccaucggcucggugucccugaccaucgccacggucugcuuccucaugcagaucgccauccuggcgaccaccgugacccugcacuucaagcagaacgagugcucgaucccgcccaacaaccaggugguccccugcgagcccaucaucaucgagaagaacaucacggagaucguguaccucaacaacaccaccaucgagaaggaggugugcccggagguccccgaguaccgcaacugguccaagccccagugccagaucaccggguucgcccccuucagcaaggacaacuccauccggcugucggccggcggggacaucugggugacgcgcgagccguacguguccugcucgcccggcaagugcuaccaguucgcccuggggcagggcaccacccucaacaacaagcacuccaacggcaccauccacgaccggaucccccaccgcacgcugcugaugagcgagcucgggguccccuuccaccugggcaccaagcaggucugcaucgccugguccucguccucgugccacgacgggaaggcguggcugcacgugugcgugaccggcgacgaccggaacgccaccgccuccuucaucuacgacgggaugcucgccgacagcaucggcuccuggucgcagaacauccugcgcacgcaggaguccgagugcgugugcaucaacgggaccugcaccguggucaugaccgacgggucggcgagcggccgggccgacacgcgcauccuguucaucaaggaggggaagaucgugcacaucuccccgcucucgggcuccgcccagcacaucgaggagugcucgugcuacccccgguaccccgacgugcgcugcgucugccgggacaacuggaagggcuccaaccgccccgugaucgacaucaacauggccgacuacagcaucgacuccucguacgugugcuccgggcuggucggcgacaccccgcggaacgacgacucguccagcuccucgaacugccgcgaccccaacaacgagcgggggaaccccggcgugaaggggugggccuucgacaacggcaacgacguguggaugggccgcaccaucuccgaggacucgcgguccggguacgagaccuuccgcgucacggacggcuggaccaccgcgaacagcaagucccaggugaaccggcagaucaucgucgacaacaacaacuggucgggguacucgggcaucuucuccguggagggcaagagcugcaucaaccgcugcuucuacguggagcugauccggggccgcccccaggagacccgcgucugguggacguccaacucgaucgugguguucugcggcaccuccgggaccuacggcaccgggagcuggccggacggcgccaacaucaacuucaugcccaucuga

SEQ ID NO: 16410 - RNA, 1380 nt, Artificial Sequence
  derived and/or modified CDS sequence (AUadapt) from InfluenzaA__EPI736916__NA
augaaucccaaccagaagaucacgugcaucucggccaccggcgugacccuguccgucgugucgcuccugaucgggaucgccaaccugggccucaacaucgggcugcacuacaagguguccgacaguaccaccaucuccaucccgaacaugaacgagaccaaccccacgaccaccaacaucaccaacaucaucgucaacaagaacgaggagcgcacguuccugaaccucaccaagccccugugcgaggugaauucguggcacauccuguccaaggacaacgcgauccggaucggcgaggacgcccacauccucgugacccgcgagcccuaccugucgugcgacccgcaggggugucggauguucgcccugucccagggcaccacgcuccgcggccggcacgccaacgggaccauccacgaccgcucgcccuuccgggcccugaucuccugggagaugggccaggcgcccucgcccuacaauacccgcgucgagugcaucgggugguccucgaccuccugccacgacggcaucucgcggauguccaucugcaucucggggccgaacaacaaugccuccgccguggugugguaccgcggccggcccgucacggagauccccucgugggccggcaacauccugcgcacccaggagucggagugcgugugccacaaggggaucugccccguggucaugaccgacggcccggcgaacaauaaggccgccaccaagaucaucuacuucaaggaggggaaggugcagaagaucgaggagcuccagggcaacgcccagcacaucgaggagugcuccugcuacggcgccgcggggaugaucaagugcgugugccgggauaacuggaagggcgccaaccgccccaucaucacgaucgaccccgagaugaugacccacaccucgaaguaccugugcuccaagauccugaccgacacgucgcggcccaacgauccgaccaacgggaacugcgacgcccccaucaccggcgggucccccgaccccggcgucaagggcuucgccuuccucgacggggagaacucguggcugggccgcaccaucuccaaggauucgcgguccggguacgagaugcugaaggugccgaacgccgagacggacacccagucgggccccaccuccuaccagcucaucgugaacaaccagaacuggaguggguacuccggcgcguucaucgacuacugggccaacaaggagugcuucaaccccugcuucuaugucgagcugauccgcggccggcccaaggagucggacgugcuguggaccuccaacucgaugguggcccucugcgggucccgcgagcggcugggcucgugguccuggcacgacggggccgagaucaucuacuucaaguga

SEQ ID NO: 16411 - RNA, 1380 nt, Artificial Sequence
  derived and/or modified CDS sequence (AUadapt) from InfluenzaA__EPI593891__NA
augaaucccaaccagaagaucacgugcaucucggccaccggcgugacccuguccgucgugucgcuccugaucgggaucgccaaccugggccucaacaucgggcugcacuacaagguguccgauucgaccaccaucaacuccccgaacaugaacgagaccaaccccacgaccaccaacaucaccaacaucaucgucaacaagaaugaggagcgcacguuccugaaccucaccaagccccugugcgaggugaacucguggcacauccuguccaaggacaacgcgauccggaucggcgaggaggcccauauccucgugacccgcgagcccuaccugucgugcgacccgcaggggugccggauguucgcccugucccagggcaccacgcuccgcggccggcacgccaacgggaccauccaugaccgcucgcccuuccgggcccugaucuccugggagaugggccaggcgcccucgcccuacaacacccgcgucgagugcaucgggugguccucgaccuccugucacgacggcaucucgcggauguccaucugcaucucggggccgaacaacaacgccuccgccguggugugguaucgcggccggcccgucacggagauccccucgugggccggcaacauccugcgcacccaggagucggagugcgugugccacaaggggaucugccccguggucaugaccgacggcccggcgaacaauaaggccgccaccaagaucaucuacuuccgggaggggaagauccagaagaucgaggagcuccagggcaacgcccagcacaucgaggagugcuccugcuacggcgccgcggggaugaucaagugcgccugucgcgacaacuggaagggcgccaaccggcccaucaucacgaucgaccccgagaugaugacccacaccucgaaguaccugugcuccaagauccugaccgauacgucgcgccccaacgacccgaccaacgggaacugcgacgcccccgugaccggcgggucccccgaccccggcaucaagggcuuugccuuccucgacggggagaacucguggcugggccggaccaucuccaagaacucgcgcuccggguacgagaugcugaaggugccgaacgcggagacggauacccagucgggccccaccuccuaccagcucaucgucaacaaccagaacuggucgggguacuccggcgccuucaucgauuacugggccaacaaggagugcuucaaccccugcuucuacguggagcugauccggggccgccccaaggagagugacgugcuguggaccuccaacucgauggucgcccucugcgggucccgggagcgccugggcucgugguccuggcacgacggggccgagaucaucuacuucaaguga

SEQ ID NO: 16412 - RNA, 1380 nt, Artificial Sequence
  derived and/or modified CDS sequence (AUadapt) from InfluenzaA__EPI691380__NA
augaaucccaaccagaagaucgugugcaucucggucaccggcgugacccuguccguggucucgcuccugaucgggaucacgaaccugggccucaacaucgggcugcacuacaagguguccgacucgaccaccaucaacaucccgaacaugaacgagaccaaucccacgaccaccaacaucaccaacaucaucaugaacaagaacgaggagcgcacguuccugaagcucaccaagccccugugcgaggugaacuccuggcacauccugucgaaggacaacgccauccggaucggcgaggacgcccacauccucgucacccgcgagcccuaucuguccugcgacccgcaggggugccggauguucgcgcugucgcagggcaccacgcuccgcggccagcacgccaacgggaccauccacgaccggucccccuuccgcgcccugaucucgugggagaugggccaggcccccucccccuacaacacccggguggaguguaucggguggucguccaccucgugccacgacggcaucucccgcaugucgaucugcaucuccgggccgaacaacaacgccucggcgguggucugguaccggggccgccccgugacggagauccccuccugggccggcaacauccugcggacccaggagagugagugcgugugccacaaggggaucugccccgucgugaugaccgacggcccggccaacaacaaggccgcgaccaagaucaucuacuucaaggaggggaagauccagaagacggaggagcuccagggcaacgcccagcacaucgaggagugcucguguuacggcgccgccgggaugaucaagugcgugugccgcgacaacuggaagggcgccaaccggcccaucaucaccaucgaccccgagaugaugacccacaccuccaaguaccugugcucgaagauccugacggacaccucccgccccaacgauccgaccaacgggaacugcgacgcgcccaucaccggcgggucgcccgaccccggcgucaagggcuucgccuuccucgacggggagaacuccuggcugggccggacgaucucgaaggacucccgcucgggguaugagaugcugaaggugccgaacgccgagaucgacauccaguccggccccaucucguaccagcucguggucaacaaccagaacugguccggguacucgggcgccuucaucgacuacugggccaacaaggaguguuucaaccccugcuucuacguggagcugauccggggccgccccaaggaguccggggugcuguggaccucgaacuccauggucgcgcucugcggcucgcgggagcgccugggguccuggucguggcacgacggcgccgagaucaucuacuucaaguga

SEQ ID NO: 16413 - RNA, 1413 nt, Artificial Sequence
  derived and/or modified CDS sequence (AUadapt) from InfluenzaA__EPI533584__NA
augaaucccaaccagaagaucacgugcaucucggccaccggcaugacccuguccguggucucgaugcucaucgggaucgccaaccugggccugaacaucgggcuccacuacaagguguccgacucgaccaacaucaacaucccgaacaugaacgagaccucccccaccacgaccaucaucaacaaccacccccagaacaauuucaccaacaucaccaacaucaucgugacgaagaacgaggagggccaccuccugaaccugaccaagccccugugcgaggucaacucguggcacauccuguccaaggacaacgcgauccgcaucggggaggacgcccacaucaucgugacccgggagccguaccucucgugcgacccccagggcugucgcauguucgcccugucccagggcaccacgcugcgggggaagcacgccaacggcaccauccacgaccgcucgcccuuccgggcccucguguccugggagauggggcaggcgcccucgccguacaacacccgcgucgagugcaucggcugguccucgaccuccugccacgacgggaucucgcggauguccaucugcaucucgggccccaauaacaacgccuccgccguggugugguacggcgggcgccccgucacggagauccccucgugggccggcaacauccugcggacccaggagucggagugcgugugccacgggggcaucugcccgguggucaugaccgacggccccgcgaacaaccgcgccgagaccaagaucaucuacuucaaggaggggaagaucaagaagaucgaggagcugaagggcgacgcccagcacaucgaggagugcuccuguuacggggccucggagaugaucaagugcaucugccgggacaacuggaagggcgccaaccgccccgugaucacgaucgaccccgagaugaugacccacaccuccaaguaccucugcucgaagauccugaccgacacgucccggccgaacgaccccaccaacgggaagugcgaggcgcccaucaccggcggcucgcccgauccgggggugaagggcuucgccuuccuggacggggagaacuccuggcucggccgcaccaucucgaaggacucccggucgggguacgagaugcugaagguccccaacgccgagacggacacccaguccggcgccaucucgcaccagaucaucgugaacaaccagaacugguccggcuacucgggggccuucaucgauuacugggcgaacaaggagugcuucaaccccugcuucuacguggagcugauccgcggccggcccaaggaguccucgguccucuggaccuccaacucgaucguggcccugugcggguccaaggagcgccugggcucguggucguggcacgacggggccgagaucaucuacuucaaguga

SEQ ID NO: 16414 - RNA, 1380 nt, Artificial Sequence
  derived and/or modified CDS sequence (AUadapt) from InfluenzaA__EPI641400__NA
augaaucccaaccagaagaucacgugcaucucggccaccggcgugacccuguccgucgugucgcuccugaucgggaucgccaaccugggccucaacaucgggcugcacuacaagguguccgacaguaccaccaucaacaucccgaacaugaacgagaccaaccccacgaccaccaacaucaccaacaucaucgucaacaagaacgaggagcgcacguuccugaaccucaccaagccccugugugaggugaacuccuggcacauccugucgaaggacaacgcgauccggaucggcgaggacgcccacauccucgugacccgcgagcccuaccuguccugcgacccgcaggggugucggauguucgcccugucgcagggcaccacgcuccgcggccggcacgccaacgggaccauccacgacaagucccccuuccgcgcccugaucucgugggagaugggccaggcgcccucccccuacaauacccgggucgagugcaucggguggucguccaccucgugccacgacggcaucucccgcaugucgaucugcaucuccgggccgaacaacaaugccucggccguggugugguaccggggccgccccgucacggagauccccuccugggugggcaacauccugcggacccaggagucggagugcgugugccacaaggggaucugccccgucgugaugaccgacggcccggccaacaauaaggcggccaccaagaucaucuacuucaaggaggggaagauccagaagaucgaggagcuccagggcaacgcccagcacaucgaggagugcucgugcuacggcgccgccgggaugaucaagugcgugugucgcgacaacuggaagggcgcgaaccggcccaucaucacgaucgaccccgagaugaugacccacaccuccaaguaccugugcucgaagauccugaccgacacgucccgccccaacgauccgaccaacgggaacugcgacgagcccaucaccggcgggucgcccgaccccggcgucaagggcuucgccuuccucgacggggagaacuccuggcugggccggaccaucaguaaggacucccgcucgggguacgagaugcugaaggugccgaacgccgagacggacacccaguccggccccaccucguaccagcucaucgugaacaaccagaauugguccggguacucgggcgccuucaucgacuacugggccaacaaggagugcuucaaccccugcuuuuacgucgagcugauccggggccgccccaaggagaucgacgugcugugggcguccaacucgaugguggcccucugcgggucccgggagcgccugggcucgugguccuggcacgacggggccgagaucaucuacuucaaguga

SEQ ID NO: 16415 - RNA, 1380 nt, Artificial Sequence; identical to SEQ ID NO: 16414
  derived and/or modified CDS sequence (AUadapt) from InfluenzaA__EPI587620__NA

SEQ ID NO: 16416 - RNA, 1410 nt, Artificial Sequence
  derived and/or modified CDS sequence (AUadapt) from InfluenzaA__EPI569392__NA
augaaucccaaccaaaagaucgugaccaucggcagccugucccucgggcuggucguguucaacgugcugcuccacgccgucagcaucauccugaccgugcuggcccucggcaaguccgagaacaacgggaucugcaacggcacggugguccgcgaguacaacgagaccgugcggaucgagaaagugacccagugguacaauaccagcgucguggaguacgugccgcacuggaacgaggggacguacaucaacaacaccgagcccaucugcgacgucaagggcuucgcgcccuucuccaaggacaacggcauccgcguggggagucggggccacaucuucgugauccgcgaacccuucgucuccugcagcccgguggggugccggaccuucuuccugacccagggcucccugcucaacgacaagcacagcaacgggacggugaaggaucgcucccccuuccggacccugaugagcgucgaggugggccagucccccaacguguaccaggcccgcuucgaagccgucgccuggagcgccaccgcgugccacgacggcaagaaguggauggccaucggggugaccggccccgacuccaaggccguggccgucgugcacuacgggggcgucccgacggacguggugaauagcugggcgggcgacauccugcggacccaggaguccagcugcacgugcauccaggggaacugcuacugggucaugaccgacggccccgccaaccgccaggcccaauaccggaucuacaaggccaaccaggggaagaucaucggccgcaaggauguguccuucagcgggggccacaucgaggagugcagcugcuaccccaacgacggcaaaguggagugcgucugccgggacaacuggaccgggaccaaucgccccgugcucaucaucuccccggaccugagcuaccgggugggcuaccugugcgccgggcuccccuccgacacgccccgcggcgaggacacccaguucgucgggagcugcaccucccccaugggcaaccagggcuacggggugaagggcuucggguuucggcagggcaccgacgugugggucgggcgcaccaucagccggaccucccgcagcggcuucgaaaucauccggaucaagaacggcuggacgcagaccuccaaggagcagauccgccgccaggugguggucgacaacagcaacugguccggguacagcggcuccuucacccugccgguggaacugagcgggcgggagugucucgugcccugcuucugggucgagaugauccgcggccggcccgaggagcgcaccaucuggacguccagcuccagcaucgugaugugcggcguggacuacgagaucgcggacugguccuggcacgacggggccauccugcccuucgacaucgacaaguga

SEQ ID NO: 16417 - RNA, 1368 nt, Artificial Sequence
  derived and/or modified CDS sequence (AUadapt) from InfluenzaA__EPI459857__NA
augaaucccaaccagaagaucaucaccaucggcucgaucugcauggugaucgggaccgucucccugaucguccaggugggcaacaucauccucaucugggugaaccacagcauccagacgugcaucaccuacgagaacaacaccugggugaaccagaccuacguguccaacacgaacuuccugaccgggcaggccgucgccagcgugacccuggcgggcaacuccucgcucugcccgaucuccgggugggccaucuacagcaaggacaacggcauccgcaucggcuccaagggggacguguucgucauccgggagcccuucaucagcugcucccaccuggagugccgcaccuucuuccugacgcagggcgcccuccugaaugacaagcacagcaacgggaccaucaaggaccggucccccuaccgcacccugaugucgugccccgugggcgaggccccgucccccuacaacagccgguucgaguccguggccuggagcgcguccgccugccacgacgggaucaacuggcucaccaucggcaucagcggccccgacaacgaggccgucgccgugcugaaguacaacggggugaucacggacaccaucaagucguggcgcaacaacauccugcggacccaggaguccgagugcgcgugcgucaacggcagcugcuucaccgugaugacggacgggcccuccaacggccaggccaguuacaagaucuucaagaucgagaagggcaaggugguccgcuccguggagcucgacgccccgaacuaccacuacgaggagugcucgugcuaccccgacgccggggagaucacgugcgugugccgggacaacuggcacggcuccaaccgccccugggucagcuucaaccagaaccuggaguaccagaccggguacaucugcuccggcguguucggggacagcccccggccgaacgacggcaccggcuccugcgggcccgugagcuccaacggcgccuuuggggucaagggcuucucguucaaguacgggaacggcguguggaucggccgcaccaagaccaccaacucccggagcggguucgagaugaucugggaccccaacggcuggaccgagacggacuccagcuucuccaugaagcaggacaucaucgcgaucaccgacuggagcggguacucgggcuccuucguccagcaccccgagcugaccgggcucaacugcaugcgcccgugcuucuggguggagcugauccggggccagccccgcgagaacaccaucuggacgagcggcuccagcaucuccuucugcggggugaacagcgagaccgucggcugguccuggcccgacggggccgagcugcccuucaccaucgacaaguga

SEQ ID NO: 16418 - RNA, 1416 nt, Artificial Sequence
  derived and/or modified CDS sequence (AUadapt) from InfluenzaA__EPI242204__NA
augaaucccaaccagaagcuguucgcccucucgggcguggccaucgcgcuguccguccugaaccuccugaucgggaucucgaacgugggccugaacgugucccuccaccugaagggggagggcgucaagcaggagaacaaccugaccugcaccacgaucacccagaacaacaccaccgugguggagaacacguacgucaacaacaccaccaucaucaacaaggggaccaaccucaaggccccgaacuaccugcugcucaacaagucgcugugcuccguggagggcuggguggucaucgccaaggacaacgccauccgcuucggcgagucggagcagaucaucgugacgcgggagcccuacguguccugcgaccccucggggugcaagauguaugcccugcaccagggcaccaccauccgcaacaagcacuccaacgggaccauccacgaccggacgaccuuccgcggccucaucucgacgccccuggggaccccgcccaccgucuccaacucggacuucaucugcgugggcugguccucgaccuccugccacgacggcguggggcggaugaccaucugcauccagggcaacaacgacaacgcgaccgccacggucuacuacaaccgccggcugaccaccaccaucaagacgugggccaagaacauccuccgcacccaggagucggagugcgugugccacaacgggaccugcgccguggucaugaccgacggccccgcguccagucaggccuacacgaagaucauguacuuccacaagggccugaucaucaaggaggagccccugcggggguccgcccgccacaucgaggagugcucgugcuacggccacgaccagaaggugucgugcgugugccgggacaacuggcagggggccaaccgcccgaucaucgagaucgacauguccacccucgagcacaccucgcgguacgucugcaccggcgugcugacggacaccucccgccccggggacaagcccaacggcgacugcucgaaccccaucaccggcuccccgggggcccccggcgugaagggguucggcuuccugaacggggacaauaccuggcucggccggacgaucucgccccgcucccggucgggcuucgagaugcugaagauccccaacgcggagaccgacccgaacucccgcaucaucgagcggcaggagaucgucgacaacucgaacugguccggguacucgggcuccuucaucgacuacugggacgaggccaacgagugcuacaaccccugcuucuacguggagcugauccgcgggcggcccgaggaggccaaguacgucugguggaccucgaacucccucaucgcccugugcggcucgcccguguccguggggucgggcuccuucccggacggcgcccagauccaguacuucucguga

SEQ ID NO: 16419 - RNA, 1416 nt, Artificial Sequence
  derived and/or modified CDS sequence (AUadapt) from InfluenzaA__EPI408029__NA
augaaucccaaccagaagcuguucgcccucucgggcguggccaucgcgcuguccguccugaaccuccugaucgggaucucgaacgugggccugaacaugucccuccaccugaagggggagggcgugaagcaggagaacaaccugaccugcaccacgaucacccagaacaacaccaccgucguggagaacacguacgugaacaacaccaccaucaucaacaaggggaccaaccucaaggccccgaacuaccugcugcucaacaagucgcugugcuccgucgagggcuggguggugaucgccaaggacaacgccauccgcuuuggcgagucggagcagaucaucgucacgcgggagcccuacguguccugcgaccccucggggugcaagauguacgcccugcaccagggcaccaccauccgcaacaagcacuccaacgggaccauccacgaccggacgaccuuccgcggccuccugucgacgccccuggggaccccgcccaccguguccaacucggacuucaucugcgucggcugguccucgaccuccugccacgacggcguggggcggaugaccaucugcauccagggcaacaaugacaacgcgaccgccacgguguacuacaaccgccggcucaccaccaccaucaagacgugggccaagaacauccugcgcacccaggagucggagugcgucugccacaacgggaccugcgccguggugaugaccgacggccccgcguccucgcaggccuacacgaagaucauguacuuccacaagggccugaucaucaaggaggagccccuccggggguccgcccgccacaucgaggagugcucgugcuacggccacgaccagaaggucucgugcgugugucgggacaacuggcagggggccaaccgcccgaucaucgagaucgacauguccacccuggagcacaccucgcgguacgugugcaccggcguccugacggacaccucccgccccggggacaagcccaacggcgacugcucgaaccccaucaccggcuccccgggggcccccggcgugaagggguucggcuuccucaacggggacaacaccuggcugggccggacgaucucgccccgcucccggucgggcuucgagaugcugaagauccccaacgcggagaccgacccgaacucccgcaucaucgagcggcaggagaucguggauaacucgaaccgcuccggguacucgggcuccuucaucgacuacugggacgaggccaacgagugcuacaaccccugcuucuacgucgagcucauccgggggcgccccgaggaggccaaguacgugugguggaccucgaacucccugaucgcccugugcggcucgcccgucuccguggggucgggcuccuucccggacggcgcccagauccaguacuucucguga

SEQ ID NO: 16420 - RNA, 1398 nt, Artificial Sequence; identical to SEQ ID NO: 16294
  derived and/or modified CDS sequence (AUadapt) from InfluenzaA__EPI439509__NA

SEQ ID NO: 16421 - RNA, 1350 nt, Artificial Sequence; identical to SEQ ID NO: 16396
  derived and/or modified CDS sequence (AUadapt) from InfluenzaA__EPI164223__NA

SEQ ID NO: 16422 - RNA, 1398 nt, Artificial Sequence; identical to SEQ ID NO: 16294
  derived and/or modified CDS sequence (AUadapt) from InfluenzaA__EPI486493__NA

SEQ ID NO: 16423 - RNA, 1398 nt, Artificial Sequence
  derived and/or modified CDS sequence (AUadapt) from InfluenzaA__EPI740737__NA
augaaucccaaccagaagauccugugcaccucggccaccgccaucacgaucuccgcgaucgccgugcucaucggcaucgccaaccuggggcugaacaucggccuccaccugaagccggggugcaacugcucgcacucccagcccgagaccaccaacaccucgcagacgaucaucaauaacuacuacaacgagaccaacaucaccaacauccagaucgaggagcgcaccucccggaacuucaacaaccugacgaagggccucugcaccaucaacucguggcauaucuacgggaaggacaacgccguccgcaucggcgaguccucggacgugcuggugacccgggagcccuacgucuccugcgaccccgacgagugccgcuucuacgcccugucgcagggcaccacgauccgggggaagcauuccaacggcaccauccacgaccgcucgcaguaccgggcgcucaucuccuggccgcugucguccccgcccaccgugcacaacucgcgcguggagugcaucgggugguccucgaccuccugccacgauggcaagucgcggaugucgaucugcaucuccgggcccaacaacaacgccucggccgucgugugguacaaccgccggcccguggccgagaucaacacgugggcgcgcaacauccugcggacccaggaguccgagugcgucugccacaauggcgugugccccguggucuucaccgacggccccgccaccgggcccgccgacacgcgcaucuacuacuucaaggagggcaagauccucaagugggagucgcugaccgggaccgccaagcacaucgaggagugcuccugcuacggcgagcggaccggcaucacgugcacgugucgcgacaacuggcaggggucgaaccggccgguggugcagaucgaccccgucgccaugacccacaccucccaguacaucugcucgcccgugcugaccgacucgccccgcccgaacgaccccaauaucggcaagugcaacgaccccuaccccgggaacaacaacaacggcgugaagggguucuccuaccucgacggcgcgaacaccuggcugggccggaccaucuccaccgccucgcgcuccggguaugagaugcugaaggucccgaacgcccucacggacgaccggucgaagcccauccagggccagaccaucgugcugaacgccgacugguccggguacucgggcuccuucauggacuacugggccgagggggacugcuaucgcgcgugcuucuacguggagcugauccgcggccggcccaaggaggacaaggucugguggaccucgaacuccaucgugucgaugugcucguccaccgaguuccucggccaguggaacuggcccgacggggccaagaucgaguacuuccuguga

SEQ ID NO: 16424 - RNA, 1398 nt, Artificial Sequence
  derived and/or modified CDS sequence (AUadapt) from InfluenzaA__EPI730494__NA
augaaucccaaccagaagauccugugcaccucggccaccgccaucacgaucggcgcgaucgccgugcucaucgggaucgccaaccugggccugaacaucgggcuccaccugaagccgggcugcaacugcucccacucgcagcccgagaucaccaacaccucccagaccaucaucaacaacuacuacagugagacgaacaucaccaacauccagauggaggagcgcaccuccaagaacuucaacaaccugaccaaggggcucugcacgaucaacucguggcacaucuacggcaaggacaacgccguccggaucggcgaguccucggacgugcuggugacccgcgagcccuacgucuccugcgaucccgacgagugccgguucuacgcccugucgcaggggaccaccauccgcggcaagcacuccaacgggacgauccacgaccggucgcaguaccgcgcgcucaucuccuggccgcugucguccccgcccaccguguacaacucgcggguggagugcaucggcugguccucgaccuccugucacgacggcaagucgcgcaugucgaucugcaucuccgggcccaacaacaacgccucggccgucgugugguacaaccggcgccccguggccgagaucaacaccugggcgcggaacauccugcgcacgcaggaguccgagugcgucugccacaacggcgugugucccguggucuucaccgacgggucggccaccggccccgccgacacccggaucuacuacuucaaggaggggaagauccucaagugggagucccugacgggcaccgccaagcacaucgaggagugcucgugcuacggcgagcgcaccgggaucacgugcacgugccgggacaacuggcagggcuccaaucgccccgugauccagaucgacccgguggccaugacccacaccucgcaguacaucugcucccccguccugaccgacaacccccggcccaacgacccgaacaucgggaagugcaacgaccccuaccccggcaacaacaacaaugggaucaagggcuucucguaccucgacggcgcgaacaccuggcuggggcgcaccaucuccaccgccucgcgguccggcuacgagaugcugaaggugcccaacgcccucaccgacgaccgcucgaagccgauccaggggcagacgaucgugcugaacgccgacugguccggcuacucgggguccuucauggacuauugggccgagggcgacugcuaccgggcgugcuucuacgucgagcugauccgcggccgccccaaggaggacaaggugugguggaccucgaacuccaucgugucgaugugcucguccaccgaguuccucgggcaguggaacuggcccgacggcgccaagaucgaguacuuccuguga

SEQ ID NO: 16425 - RNA, 1398 nt, Artificial Sequence
  derived and/or modified CDS sequence (AUadapt) from InfluenzaA__EPI712925__NA
augaaucccaaccagaagauccugugcaccucggccaccgccaucacgaucggcgcgaucgccgugcucaucgggaucgccaaccugggccugaacaucgggcuccaccugaagccgggcugcaacugcucccacucgcagcccgagaccaccaauaccucccagacgaucaucaacaacuacuacaacgagaccaacaucaccaacauccagaucgaggagcgcaccucgcggaacuucaacaaccugacgaaggggcucuguaccaucaacuccuggcacaucuacggcaaggacaacgccguccgcaucggcgagucguccgacgugcuggugacccgggagcccuacgucucgugcgaccccgacgagugucgcuucuacgcccugucccaggggaccacgauccggggcaagcacucgaacgggaccauccacgaccgcucccaguaccgggcgcucaucucguggccgcuguccucgccgcccaccgugcacaacucccgcguggaguguaucggcuggucguccaccucgugccacgacgggaagucccggaugucgaucugcaucucgggccccaacaacaacgccuccgccgucgugugguacaaucgccggcccguggccgagaucaacacgugggcgcgcaacauccugcggacccaggagucggagugcgucugccacaacggcgugugccccguggucuucaccgacgggcccgccaccggccccgccgacacgcgcaucuacuauuucaaggaggggaagauccucaagugggagucccugaccggcaccgccaagcacaucgaggagugcucgugcuacggcgagcggaccgggaucacgugcacgugccgcgacaacuggcagggcuccaaccggccgguggugcagaucgaccccgucgccaugacccauaccucgcaguacaucugcucccccgugcugaccgacucgccccgcccgaacgaccccaacaucgggaagugcaacgaccccuaccccggcaauaacaacaacggggugaagggcuucuccuaccucgacggcgcgaacaccuggcuggggcggaccaucucgaccgccucccgcucgggcuacgagaugcugaaggucccgaacgcccucacggacgaucgguccaagcccauccaggggcagaccaucgugcugaacgccgacuggucgggcuacuccgggucguucauggacuacugggccgagggcgacugcuaccgcgcgugcuuuuacguggagcugauccgcggccggcccaaggaggacaaggucugguggaccuccaacucgaucguguccaugugcucgucgaccgaguuccucgggcaguggaacuggcccgacggcgccaagaucgaguacuuccuguga

SEQ ID NO: 16426 - RNA, 1398 nt, Artificial Sequence
  derived and/or modified CDS sequence (AUadapt) from InfluenzaA__EPI448938__NA
augaaucccaaccagaagauccugugcaccucggccaccgccaucaucaucggcgcgaucgccgugcucaucgggauggccaaccugggccugaacaucgggcuccaccugaagccgggcugcaacugcucccacucgcagcccgagacgaccaacaccucccagaccaucaucaacaacuauuacaacgagacgaacaucaccaacauccagauggaggagcgcaccucgcggaacuucaacaaccugaccaaggggcucugcacgaucaacuccuggcacaucuacggcaaggacaacgccguccgcaucggcgagaguuccgacgugcuggugacccgggagcccuacgucucgugcgaccccgacgagugccgcuucuacgcccugucccaggggaccaccauccggggcaagcacucgaacgggacgauccacgaccgcucccaguaccgggcgcucaucaguuggccgcuguccucgccgcccaccguguacaacucccgcguggagugcaucggcuggucguccaccucgugccacgacgggaagucccggaugucgaucugcaucucgggccccaacaacaacgccuccgccgucgugugguauaaccgccggcccguggccgagaucaacaccugggcgcgcaacauccugcggacgcaggagucggagugcgucugccacaacggcgugugccccguggucuucaccgacggguccgccaccggccccgccgacacccgcaucuacuacuucaaggaggggaagauccucaagugggagagucugacgggcaccgccaagcacaucgaggagugcuccugcuacggcgagcggaccgggaucacgugcacgugccgcgacaacuggcagggcucgaaccggcccgugauccagaucgacccgguggccaugacccacaccucccaguacaucugcucgcccguccugaccgauaacccccgccccaacgacccgaacaucgggaagugcaacgaccccuaccccggcaacaacaacaacggggugaagggcuucuccuaccucgacggcgcgaauaccuggcuggggcggaccaucucgaccgccucccgcucgggcuacgagaugcugaaggugcccaacgcccucaccgacgaccgguccaagccgauccaggggcagacgaucguccugaacgccgacuggucgggcuacuccgggucguucauggacuacugggccgagggcgacuguuaccgcgcgugcuucuacguggagcugauccgcggccggcccaaggaggacaaggugugguggaccuccaacucgaucgucuccaugugcucgucgaccgaguuccucgggcaguggaacuggcccgacggcgccaagaucgaguacuuccuguga

SEQ ID NO: 16427 - RNA, 1410 nt, Artificial Sequence
  derived and/or modified CDS sequence (AUadapt) from InfluenzaA__EPI445995__NA
augaaucccaaccagaagaucaucgcccugggcucggccucccucaccaucgcgaucaucugccugcugauccagaucgccauccucgccaccacgaugacccugcacuucaugcagaacgagcacaccaacucgacccgcaacaagguggucccgugcgaguccaucaucaucgagcggaacaucacggagaucgugcaccugaacgggaccaucaucgagaaggagagcugccccaaggccguggaguacaagaacugguccaagccccagugccagaucaccggcuucgcccccuucucgaaggacaacuccauccgccucagcgccgggggcgacaucugggucacccgggagccguacguguccugcucgcuguccaagugcuaccaguucgcgcuggggcagggcacgacccucaacaaccgccacagcaacggcaccacccacgaccggucccccuaccgcacgcugcugaugucggagcucggggugcccuuccaccugggcaccaagcaggucugcaucgccugguccaguuccucgugccacgacgggcgggccuggcugcacgugugcgugaccggcgacgacaagaacgcgaccgccuccgucaucuacgggggcaugcucacggacagcaucggcucgugguccaagaacauccugcgcacccaggagagcgagugcgugugcaucaacgggaccugcaccguggucaugacggacggcuccgccucggggcgggccgacacccgcauccuguucauccgggagggcaagaucgugcacaucagcccccucuccggcuccgcccagcacguggaggagugcucgugcuacccgcgcuaccccgagguccggugcgugugccgcgacaacuggaagggguccaaccggcccgugcuguacaucaacgucgcggacuacagcaucgacuccucguacgugugcuccggccuggugggggauacgccccgcaacgaggacagcuccucguccagcaacugccgggacccgaacaacgagcgcggcgggcccggcgucaagggcugggccuucgacaacggggacgacguguggaugggccggaccaucaagaaggacucccgcgccggguacgagaccuuccggguggucgacggcuggacccucgccaacucgaagagccagaccaaccgccaggugaucgucgacuccgacaacuggucgggguacuccggcauguucagcguggagggcaagaccugcaucaaccgcugcuucuacguggagcugauccgggggcgcccccaggagacgcgggucugguggaccuccaacucgaucaucguguucugcggcaccuccgggaccuacggcacggggagcuggcccgacggcgccgacaucaacuucauguccaucuga

SEQ ID NO: 16428 - RNA, 1410 nt, Artificial Sequence
  derived and/or modified CDS sequence (AUadapt) from InfluenzaA__EPI470861__NA
augaaccccaaccagaagaucaucgccaucggcucggugucccugaccaucgccaccaucugccuccugaugcagaucgcgauccuggccacgaccaugacccuccacuucaagcagaacgagugcaucaacucguccaacaaccaggucgugccgugcgagcccaucaucaucgagcgcaacaucaccgagaucgugcaccugaacucgacgacccuggagaaggagaucugccccaaggucgccgacuaccggaacugguccaagccccagugccagaucaccggguucgccccguucucgaaggacaacuccauccgccucagcgccggcggggacaucugggugacccgggagcccuacguguccugcggccuggggaagugcuaccaguucgcgcugggccagggcacgacccucgagaacaagcacucgaacgggaccgcccacgaccgcacgccccaccggacccugcugaugaacgagcucggcguccccuuccaccuggccaccaagcaggucugcaucgccugguccucguccucgugccacgacgggaaggcguggcugcacgugugcgugaccggcgacgaccgcaacgccaccgccuccaucaucuacgacgggauccucguggacagcaucggcuccuggucgaagaacauccugcggacgcaggaguccgagugcgugugcaucaacgggaccugcgccgucgugaugaccgacggcucggccucgggccgcgcggacacccggauccuguucauccgcgaggggaagaucgcccacaucuccccgcucagcggcuccgcccagcacguggaggagugcucgugcuacccccgguaccccgagguccgcugcgugugccgggacaacuggaagggcuccaaccgccccgugcuguacaucaacauggccaacuacucgaucgacuccucguacgucugcuccgggcuggugggcgacacgccgcggaacgacgaccgcucguccagcuccaacugccgggaccccaacaacgagcgcggggcccccggcgugaaggggugggcguucgacaacggcaacgacaucuggaugggccggaccaucaagaaggacucgcgcuccggguacgagaccuuccgggucaucggcggguggaccacggccaacucgaagucccagaucaaccgccaggugaucguggacucggacaacuccagcggcuacucggggaucuucuccgucgagggcaagucgugcaucaaccgcugcuucuacguggagcucauccggggccgccccaaggagacccgggucugguggaccuccaacucgaucaucguguucugcgggaccuccggcacguacgggaccggcagcuggccggacggggccaacaucaacuucaugcccaucuga

SEQ ID NO: 16429 - RNA, 1401 nt, Artificial Sequence
  derived and/or modified CDS sequence (AUadapt) from InfluenzaA__EPI498036__NA
augaaccccaaccagaagaucaucgccaucggcucggugucccugaucaucgccaucaucugccuccugaugcagaucgcgauccugaccaccacgaugacccuccacuuccgccagaacgagugcucgaacccguccaacaaccaggucaugcccugcgagcccaucauccuggagcggaacaccgugcaccugaacagcaccaucaucgagcgcgagaucugccccaagguggccgacuacaagaacugguccaagccgcagugccagaucacgggguucgcccccuucucgaaggacaacuccauccggcucucggccggcggggacaucugggucacccgcgagcccuacguguccugcagccuggacaagugcuaccaguucgcccugggccaggggaccacccucaagaacaagcacuccaacggcacgacccacgaccggacgccccaccgcacccugcugaugaacgagcucggcgugccguuccaccuggggaccaagcaggucugcaucgcguggucguccagcuccugcuacgacggcaaggccuggcugcacaucugcgugaccggggacgacaagaacgccaccgccucgaucaucuacgacggcaugcucguggacuccaucgggucgugguccaagaacauccugcggacccaggagagcgagugcgucugcaucaacggcacgugcgcgguggugaugaccgacggcucggccuccgggaaggccgacacccgcguccuguucauccgggagggcaagaucaucaacaucagcccccucuccgggucggcccagcacguggaggagugcuccugcuacccccgcuaccccgaggugcggugcgucugccgcgacaacuggaagggcucgaaccggccgauccuguacaucaacauggccgacuacuccaucgagagcuccuacgugugcucgggccuggugggggacacgccccgcaacgacgacuccucguccagcuccaacugccgggaccccaacaacgagcgcggcgcgcccggggucaagggcugggccuucgacgacgggaacgacguguggaugggccggaccaucaagaacggcucgcgcuccggguacgagaccuuccggguggucaacggcuggaccauggccaacagcaagucccagaucaaccgccaggugaucguggacucggacgacuggucgggguacuccggcaucuucagcgucgaggggaagaagugcaucaaccggugcuucuacguggagcucauccgcggccgcccgcaggagccccgggucugguggaccuccaacucgaucaucguguucugcggcacguccgggaccuacggcaccgggagcuggcccgacggcgccaacaucaacuucaugcccguguga

SEQ ID NO: 16430 - RNA, 1410 nt, Artificial Sequence
  derived and/or modified CDS sequence (AUadapt) from InfluenzaA__EPI470902__NA
augaaucccaaccagaagaucguggccaucggcucggccucccugaccaucgcgaccaugugccuccugaugcagaucgcccuguucgccacgaccaugacccuccacuucaagcagaccgggugcacgaacagcuccgacaaccaggccgucccgugcggccccaucaucaucgagcgcaacaucaccgagaucgugcaccugaauucgaccacccuggagaaggagacgugccccaaguccgccggguaccggaacuggagcaagccccagugccagaucaccggcuucgcgccguucuccaaggacaacucgauccgccucgccgccgccggggacaucugggugacccgggagcccuacgucuccugcggccugggcaaguguuaccaguucgcgcuggggcagggcaccacgcucgacaacaagcacagcaacgggaccacccacgaccgcacgccccaccggacccugcugaugaacgagcucggcgugcccuuccaccuggccaccaagcaggucugcaucgccugguccucguccaguugccacgacgggaaggccuggcugcacgugugcgugaccggcgacgacaagaacgccaccgcguccaucaucuacgacggcauccucguggacucgaucgccuccuggagcaagaacauccugcgcacgcaggaguccgagugugucugcaucaacgggaccugcaccguggugaugaccgacggcucggccagcgggcgggccgacacgcgcauccuguucauccgggagggcaagaucguccacaucuccccgcucucgggcuccgcccagcacguggaggagugcagcugcuauccccgcuaccccgaggugcggugcgucugccgcgacaacuggaagggguccaaccggcccgugcuguucaucaacauggcggacuacucgaucgacuccagcuacgugugcuccggccuggucggggauaccccgcgcaacgacgaccggucguccagcuccaacugccgcgaccccaacaacgagcggggcgcccccggggugaagggcugggccuucgacucgggcaacgauaucuggauggggcgcaccaucgagaaggacucccggagcggcuacgagaccuuccgcgugaucgggggcugguccacggccaacucgaagucccagaucaaccggcaggucaucguggaccgcgacaacagcucgggguacuccggcaucuucaguguggagggcaaguccugcaucaaccgcugcuucuacgucgagcucauccgggggcgccccaaggagaaccgggugugguggaccucgaacuccaucaucgucuucugcggcaccagcgggaccuacggcacgggguccuggccggacggcgccaacaucaaccugaugcccaucuga

SEQ ID NO: 16431 - RNA, 1401 nt, Artificial Sequence
  derived and/or modified CDS sequence (AUadapt) from InfluenzaA__EPI838241__NA
augaaccccaaccagaagaucaccgccaucggcucggugucccugaucaucgccaucaucugccuccugaugcagaucgcgauccugaccacgaccaugacccuccacuuccgccagaacgagugcucgaacuccagcaacaaccaggucaugccgugcgagcccaucaucaucgagcggaacaccgugcaccugaacuccacgaccaucgagcgcgagaucugccccaagguggccgaguacaagaacuggucgaagccccagugccagaucaccggguucgccccguucuccaaggacaacucgauccggcuguccgccagcggcgacaucugggucacccgcgagcccuacguguccugcucgcucgacaagugcuaccaguucgcccuggggcagggcacgacccugaagaacaagcacuccaacgggaccgcgcacgaccggacgccccaccgcacccuccugaugaacgagcugggcgugcccuuccaccucggcaccaagcaggucugcaucgccuggucguccagcuccugcuacgacgggaaggccuggcugcacgugugcgugaccggcgacgacaagaacgccaccgcgucgaucaucuacgacgggaugcuggucgacuccaucggcagcuggucgaagaacauccuccggacgcaggaguccgagugcgugugcaucaacgggaccugcgccguggucaugaccgacggcucggccuccggcaaggccgacacccgcgugcuguucauccgggaggggaagaucaucaacaucagcccgcuguccggcucggcccagcacguggaggagugcuccugcuacccccgcuaccccgagguccggugcgugugccgcgacaacuggaaggggucgaaccggcccauccucuacaucaacauggcggacuacuccaucgagagcuccuacgugugcucgggccuggucggcgacacgccgcgcaacgacgacuccagcuccucguccaacugccgggaccccaacaacgagcgcggggcccccggcgugaaggggugggccuucgacgacggcaacgacguguggauggggcggaccaucaagaacggcucgcgcuccggcuacgagaccuuccgggucgugaacggguggaccauggccaacagcaagucgcagaucaaccgccaggugaucgucgaguccgacgacuggucgggcuacuccgggaucuucagcguggagggcaagaagugcaucaaccggugcuucuacgucgagcugauccgcgggcgcccccaggagccgcgggugugguggacguccaacucgaucaucguguucugcggcaccuccggcaccuacgggaccggcagcuggcccgacggggccaacaucaacuucaugcccaucuga

SEQ ID NO: 16432 - RNA, 1401 nt, Artificial Sequence; identical to SEQ ID NO: 16431
  derived and/or modified CDS sequence (AUadapt) from InfluenzaA__EPI680525__NA

SEQ ID NO: 16433 - RNA, 1401 nt, Artificial Sequence
  derived and/or modified CDS sequence (AUadapt) from InfluenzaA__EPI690481__NA
augaaccccaaccagcgcaucaccgccaucggcucggugucccugaucaucgccaucaucugccuccugaugcagaucgcgauccugaccacgaccaugacccuccacuuccggcagaacgagugcucgaacccguccaacaaccaggucaugcccugcgagcccaucaucaucgagcgcaacaccgugcaccugaacagcacgaccaucgagcgggagaucugccccaagguggccgaguacaagaacugguccaagccgcagugccagaucaccggguucgcccccuucucgaaggacaacuccauccgccugucggccuccggcgacaucugggucacccgggagcccuacgugagcugcucccucaacaagugcuaccaguucgcccuggggcagggcacgacccugaagaacaagcacucgaacgggaccacccacgaccgcacgccccaccggacccuccugaugaacgagcugggcgugccguuccaccucggcaccaagcaggucugcaucgcgugguccucguccagcugcuacgacgggaaggccuggcugcacgugugcgugaccggcgacgacaagaacgccacggccuccaucaucuacgacgggaugcuggucgacucgaucggcuccuggucgaagaacauccuccgcacccaggagagcgagugcgugugcaucaacgggaccugcgcgguggucaugaccgacggcuccgccucgggcaaggccgacacgcgggugcuguucauccgcgaggggaagaucaucaacaucucgccccuguccggcuccgcccagcacguggaggagugcagcugcuacccccgguaccccgagguccgcugcgugugccgggacaacuggaagggguccaaccgcccgauccucuacaucaacauggccgacuacucgaucgaguccucguacgugugcuccggccuggucggcgacacgccccggaacgacgacagcuccucguccucgaacugccgcgaccccaacaacgagcgcggggcgcccggcgugaaggggugggccuucgacgacggcaacgacguguggauggggcggaccaucaagaacggcucccggagcggcuacgagaccuuccgcgucgugaacggguggaccauggccaacuccaagucgcagaucaaccgccaggugaucgucgacucgaacgacugguccggcuacagcgggaucuucuccguggagggcaagaagugcaucaaccggugcuucuacgucgagcugauccgcgggcggccgcaggagccccgcgugugguggaccucgaacuccaucaucguguucugcggcaccagcggcaccuacgggacgggcuccuggcccgacggggccaacaucaacuucaugcccaucuga

SEQ ID NO: 16434 - RNA, 1410 nt, Artificial Sequence
  derived and/or modified CDS sequence (AUadapt) from InfluenzaA__AAA43084__NA
augaaccccaaccagaagaucaucaccaucggcucggugucccugaccaucgccacggucugcuuccucaugcagaucgccauccuggcgaccaccgugacccugcacuucaagcagcacgagugcgacucgccggccuccaaccaggugaugcccugcgagcccaucaucaucgagcgcaacaucacggagaucgucuaccucaacaacaccaccaucgagaaggagaucugccccgaggugguggaguaccggaacuggucgaagccgcagugccagaucaccggguucgcccccuucuccaaggacaacagcauccgccuguccgccggcggggacaucugggucacgcgggagcccuacgugucgugcgaccccggcaagugcuaccaguucgcccuggggcagggcaccacccucgacaacaagcacuccaacggcaccauccacgaccgcaucccgcaccggacgcugcugaugaacgagcucggggugcccuuccaccugggcaccaagcaggucugcguggcguggucguccagcuccugccacgacgggaaggccuggcugcacgugugcgucaccggcgacgaccgcaacgccaccgccucguucaucuacgacgggcggcucguggacuccaucggcucguggucccagaacauccugcgcacgcaggagucggagugcgugugcaucaacgggaccugcaccgucgugaugaccgacggcuccgcgagcggccgggccgacacgcgcauccuguucaucaaggaggggaagaucgugcacaucucgccccucuccggcucggcccagcacaucgaggagugcuccugcuacccccgguacccggacguccgcugcaucugccgggacaacuggaagggcagcaaccgccccgugaucgacaucaacauggaggacuacuccaucgacucgggguacgugugcuccggccuggucggggacacgccccggaacgacgacucguccucgaacuccaacugccgcgaccccaacaacgagcggggcaacccgggggugaagggcugggccuucgacaacggcgacgacguguggauggggcgcaccaucaacaaggagagccgguccggcuacgagaccuucaaggucaucgggggcuggucgacccccaacuccaagucgcaggugaaccgccaggucaucguggacaacaacaacugguccggguacagcggcaucuucuccguggagggcaagucgugcaucaaccggugcuucuacgucgagcugauccgcgggcgcccccaggagacccgggugugguggaccucgaacuccaucguggucuucugcggcaccagcgggacguacggcaccggguccuggcccgacggcgccaacaucaacuucaugccgaucuga

SEQ ID NO: 16435 - RNA, 1362 nt, Artificial Sequence
  derived and/or modified CDS sequence (AUadapt) from InfluenzaA__AAA43397__NA
augaaucccaaccagaagaucaucaccaucggcucgaucugcaugguggucgggaucaucucccugauccuccagaucggcaacaucaucagcaucuggaucucccacagcauccagaccgggaaccagaaucacacgggcaucugcaaccagggguccaucaccuacaaggugguggccggccaggacagcaccuccgucauccugaccggcaacagcucccuguguccgauccgcgggugggccauccacagcaaggacaacggcauccggaucggguccaagggcgacguguucgugauccgcgagcccuucaucagcuguucccaccucgagugccggacguucuuccugacccagggggcgcugcucaacgacaagcacagccgcggcaccuuuaaggaccggucccccuaccgcgcccugaugagcugccccgucggcgaggccccgucccccuacaacagccgguucgaguccguggccuggagugccagcgcgugccacgacggggugggcuggcugaccaucgggaucuccggccccgacgacggcgccgucgccgugcucaaguacaaccgcaucaucacggagaccaucaagaguuggcggaagaacauccugcgcacccaggaguccgagugcacgugcgugaacgggagcugcuucaccaucaugaccgacggccccuccgaugggcuggccagcuacaagaucuucaagaucgagaagggcaaggucaccaaguccaucgagcucaacgcgccgaacagccacuacgaggaguguuccugcuaccccgacaccgggaaggugaugugcgugugccgggacaacuggcacggcaguaaccgccccugggucuccuucgaccagaaccuggacuacaagaucggcuacaucugcagugggguguucggcgacaacccccggccgaaggacgggacgggcuccugcgggcccgugagcgccgacggcgccaacggcgucaagggguuuuccuacaaguacggcaacgggguguggaucggccgcaccaagagcgacuccagccggcacggguucgagaugaucugggaucccaacggcuggaccgagaccgacucccgcuucagcaugcggcaggacguggucgccaucacgaaccgcagcggcuacuccgggaguuucgugcagcaccccgagcugaccggccucgacugcaugcggccgugcuucuggguggagcugauccgcgggcugcccgaggaggacgccaucuggaccuccggcagcaucaucuccuuuugcggcgucaacagcgacaccguggacugguccuggcccgacggggcggagcuccccuucacgaucgacaaguga

SEQ ID NO: 16436 - RNA, 1365 nt, Artificial Sequence
  derived and/or modified CDS sequence (AUadapt) from InfluenzaA__AAA43412__NA
augaaucccaaccagaagaucaucaccaucggcucgaucugccugguggucgggcucaucucccugauccugcagaucggcaacaucaucagcaucuggaucucccacagcauccagaccgggucccagaaccacacgggcaucugcaaccagaacaucaucaccuacaagaacucgaccugggugaaggacaccacguccgugauccucaccgggaacagcucccuguguccgauccgcggcugggccaucuacagcaaggacaacuccauccggaucggcagcaagggggacgucuucgugauccgcgagcccuucaucuccugcucgcaccuggagugccggaccuucuuccucacccagggcgcccugcugaacgaccgccacuccaacgggacggugaaggaucggagccccuaccgcgcgcucauguccugccccgucggcgaggccccgagccccuacaacucccgguucgagagcguggccuggucggccuccgccugccacgacgggaugggcuggcugaccaucggcaucagcgggcccgacaacggcgcgguggccguccugaaguacaacgggaucaucaccgagaccaucaaguccuggcgcaagaagauccuccggacgcaggagagcgagugcgccugugugaacggcuccugcuucaccaucaugaccgacggccccagcgacgggcuggccuccuacaagaucuucaagaucgagaagggcaaggugaccaagucgaucgagcugaacgcgccgaacucccacuacgaggagugcagcugcuaccccgacacggggaaggucaugugugugugccgcgacaacuggcacggcuccaaccggcccugggugagcuucgaccagaaccucgacuaccagaucggguacaucugcuccggcgucuucggcgacaacccccgcccgaaggacgggaccggcagcugcgggcccguguauguggacggcgccaacggggucaagggcuucuccuaccgguacggcaacgggguguggaucggccgcaccaagucgcacuccagccggcacggguucgagaugaucugggaccccaacggcuggaccgagacggacuccaaguucagcgugcgccaggacgucguggccaugaccgacuggaguggguacuccggcucguucgugcagcaccccgagcugaccggccuggacugcauccggccgugcuucugggucgagcucauccgcgggcggcccaaggagaagaccaucuggacguccgccagcuccaucagcuucugcggcgugaacuccgacaccgucgacuggagcuggcccgacggggccgagcugcccuucaccaucgacaaguga

SEQ ID NO: 16437 - RNA, 1410 nt, Artificial Sequence
  derived and/or modified CDS sequence (AUadapt) from InfluenzaA__AAG01743__NA
augaaccccaaccagaagaucaucacccugggcucggugucccucaccaucgccacgaucugcuuccugaugcagaucgccauccuggucaccaccgugacccuccacuucaagcaguacgagugcgacuacccggcgaacaaccaggccaugcccugcgagcccaucaucaucgagcgcaacaucacggagaucguguaccugaccaacaccaccaucgagaaggaggucugccccaagcugguggaguaccggaacuggucgaagccgcagugcaagaucacgggguucgcccccuucuccaaggacaacagcauccgccucuccgccggcggggacaucugggugacccgggagcccuacgucucgugcgaccccggcaagugcuaccaguucgcccuggggcagggcaccacccuggacaacaagcacuccaacgacacgauccacgaccgcaccccgcaccggacccuccugaugaacgagcugggcgugcccuuccaccucgggacccgccaggugugcaucgcguggucguccagcuccugccacgacggcaaggccuggcugcacgucugcgugacgggguacgacaagaacgccaccgccucguucaucuacgacggccggcugguggacuccaucgggucguggucccagaacauccuccgcacccaggagagcgagugcgucugcaucaacgggaccugcacgguggugaugaccgacggcuccgcgucgggccgggccgacaccaagauccuguucaucgaggagggcaagaucguccacaccucgccccuguccgggagcgcccagcacguggaggagugcuccugcuacccccgcuacccgggcgugcggugcaucugccgcgacaacuggaagggcucgaaccggcccgucguggacaucaacgugaaggacuacuccaucaacucguccuacgucugcagcgggcucgugggcgacacgccccgcaacaacgaccgguccucguccucguacugccagaaccccaacaacgagaaggggacccacggcgugaaggggugggccuucgacgacggcaacgacgucuggaugggccgcaccaucuccgaggacagccgguccggguacgagaccuucaaggugaucggcggguggucgacgccgaacuccaagcugcagaucaaccgccaggucaucguggacucggacaaccgguccggcuacagcgggaucuucuccguggagggcaagucgugcaucaaccgcugcuucuacgucgagcugauccggggccgcgagcaggagacccgcgugugguggaccucgaacuccaucguggucuucugcgggaccagcggcacguacgggaccggcuccuggcccgacggggccgacaucaacaucaugcccaucuga

SEQ ID NO: 16438 - RNA, 1410 nt, Artificial Sequence
  derived and/or modified CDS sequence (AUadapt) from InfluenzaA__AAG01759__NA
augaaccccaaccagaagaucaucaccaucggcucggugucccugaccaucgccacgaugugcuuccucaugcagaucgccauccuggucaccaccgugacccugcacuucaagcaguacgagugcaacucgccgcccaacaaccaggugauccucugcgagcccacgaucaucgagcgcaacaucaccgagaucgucuaccugaccaacaccacgaucgagaaggagaucugccccaagcuggcggaguacaagaacugguccaagccgcagugcaagaucaccggguucgcccccuucagcaaggacaacuccauccggcucucggccggcggggacaucugggugacccgcgagcccuacguguccugcgaccccgacaagugcuaccaguucgcccugggccaggggaccacgcugaacaaccggcacucgaacgacaccguccacgaccgcaccccguaccggacccuccugaugaacgagcugggcgugcccuuccaccucggcacgaagcaggucugcaucgccugguccagcuccucgugccacgacgggaaggcguggcugcacgugugcgugaccggccacgacgagaacgccaccgccuccuucaucuacgacgggcgccugguggacagcaucggcuccuggucgaagaagauccuccggacccaggaguccgagugcgucugcaucaacgggacgugcaccguggugaugaccgacggcucggccuccggccgcgcggacaccaagauccuguucaucgaggaggggaagaucguccacaucagcccccugcucggcucggcccagcacguggaggagugcuccugcuacccccgguacccgggggugcgcugcgucugccgggacaacuggaagggcagcaaccgccccaucguggacaucaacgugaaggacuacuccaucgucucguccuacgugugcucgggccuggugggggacacgccccggaagaacgaccgcuccagcuccucgaacugccugaaccccaacaacgaggagggcgggcacggcgucaaggggugggccuucgacgacggcaacgacguguggaugggccggaccaucuccgagaagcuccgcagcggguacgagaccuucaaggucaucgagggcugguccaagccgaacucgaagcugcagaucaaccgccaggugaucguggaccgggggaaccgguccggcuacucggggaucuucuccgucgagggcaagagcugcaucaaccgcugcuucuacguggagcugauccggggccgcaagcaggagaccgaggugugguggacguccaacucgaucgucguguucugcgggaccagcggcaccuacgggaccggcuccuggcccgacggggccgacaucaaccucaugcccaucuga

SEQ ID NO: 16439 - RNA, 1410 nt, Artificial Sequence
  derived and/or modified CDS sequence (AUadapt) from InfluenzaA__AAG01777__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugauccucugcgagcccacgaucaucgagcgcaacaucaccgagaucgucuaccugaccaacaccacgaucgagaaggagaucugccccaagcuggcggaguacaagaacugguccaagccgcagugcaagaucaccggguucgcccccuucagcaaggacaacuccauccggcucucggccggcggggacaucugggugacccgcgagcccuacguguccugcgaccccgacaagugcuaccaguucgcccugggccaggggaccacgcugaacaaccggcacucgaacgacaccguccacgaccgcaccccguaccggacccuccugaugaacgagcugggcgugcccuuccaccucggcacgaagcaggucugcaucgccugguccagcuccucgugccacgacgggaaggcguggcugcacgugugcgugaccggccacgacgagaacgccaccgccuccuucaucuacgacgggcgccugguggacagcaucggcuccuggucgaagaagauccuccggacccaggaguccgagugcgucugcaucaacgggacgugcaccguggugaugaccgacggcucggccuccggccgcgcggacaccaagauccuguucaucgaggaggggaagaucguccacaucagcccccugcucggcucggcccagcacguggaggagugcuccugcuacccccgguacccgggggugcgcugcgucugccgggacaacuggaagggcagcaaccgccccaucguggacaucaacgugaaggacuacuccaucgucucguccuacgugugcucgggccuggugggggacacgccccggaagaacgaccgcuccagcuccucgaacugccugaaccccaacaacgaggagggcgggcacggcgucaaggggugggccuucgacgacggcaacgacguguggaugggccggaccaucuccgagaagcuccgcagcggguacgagaccuucaaggucaucgagggcugguccaagccgaacucgaagcugcagaucaaccggcccgugaucguggaccgcggggaccgguccggcuacucggggaucuucuccgucgagggcaagagcugcaucaaccgcugcuucuacguggagcugauccggggccgcaagcaggagaccgaggugugguggacguccaacucgaucgucguguucugcgggaccagcggcaccuacgggaccggcuccuggcccgacggggccgacaucaaccucaugcccaucuga

SEQ ID NO: 16440 - RNA, 1410 nt, Artificial Sequence; identical to SEQ ID NO: 16369
  derived and/or modified CDS sequence (AUadapt) from InfluenzaA__AAG01786__NA

SEQ ID NO: 16441 - RNA, 1410 nt, Artificial Sequence
  derived and/or modified CDS sequence (AUadapt) from InfluenzaA__AAK71688__NA
augaaccccaaccagaagaucaucaccaucggcucggugucccugaccaucgccacgaugugcuuccucaugcagaucgccauccuggucaccaccgugacccugcacuucaagcaguacgagugcaacucgccgcccaacaaccaggugauccucugcgagcccacgaucaucgagcgcaacaucaccgagaucgucuaccugaccaacgcgaccaucgagaaggagaucugccccaagcuggccgaguaccggaacugguccaagccgcagugcaagaucacgggguucgcccccuucagcaaggacaacuccauccgccucucggccggcggggacaucugggugacccgggagcccuacguguccugcgaccccgacaagugcuaccaguucgcccugggccaggggaccacccugaacaaccgccacucgaacgacacgguccacgaccggaccccguaccgcacccuccugaugaacgagcugggcgugcccuuccaccucggcaccaagcaggucugcaucgcgugguccagcuccucgugccacgacgggaaggccuggcugcacgugugcgugacgggccacgacgagaacgccaccgccuccuucaucuacgacgggcggcugguggacagcaucggcuccuggucgaagaagauccuccgcacccaggaguccgagugcgucugcaucaacgggaccugcacgguggugaugaccgacggcucggcguccggccgggccgacaccaagauccuguucaucgaggaggggaagaucguccacaucagcccccugcucggcucggcccagcacguggaggagugcuccugcuacccccgcuacccgggggugcggugcgucugccgcgacaacuggaagggcagcaaccggcccaucguggacaucaacgugaaggacuacuccaucgucucguccuacgugugcucgggccuggugggggacacgccccgcaagaacgaccgguccagcuccucgaacugccugaaccccaacaacgaggagggcgggcacggcgucaaggggugggccuucgacgacggcaacgacguguggaugggccgcaccaucuccgaggagcuccggagcggguacgagaccuucaaggucaucgagggcugguccaagccgaacucgaagcugcagaucaaccgccaggugaucguggaccgcggggaccgguccggcuacucggggaucuucuccgucgagggcaagagcugcaucaaccggugcuucuacguggagcugauccgcggccgcaagcaggagaccgaggugugguggaccuccaacucgaucgucguguucugcgggacgagcggcaccuacgggaccggcuccuggcccgacggggccgacaucaaccucaugcccaucuga

SEQ ID NO: 16442 - RNA, 1410 nt, Artificial Sequence
  derived and/or modified CDS sequence (AUadapt) from InfluenzaA__AAN01169__NA
augaaccccaaccagaagaucaucaccaucggcucggugucccugaccaucgccacgaucugcuuccucaugcagaucgccauccuggucaccaccgugacccugcacuucaagcaguacgagugcaacagccucccgaacaaccaggugaugcugugcgagcccacgaucaucgagcgcaacaucaccgagaucgucuaccugaccaacaccacgaucgagaaggagaucugccccaagcucgcggaguaccggaacugguccaagccccagugcaagaucaccggguucgccccguucucgaaggacaacuccauccgccugagcgccggcggggacaucugggugacccgggagcccuacguguccugcgaccccgacaagugcuaccaguucgcccugggccaggggaccacgcucaacaaccgccacucgaacgacaccguccacgaccggacccccuaccgcacccugcugaugaacgagcucggcgugccguuccaccugggcacgaagcaggucugcaucgccugguccagcuccucgugccacgacgggaaggcguggcugcacgugugcgugaccggccacgacgagaacgccaccgccuccuucaucuacgacgggcggcucguggacagcaucggcuccuggucgaagaagauccugcgcacccaggaguccgagugcgucugcaucaacgggacgugcaccguggugaugaccgacggcagcgccuccggccgggcggacaccaagauccuguucaucgaggaggggaagaucauccacaucucgcagcucagcggcuccgcccagcacgucgaggagugcucgugcuacccccgcuaccccggggugcggugcgugugccgcgacaacuggaagggcuccaaccggcccaucgucgacaucaacgugaaggacuacagcaucguguccucguacgucugcuccggccuggugggggacacgccgcgcaagaacgacagcuccucguccagccacugccugaaccccaacaacgaggagggcgggcacggcgugaaggggugggccuucgacgacggcaacgacgucuggaugggccggaccaucuccgagaaguuccgcucgggguacgagaccuucaaggugaucgagggcugguccaagcccaacagcaagcuccagaucaaccggcaggucaucguggaccgcgacaaccgguccggguacucgggcaucuucuccguggagggcaagagcugcaucaaccgcugcuucuacgucgagcugauccgggggcgcaagcaggagaccgaggugugguggacgucgaacuccaucguggucuucugcggcaccagcgggaccuacggcaccggguccuggcccgacggcgccgacaucaaccugaugccgaucuga

SEQ ID NO: 16443 - RNA, 1410 nt, Artificial Sequence; identical to SEQ ID NO: 16442
  derived and/or modified CDS sequence (AUadapt) from InfluenzaA__AAN01170__NA

SEQ ID NO: 16444 - RNA, 1410 nt, Artificial Sequence
  derived and/or modified CDS sequence (AUadapt) from InfluenzaA__AAN01171__NA
augaaccccaaccagaagaucaucaccaucggcucggugucccugaccaucgccacgaucugcuuccucaugcagaucgccauccuggucaccaccgugacccugcacuucaagcaguacgagugcaacagccucccgaacaaccaggugaugcugugcgagcccacgaucaucgagcgcaacaucaccgagaucgucuaccugaccaacaccacgaucgagaaggagaucugccccaagcucgcggaguaccggaacugguccaagccccagugcaagaucaccggguucgccccguucucgaaggacaacuccauccgccugagcgccggcggggacaucugggugacccgggagcccuacguguccugcgaccccgacaagugcuaccaguucgcccugggccaggggaccacgcucaacaaccgccacucgaacgacaccguccacggccggacccccuaccgcacccugcugaugaacgagcucggcgugccguuccaccuggggacgaagcaggucugcaucgccugguccagcuccucgugccacgacggcaaggcguggcugcacgugugcgugaccgggcacgacgagaacgccaccgccuccuucaucuacgacggccggcucguggacagcaucggguccuggucgaagaagauccugcgcacccaggaguccgagugcgucugcaucaacggcacgugcaccguggugaugaccgacggcagcgccuccgggcgggcggacaccaagauccuguucaucgaggagggcaagaucauccacaucucgcagcucagcggguccgcccagcacgucgaggagugcucgugcuacccccgcuaccccggcgugcggugcgugugccgcgacaacuggaagggcuccaaccggcccaucgucgacaucaacgugaaggacuacagcaucguguccucguacgucugcuccgggcuggugggcgacacgccgcgcaagaacgacagcuccucguccagccacugccugaaccccaacaacgaggagggcgggcacggggugaagggcugggccuucgacgacggcaacgacgucuggauggggcggaccaucuccgagaaguuccgcucgggcuacgagaccuucaaggugaucgaggggugguccaagcccaacagcaagcuccagaucaaccggcaggucaucguggaccgcgacaaccgguccggcuacucggggaucuucuccguggagggcaagagcugcaucaaccgcugcuucuacgucgagcugauccggggccgcaagcaggagaccgaggugugguggacgucgaacuccaucguggucuucugcgggaccagcggcaccuacgggaccggcuccuggcccgacggggccgacaucaaccugaugccgaucuga

SEQ ID NO: 16445 - RNA, 1410 nt, Artificial Sequence; identical to SEQ ID NO: 16442
  derived and/or modified CDS sequence (AUadapt) from InfluenzaA__AAN01172__NA

SEQ ID NO: 16446 - RNA, 1410 nt, Artificial Sequence
  derived and/or modified CDS sequence (AUadapt) from InfluenzaA__AAN01173__NA
augaaccccaaccagaagaucaucaccaucggcucggugucccugaccaucgccacgaucugcuuccucaugcagaucgccauccuggucaccaccgugacccugcacuucaagcaguacgagugcaacagccucccgaacaaccaggugaugcugugcgagcccacgaucaucgagcgcaacaucaccgagaucgucuaccugaccaacaccacgaucgagaaggagaugugccccaagcucgcggaguaccggaacugguccaagccccagugcaagaucaccggguucgccccguucucgaaggacaacuccauccgccugagcgccggcggggacaucugggugacccgggagcccuacguguccugcgaccccgacaagugcuaccaguucgcccugggccaggggaccacgcucaacaaccgccacucgaacgacaccguccacgaccggacccccuaccgcacccugcugaugaacgagcucggcgugccguuccaccugggcacgaagcaggucugcaucgccugguccagcuccucgugccacgacgggaaggcguggcugcacgugugcgugaccggccacgacgagaacgccaccgccuccuucaucuacgacgggcggcucguggacagcaucggcuccuggucgaagaagauccugcgcacccaggaguccgagugcgucugcaucaacgggacgugcaccguggugaugaccgacggcagcgccuccggccgggcggacaccaagauccuguucaucgaggaggggaagaucauccacaucucgcagcucagcggcuccgcccagcacgucgaggagugcucgugcuacccccgcuaccccggggugcggugcgugugccgcgacaacuggaagggcuccaaccggcccaucgucgacaucaacgugaaggacuacagcaucguguccucguacgucugcuccggccuggugggggacacgccgcgcaagaacgacagcuccucguccagccacugccugaaccccaacaacgaggagggcgggcacggcgugaaggggugggccuucgacgacggcaacgacgucuggaugggccggaccaucuccgagaaguuccgcucgggguacgagaccuucaaggugaucgagggcugguccaagcccaacagcaagcuccagaucaaccggcaggucaucguggaccgcgacaaccgguccggguacucgggcaucuucuccguggagggcaagagcugcaucaaccgcugcuucuacgucgagcugauccgggggcgcaagcaggagaccgaggugugguggacgucgaacuccaucguggucuucugcggcaccagcgggaccuacggcaccggguccuggcccgacggcgccgacaucaaccugaugccgaucuga

SEQ ID NO: 16447 - RNA, 1410 nt, Artificial Sequence; identical to SEQ ID NO: 16442
  derived and/or modified CDS sequence (AUadapt) from InfluenzaA__AAN01174__NA

SEQ ID NO: 16448 - RNA, 1410 nt, Artificial Sequence; identical to SEQ ID NO: 16442
  derived and/or modified CDS sequence (AUadapt) from InfluenzaA__AAN01175__NA

SEQ ID NO: 16449 - RNA, 1410 nt, Artificial Sequence; identical to SEQ ID NO: 16442
  derived and/or modified CDS sequence (AUadapt) from InfluenzaA__AAN01176__NA

SEQ ID NO: 16450 - RNA, 1410 nt, Artificial Sequence; identical to SEQ ID NO: 16442
  derived and/or modified CDS sequence (AUadapt) from InfluenzaA__AAN01177__NA

SEQ ID NO: 16451 - RNA, 1410 nt, Artificial Sequence; identical to SEQ ID NO: 16442
  derived and/or modified CDS sequence (AUadapt) from InfluenzaA__AAN01178__NA

SEQ ID NO: 16452 - RNA, 1410 nt, Artificial Sequence; identical to SEQ ID NO: 16442
  derived and/or modified CDS sequence (AUadapt) from InfluenzaA__AAN01179__NA

SEQ ID NO: 16453 - RNA, 1410 nt, Artificial Sequence; identical to SEQ ID NO: 16442
  derived and/or modified CDS sequence (AUadapt) from InfluenzaA__AAN01180__NA

SEQ ID NO: 16454 - RNA, 1410 nt, Artificial Sequence
  derived and/or modified CDS sequence (AUadapt) from InfluenzaA__AAN01181__NA
augaaccccaaccagaagaucaucaccaucggcucggugucccugaccaucgccacgaucugcuuccucaugcagaucgccauccuggucaccaccgugacccugcacuucaagcaguacgagugcaacucgcucccgaacaaccaggugaugcugugcgagcccacgaucaucgagcgcaacaucaccgagaucgucuaccugaccaacaccacgaucgagaaggagaucugccccaagcucgcggaguaccggaacugguccaagccccagugcaagaucaccggguucgccccguucagcaaggacaacuccauccgccugucggccggcggggacaucugggugacccgggagcccuacguguccugcgaccccgacaagugcuaccaguucgcccugggccaggggaccacgcucaacaaccgccacagcaacgacaccguccacgaccggacccccuaccgcacccugcugaugaacgagcucggcgugccguuccaccugggcacgaagcaggucugcaucgccugguccucguccagcugccacgacgggaaggcguggcugcacgugugcgugaccggccacgacgagaacgccaccgccuccuucaucuacgacgggcggcucguggacucgaucggcuccuggagcaagaagauccugcgcacccaggaguccgagugcgucugcaucaacgggacgugcaccguggugaugaccgacggcucggccuccggccgggcggacaccaagauccuguucaucgaggaggggaagaucauccacaucagccagcucucgggcuccgcccagcacgucgaggagugcucgugcuacccccgcuaccccggggugcggugcgugugccgcgacaacuggaagggcuccaaccggcccaucgucgacaucaacgugaaggacuacagcaucguguccucguacgucugcuccggccuggugggggacacgccgcgcaagaacgacagcuccucguccagccacugccugaaccccaacaacgaggagggcgggcacggcgugaaggggugggccuucgacgacggcaacgacgucuggaugggccggaccaucggggagaaguuccgcuccggcuacgagaccuucaaggugaucgagggguggucgaagcccaacuccaagcuccagaucaaccggcaggucaucguggaccgcgacaaccggagcggcuacuccgggaucuucucgguggagggcaaguccugcaucaaccgcugcuucuacgucgagcugauccggggccgcaagcaggagaccgaggugugguggacgagcaacucgaucguggucuucugcgggaccuccggcaccuacgggaccggcagcuggcccgacggggccgacaucaaccugaugccgaucuga

SEQ ID NO: 16455 - RNA, 1410 nt, Artificial Sequence; identical to SEQ ID NO: 16442
  derived and/or modified CDS sequence (AUadapt) from InfluenzaA__AAN01182__NA

SEQ ID NO: 16456 - RNA, 1410 nt, Artificial Sequence; identical to SEQ ID NO: 16442
  derived and/or modified CDS sequence (AUadapt) from InfluenzaA__AAN01183__NA

SEQ ID NO: 16457 - RNA, 1410 nt, Artificial Sequence; identical to SEQ ID NO: 16442
  derived and/or modified CDS sequence (AUadapt) from InfluenzaA__AAN01184__NA

SEQ ID NO: 16458 - RNA, 1410 nt, Artificial Sequence; identical to SEQ ID NO: 16442
  derived and/or modified CDS sequence (AUadapt) from InfluenzaA__AAN01185__NA

SEQ ID NO: 16459 - RNA, 1410 nt, Artificial Sequence
  derived and/or modified CDS sequence (AUadapt) from InfluenzaA__AAN01186__NA
augaaccccaaccagaagaucaucaccaucggcucggugucccugaccaucgccacgaucugcuuccucaugcagaucgccauccuggucaccaccgugacccugcacuucaagcaguacgagugcaacagccucccgaacaaccaggugaugcugugcgagcccacgaucaucgagcgcaacaucaccgagaucgucuaccugaccaacaccacgaucgagaaggagaucugccccaagcucgcggaguaccggaacugguccaagccccagugcaagaucaccggguucgccccguucucgaaggacaacuccauccgccugagcgccggcggggacaucugggugacccgggagcccuacguguccugcgaccccgacaagugcuaccaguucgcccugggccaggggaccacgcucaacaaccgccacucgaacgacaccguccacgaccggacccccuaccgcacccugcugaugaacgagcucggcgugccguuccaccugggcacgaagcaggucugcaucgccugguccagcuccucgugccacgacgggaaggcguggcugcacgugugcgugaccggccacgacgagaacgccaccgccuccuucaucuacgacgggcggcucguggacagcaucggcuccuggucgaagaagauccugcgcacccaggaguccgagugcgucugcaucaacgggacgugcaccguggugaugaccgacggcagcgccuccggccgggcggacaccaagauccuguucaucgaggaggggaagaucauccacaucucgcagcucagcggcuccgcccagcacgucgaggagugcagcugcuacccccgcuaccccggggugcggugcgugugccgcgacaacuggaagggcuccaaccggcccaucgucgacaucaacgugaaggacuacucgaucguguccagcuacgucugcuccggccuggugggggacacgccgcgcaagaacgacucguccagcuccucgcacugccugaaccccaacaacgaggagggcgggcacggcgugaaggggugggccuucgacgacggcaacgacgucuggaugggccggaccaucuccgagaaguuccgccucggguacgagaccuucaaggugaucgagggcuggagcaaguccaacucgaagcugcagaucaaccggcaggucaucguggaccgcgacaaccgguccggguacagcggcaucuucuccguggagggcaagucgugcaucaaccgcugcuucuacgucgagcugauccgggggcgcaagcaggagaccgaggugugguggacgagcaacuccaucguggucuucugcggcaccagcgggaccuacggcaccggguccuggcccgacggcgccgacaucaaccucaugcccaucuga

SEQ ID NO: 16460 - RNA, 1410 nt, Artificial Sequence
  derived and/or modified CDS sequence (AUadapt) from InfluenzaA__AAN01187__NA
augaaccccaaccagaagaucaucaccaucggcucggugucccugaccaucgccacgaucugcuuccucaugcagaucgccauccuggucaccaccgugacccugcacuucaagcaguacgagugcgacagccucccgaacaaccaggugaugcugugcgagcccacgaucaucgagcgcaacaucaccgagaucgucuaccugaccaacaccacgaucgagaaggagaugugccccaagcucgcggaguaccggaacugguccaagccccagugcaagaucaccggguucgccccguucucgaaggacaacuccauccgccugagcgccggcggggacaucugggugacccgggagcccuacguguccugcgaccccgacaagugcuaccaguucgcccugggccaggggaccacgcucaacaaccgccacucgaacgacaccguccacgaccggacccccuaccgcacccugcugaugaacgagcucggcgugccguuccaccugggcacgaagcaggucugcaucgccugguccagcuccucgugccacgacgggaaggcguggcugcacgugugcgugaccggccacgacgagaacgccaccgccuccuucaucuacgacgggcggcucguggacagcaucggcuccuggucgaagaagauccugcgcacccaggaguccgagugcgucugcaucaacgggacgugcaccguggugaugaccgacggcagcgccuccggccgggcggacaccaagauccuguucaucgaggaggggaagaucauccacaucucgcagaugagcggcuccgcccagcacgucgaggagugcucgugcuacccccgcuaccccggggugcggugcgugugccgcgacaacuggaagggcuccaaccggcccaucgucgacaucaacgugaaggacuacagcaucguguccucguacgucugcuccggccucgugggggacacgccgcgcaagaacgacagcuccucguccagccacugccugaaccccaacaacgaggagggcgggcacggcgugaaggggugggccuucgacgacggcaacgacgucuggaugggccggaccaucuccgagaaguuccgcucgggguacgagaccuucaaggugaucgagggcugguccaagcccaacagcaagcugcagaucaaccggcaggucaucguggaccgcgacaaccgguccggguacucgggcaucuucuccguggagggcaagagcugcaucaaccgcugcuucuacgucgagcucauccgggggcgcaagcaggagaccgaggugugguggacgucgaacuccaucguggucuucugcggcaccagcgggaccuacggcaccggguccuggcccgacggcgccgacaucaaccugaugccgaucuga

SEQ ID NO: 16461 - RNA, 1410 nt, Artificial Sequence; identical to SEQ ID NO: 16442
  derived and/or modified CDS sequence (AUadapt) from InfluenzaA__AAN01188__NA

SEQ ID NO: 16462 - RNA, 1410 nt, Artificial Sequence
  derived and/or modified CDS sequence (AUadapt) from InfluenzaA__AAN64883__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccucguccucgugccacgacggcaaggcguggcugcacgugugcgugaccggggacgacgagaacgccaccgccuccuucaucuacaacggccgccugguggacagcaucggguccuggucgaagaagauccuccggacccaggaguccgagugcgucugcaucaacggcacgugcaccguggugaugaccgacggcagcgccuccgggaaggcggacaccaagauccuguucaucgaggagggcaagaucguccacacgucgcugcucagcggguccgcccagcacguggaggagugcucgugcuacccccgcuaccccggcgugcggugcgucugccgcgacaacuggaagggcuccaaccggccgaucguggacaucaacgugaaggacuacucgaucgucuccagcuacgugugcuccgggcuggugggcgacacgccccgcaagaacgacucguccagcuccucgcacugccuggaccccaacaacgaggagggcgggcacggggucaagggcugggccuucgacgacggcgacgacguguggauggggcggaccaucuccgagaagcuccgcucgggcuacgagaccuucaaggucaucgaggggugguccaagcccaacagcaagcugcagaucaaccgccaggugaucguggaccggggcaaccgguccggguacucgggcaucuucuccgucgagggcaagagcugcaucaaccgcugcuucuacguggagcugauccgggggcgcaagcaggagaccgaggugcucuggaccucgaacuccaucgucguguucugcggcaccagcgggaccuacggcacgggguccuggccggacggcgccgacaucaaccugaugcccaucuga

SEQ ID NO: 16463 - RNA, 1410 nt, Artificial Sequence
  derived and/or modified CDS sequence (AUadapt) from InfluenzaA__AAN64884__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccucguccucgugccacgacggcaaggcguggcugcacgugugcgugaccggggacgacgagaacgccaccgccuccuucaucuacaacggccgccugguggacagcaucggguccuggucgaagaagauccuccggacccaggaguccgagugcgucugcaucaacggcacgugcaccguggugaugaccgacggcagcgccuccgggaaggcggacaccaagauccuguucaucgaggagggcaagaucguccacacgucgcugcucagcggguccgcccagcacguggaggagugcucgugcuacccccgcuaccccggcgugcggugcgucugccgcgacaacuggaagggcuccaaccggccgaucguggacaucaacgugaaggacuacucgaucgucuccagcuacgugugcuccgggcuggugggcgacacgccccgcaagaacgacucguccagcuccucgcacugccuggaccccaacaacgaggagggcgggcacggggucaagggcugggccuucgacgacggcaacgacguguggauggggcggaccaucuccgagaagcuccgcucgggcuacgagaccuucaaggucaucgaggggugguccaagcccaacagcaagcugcagaucaaccgccaggugaucguggaccggggcaaccgguccggguacucgggcaucuucuccgucgagggcaagagcugcaucaaccgcugcuucuacguggagcugauccgggggcgcaagcaggagaccgaggugcucuggaccucgaacuccaucgucguguucugcggcaccagcgggaccuacggcacgggguccuggccggacggcgccgacaucaaccugaugcccaucuga

SEQ ID NO: 16464 - RNA, 1410 nt, Artificial Sequence; identical to SEQ ID NO: 16463
  derived and/or modified CDS sequence (AUadapt) from InfluenzaA__AAN64885__NA

SEQ ID NO: 16465 - RNA, 1410 nt, Artificial Sequence; identical to SEQ ID NO: 16463
  derived and/or modified CDS sequence (AUadapt) from InfluenzaA__AAN64886__NA

SEQ ID NO: 16466 - RNA, 1410 nt, Artificial Sequence; identical to SEQ ID NO: 16463
  derived and/or modified CDS sequence (AUadapt) from InfluenzaA__AAN64887__NA

SEQ ID NO: 16467 - RNA, 1410 nt, Artificial Sequence
  derived and/or modified CDS sequence (AUadapt) from InfluenzaA__AAN64888__NA
augaaccccaaccagaagaucaucaccaucggcucggugucccugaccaucgccacgaucugcuuccucaugcagaucgucauccuggugaccaccgugacccugcacuucaagcaguacgagugcaacucgccgcccaacaaccaggucaugcucugcgagcccacgaucaucgagcgcaacaucaccgagaucguguaccugaccaacaccacgaucgagaaggagaucugccccaagcuggccgaguaccggaacugguccaagccgcagugcaacaucaccggguucgcgcccuucagcaaggacaacuccauccgccucucggccggcggggacaucugggugacccgggagcccuacgucuccugcgaccccgacaagugcuaccaguucgcccugggccaggggaccacgcugaacaacggccacagcaacgacaccgugcacgaccgcaccccguaccggacccuccugaugaacgagcugggcgugcccuuccaccucgggacgaagcaggucugcaucgccugguccucguccagcugccacgacggcaaggccuggcugcacgugugcgugaccggggacgacaagaacgcgaccgccuccuucaucuacaacggccgccuggucgacucgaucggguccuggagcaagaagauccuccggacccaggaguccgagugcgugugcaucaacggcacgugcaccguggucaugaccgacggcucggccuccgggaaggccgacaccaagauccuguucaucgaggagggcaagaucgugcacacgagccugcucucgggguccgcgcagcacguggaggagugcucgugcuacccccgcuaccccggcguccggugcgugugccgcgacaacuggaagggcuccaaccggccgaucguggacaucaacgucaaggacuacagcaucguguccucguacgugugcuccgggcuggucggcgacacgccccgcaagaacgacagcuccucguccagccacugccuggaccccaacaacgaggagggcgggcacggggugaagggcugggccuucgacgacggcaacgacgucuggauggggcggaccaucuccgagaagcuccgcucgggcuacgagaccuucaaggugaucgaggggugguccaagcccaacagcaagcugcagaucaaccgccaggugaucgucgaccggggcaaccgguccggguacucgggcaucuucuccguggagggcaagagcugcaucaaccgcugcuucuacguggagcugauccgggggcgcaaccaggagaccgagguccucuggaccucgaacuccaucgugguguucugcggcaccagcgggaccuacggcacgggguccuggccggacggcgccgacaucaaccugaugcccaucuga

SEQ ID NO: 16468 - RNA, 1410 nt, Artificial Sequence; identical to SEQ ID NO: 16463
  derived and/or modified CDS sequence (AUadapt) from InfluenzaA__AAN64889__NA

SEQ ID NO: 16469 - RNA, 1410 nt, Artificial Sequence
  derived and/or modified CDS sequence (AUadapt) from InfluenzaA__AAN64890__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggagaugcucugcgagcccacgaucaucgagcgcaacaucaccgagaucguguaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggucacccgggagcccuacguguccugcgaccccgacaagugcuaccaguucgcccugggccaggggaccacgcugaacaacggccacucgaacgacaccgugcacgaccgcaccccguaccggacccuccugaugaacgagcugggcguccccuuccaccucgggacgaagcaggucugcaucgccugguccagcuccucgugccacgacggcaaggcguggcugcacgugugcgugaccggggacgacgagaacgccaccgccuccuucaucuacaacggccgccugguggacagcaucggguccuggucgaagaagauccuccggacccaggaguccgagugcgugugcaucaacggcacgugcaccgucgugaugaccgacggcucggccuccgggaaggcggacaccaagauccuguucaucgaggagggcaagaucgugcacacgagccugcucucgggguccgcccagcacgucgaggagugcucgugcuacccccgcuaccccggcgugcggugcgugugccgcgacaacuggaagggcuccaaccggccgaucgucgacaucaacgugaaggacuacagcaucguguccucguacgucugcuccgggcuggugggcgacacgccccgcaagaacgacagcuccucguccucgcacugccuggaccccaacaacgaggagggcgggcacggggugaagggcugggccuucgacgacggcaacgacgucuggauggggcggaccaucuccgagaagcuccgcagcggcuacgagaccuucaaggugaucgaggggugguccaagcccaacucgaagcugcagaucaaccggcaggucaucguggaccgcggcaaccgguccggguacucgggcaucuucuccguggagggcaagagcugcaucaaccgcugcuucuacgucgagcugauccgggggcgcaagcaggagaccgaggugcucuggaccucgaacuccaucguggucuucugcggcaccagcgggaccuacggcacgggguccuggccggacggcgccgacaucaaccugaugcccaucuga

SEQ ID NO: 16470 - RNA, 1410 nt, Artificial Sequence; identical to SEQ ID NO: 16463
  derived and/or modified CDS sequence (AUadapt) from InfluenzaA__AAN64891__NA

SEQ ID NO: 16471 - RNA, 1410 nt, Artificial Sequence
  derived and/or modified CDS sequence (AUadapt) from InfluenzaA__AAO46212__NA
augaaccccaaccagaagaucaucaccaucggcucggugucccugaccaucgagacggucugcuuccucaugcagaucgccauccuggccaccaccgugacccugcacuucaagcagcacgagugcgacucgccggcguccaaccaggugaugcccugcgagcccaucaucaucgagcgcaacaucacggagaucgucuaccucaacaacaccaccaucgagaaggagaucugccccgaggugguggaguaccggaacuggagcaagccgcagugccagaucaccggguucgcccccuucuccaaggacaacucgauccgccuguccgccggcggggacaucugggucacgcgggagcccuacgugucgugcgacaccggcaagugcuaccaguucgcccuggggcagggcaccacccucgacaacaagcacuccaacggcacgauccacgaccgcaucccccaccggacccugcugaugaacgagcucggggugccguuccaccugggcaccaagcaggucugcguggccuggagcuccucguccugccacgacgggaaggcguggcugcacgugugcgucaccggcgacgaccgcaacgccacggccucguucaucuacgacgggcggcucguggacuccaucggcagcuggucccagaacauccugcgcacccaggagucggagugcgugugcaucaacgggaccugcaccgucgugaugacggacggcuccgccucgggccgggcggacacccgcauccuguucaucaaggaggggaagaucgugcacaucagcccccucuccggcucggcccagcacaucgaggagugcuccugcuacccccgguaccccgacguccgcugcaucugccgggacaacuggaagggcagcaaccgcccggugaucgacaucaacauggaggacuacuccaucgacucguccuacgugugcucggggcuggucggcgacacgccccggaacgacgacuccagcuccaacucgaacugccgcgaccccaacaacgagcgggggaaccccggcgugaaggggugggccuucgacaacggcgacgacguguggaugggccgcaccaucuccaaggaccugcggucgggguacgagaccuucaaggucaucggcgggugguccaccccgaacagcaagucccaggugaaccgccaggucaucguggacaacaacaacuggucgggcuacuccgggaucuucucgguggagggcaagagcugcaucaaccggugcuucuacgucgagcucauccgcggccgcccccaggagacccgggugugguggaccuccaacucgaucguggucuucugcgggacguccggcaccuacgggaccggcagcuggcccgacggggccaacaucaacuucaugcccaucuga

SEQ ID NO: 16472 - RNA, 1410 nt, Artificial Sequence
  derived and/or modified CDS sequence (AUadapt) from InfluenzaA__AAO46213__NA
augaaccccaaccagaagaucaucaccaucgacucggugucccugaccaucgccacggucugcuuccucaugcagaucgccauccuggcgaccaccgugacccugcacuucaagcagcacgagugcgacucgccggccuccaaccaggugaugcccugcgagcccaucaucaucgagcgcaacaucacggagaucgucuaccucaacaacaccaccaucgagaaggagaucugccccgaggugguggaguaccggaacuggagcaagccgcagugccagaucaccggcuucgcccccuucuccaaggacaacucgauccgccuguccgccgggggcgacaucugggucacgcgggagcccuacgugucgugcgacaccgggaagugcuaccaguucgcccugggccaggggaccacccucgacaacaagcacuccaacggcacgauccacgaccgcaucccccaccggacccugcugaugaacgagcucggcgugccguuccaccuggggaccaagcaggucugcguggcguggagcuccucguccugccacgacggcaaggccuggcugcacgugugcgucaccggggacgaccgcaacgccacggccucguucaucuacgacggccggcucguggacuccaucgggagcuggucccagaacauccugcgcacccaggagucggagugcgugugcaucaacgggaccugcaccgucgugaugacggacggcuccgcgucggggcgggccgacacccgcauccuguucaucaaggagggcaagaucgugcacaucagcccccucuccgggucggcccagcacaucgaggagugcuccugcuacccccgguaccccgacguccgcugcaucugccgggacaacuggaagggcagcaaccgcccggugaucgacaucaacauggaggacuacuccaucgacucguccuacgugugcucgggccuggucggggacacgccccggaacgacgacuccagcuccaacucgaacugccgcgaccccaacaacgagcggggcaaccccggggugaagggcugggccuucgacaacggggacgacguguggaugggccgcaccaucuccaaggaccugcggucgggcuacgagaccuucaaggucaucgggggcugguccaccccgaacagcaagucccaggugaaccgccaggucaucguggacaacaacaacuggucgggguacuccggcaucuucucgguggagggcaagagcugcaucaaccggugcuucuacgucgagcucauccgcggccgcccccaggagacccgggugugguggaccuccaacucgaucguggucuucugcggcacguccgggaccuacggcaccgggagcuggcccgacggcgccaacaucaacuucaugcccaucuga

SEQ ID NO: 16473 - RNA, 1410 nt, Artificial Sequence
  derived and/or modified CDS sequence (AUadapt) from InfluenzaA__AAO46214__NA
augaaccccaaccagaagaucaucaccaucggcucggugucccugaccaucgccacggucugcuuccucaugcagaucgccauccuggcgaccaccgugacccugcacuucaagcagcacgagugcgacucgccggccuccaaccaggugaugcccugcgagcccaucaucaucgagcgcaacaucacggagaucgucuaccucaacaacaccaccaucgagaaggagaucugccccgaggccguggaguaccggaacuggagcaagccgcagugccagaucaccggguucgcccccuucuccaaggacaacucgauccgccuguccgccggcggggacaucugggugacgcgggagcccuacgucucgugcgaccccggcaagugcuaccaguucgcgcuggggcagggcaccacccucgacaacaagcacuccaacggcaccauccacgaccgcaucccgcaccggacgcugcugaugaacgagcucggggugcccuuccaccugggcaccaagcaggucugcguggccuggagcuccucguccugccacgacgggaaggccuggcugcacgugugcgugaccggcgacgaccgcaacgccaccgcgucguucaucuacgacgggcggcucgucgacuccaucggcagcuggucccagaacauccugcgcacgcaggagucggagugcgugugcaucaacggcaucugcaccguggucaugaccgacggguccgccucgggccgggccgacacccgcauccuguucaucgaggaggggaagaucgugcacaucagcccccucuccggcucggcccagcacguggaggagugcuccugcuacccccgguacccggacguccgcugcaucugccgggacaacuggaagggcucgaaccgccccgugaucgacaucaacauggaggacuacuccaucgacagcuccuacgugugcucggggcuggucggcgacacgccccggaacgacgaccgcuccucgaacuccaacugccgggaccccaacaacgagcgcgggaacccgggcgugaaggggugggccuucgacaacggcgacgacguguggaugggccggaccaucagcaaggaccugcgcuccggguacgagaccuucaaggucaucggcggguggucgacccccaacuccaagucgcaggugaaccggcaggucaucguggacaacaacaacugguccggcuacagcgggaucuucuccguggagggcaagucgugcaucaaccgcugcuucuacgucgagcucauccgcggccggcagcaggagacgcgcgugugguggaccucgaacuccaucguggucuucugcgggaccagcggcaccuacgggacgggcuccuggcccgacggggcgaacaucaacuucaugcccaucuga

SEQ ID NO: 16474 - RNA, 1410 nt, Artificial Sequence
  derived and/or modified CDS sequence (AUadapt) from InfluenzaA__AAO46215__NA
augaaccccaaccagaagaucaucaccaucggcucggugucccugaccaucgccacggucugcuuccucaugcagaucgccauccuggcgaccaccgugacccugcacuucaagcagcacgagugcgacucgccgacguccaaccaggugaugcccugcgagcccaucaucaucgagcgcaacaucaccgagaucgucuaccucaacaacaccaccaucgagaaggagaucugccccgaggugguggaguaccggaacuggagcaagccgcagugccagaucacgggguucgcccccuucuccaaggacaacucgauccgccuguccgccggcggggacaucugggucacccgggagcccuacgugucgugcgaccccggcaagugcuaccaguucgcccuggggcagggcaccacccucgacaacaagcacuccaacggcacgauccacgaccgcaucccgcaccggacccugcugaugaacgagcucggggugcccuuccaccugggcaccaagcaggucugcguggccuggagcuccucguccugccacgacgggaaggcguggcugcacgugugcgucaccggcgacgaccgcaacgccacggccucguucaucuacgacgggcggcucguggacuccaucggcagcuggucccagaacauccugcgcacccaggagucggagugcgugugcaucaacgggaccugcaccgucgugaugacggacggcuccgccucgggccgggcggacacccgcauccuguucaucaaggaggggaagaucgugcacaucagcccccucuccggcucggcccagcacaucgaggagugcuccugcuacccccgguacccggacguccgcugcaucugccgggacaacuggaagggcagcaaccgccccgugaucgacaucaacauggaggacuacuccaucgacucguccuacgugugcucggggcuggucggcgacacgccccggaacggggacuccagcuccaacucgaacugccgcgaccccaacaacgagcggggcaacccgggggugaagggcugggccuucgacaacggcgacgacguguggauggggcgcaccaucuccaaggagucgcgguccggcuacgagaccuucaaggucaucgggggcuggagcacccccaacuccaagucgcaggugaaccgccaggucaucguggacaacaacaacugguccggguacucgggcaucuucagcguggagggcaaguccugcaucaaccggugcuucuacgucgagcugauccgcgggcgcccccaggagacccgggugugguggaccucgaacuccaucguggucuucugcggcacgagcgggaccuacggcaccggguccuggcccgacggcgccaacaucaacuucaugccgaucuga

SEQ ID NO: 16475 - RNA, 1410 nt, Artificial Sequence
  derived and/or modified CDS sequence (AUadapt) from InfluenzaA__AAO46216__NA
augaaccccaaccagaagaucaucaccaucggcucggugucccugaccaucgccacggucugcuuccucaugcagaucgccauccuggcgaccaccgugacccugcacuucaagcagcacgagugcgacucgccggccuccaaccaggugaugcccugcgagcccaucaucaucgagcgcaacaucacggagaucgucuaccucaacaacaccaccaucgagaaggagaucugccccgaggugguggaguaccggaacuggagcaagccgcagugccagaucaccggguucgcccccuucuccaaggacaacucgauccgccuguccgccggcggggacaucugggucacgcgggagcccuacgugagcugcgaccccuccaagugcuaccaguucgcccugggccaggggaccacccucgagaacaagcacucgaacggcaccaagcacgaccgcaucccgcaccggacgcugcugaugaacgagcucggcgugcccuuccaccuggggaccaagcaggucugcguggcgugguccucguccagcugccacgacggcaaggccuggcugcacgugugcgucaccggggacgaccgcaacgccaccgccuccuucaucuacgagggccggcucguggacucgaucguguccuggagccagaacauccugcgcacgcaggaguccgagugcgucugcaucaacgggaccugcaccguggugaugaccgacggcucggcgagcggccgggccgacacgcgcauccuguucaucaaggaggggaagaucguccacaucucgccccucuccggcuccgcccagcacaucgaggagugcucgugcuacccccgguacccggacgugcgcugcaucugccgggacaacuggaagggguccaaccgccccgugaucgacaucaacauggaggacuacagcaucgacuccucguacgucugcuccggccuggugggcgacacgccccggaacgacgacagcuccucgaacuccaacugccgcgaccccaacaacgagcgggggaacccgggcgugaaggggugggccuucgacaacggcgacgacgucuggauggggcgcaccaucagcaaggacucccggucgggcuacgagaccuucaaggugaucggcgggugguccacccccaacucgaagucccaggucaaccgccaggugaucguggacagcaacaacuggucgggcuacuccgggaucuucagcgucgagggcaaguccugcaucaaccggugcuucuacguggagcugauccgcgggcgcccccaggagacccgggugugguggaccucgaacuccaucgucguguucugcggcaccagcggcacguacgggaccggcuccuggcccgacggggccaacaucaacuucaugccgaucuga

SEQ ID NO: 16476 - RNA, 1410 nt, Artificial Sequence
  derived and/or modified CDS sequence (AUadapt) from InfluenzaA__AAO46217__NA
augaaccccaaccagaagaucaucaccaucggcucggugucccugaccaucgccacggucugcuuccucaugcagaucgccauccuggcgaccaccgugacccugcacuucaagcagcacgagugcgacucgccggccuccaaccaggugaugcccugcgagcccaucaucaucgagcgcaacaucacggagaucgucuaccucaacaacaccaccaucgagaaggagaucugccccgaggugguggaguaccggaacuggagcaagccgcagugccagaucaccggguucgcccccuucuccaaggacaacucgauccgccuguccgccggcggggacaucugggucacgcgggagcccuacgugagcugcgaccccuccaagugcuaccaguucgcccugggccaggggaccacccucgacaacaagcacucgaacggcaccauccacgaccgcaucccgcaccggacgcugcugaugaacgagcucggcgugcccuuccaccuggggaccaagcaggucugcguggcgugguccucguccagcugccacgacggcaaggccuggcugcacgugugcgucaccggggacgaccgcaacgccaccgccuccuucaucuacgacggccggcucgaggacucgaucggguccuggagccagaacauccugcgcacgcaggaguccgagugcgugugcaucaacgggaccugcaccguggucaugaccgacggcucggcgagcgggcgggccgacacgcgcauccuguucaucaaggagggcaagaucgugcacaucucgccccucuccggguccgcccagcacaucgaggagugcucgugcuacccccgguacccggacgugcgcugcaucugccgggacaacuggaagggcuccaaccgccccguccuggacaucagcauggaggacuacuccaucgacucguccuacgugugcagcggccuggugggggacacgccccggaacgacgacuccucguccaacagcaacugccgcgaccccaacaacgagcggggcaacccgggggucaagggcugggccuucgacaacggggacgacguguggaugggccgcaccaucuccaaggaccuccggucgggcuacgagaccuucaaggugaucgggggcugguccacccccaacucgaagucccaggucaaccgccaggugaucgucgacaacaacaacuggagcggguacucgggcaucuucuccguggagggcaagagcugcaucaaccggugcuucuacguggagcugauccgcggccgcucccaggagacccgggucugguggaccucgaacuccaucgugguguucugcggcaccagcgggacguacggcaccggguccuggcccgacggcgccaacaucaacuucaugcccaucuga

SEQ ID NO: 16477 - RNA, 1410 nt, Artificial Sequence
  derived and/or modified CDS sequence (AUadapt) from InfluenzaA__AAO46218__NA
augaaccccaaccagaagaucaucaccaucggcucggugucccugaccaucgccacggucugcuuccucaugcagaucgccauccuggcgaccaccgugacccugcacuucaagcagcacgagugcgacucgccggccuccaaccaggugaugcccugcgagcccaucaucaucgagcgcaacaucacggagaucgucuaccucaacaacaccaccaucgagaaggagaucugccccgaggugguggaguaccggaacuggagcaagccgcagugccagaucaccggguucgcccccuucuccaaggacaacucgauccgccuguccgccggcggggacaucugggucacgcgggagcccuacgugucgugcgaccccggcaagugcuaccaguucgcccuggggcagggcaccacccucgacaacaagcacuccaacggcaccauccacgaccgcaucccgcaccggacgcugcugaugaacgagcucggggugcccuuccaccugggcaccaagcaggucugcguggcguggagcuccucguccugccacgacgggaaggccuggcugcacgugugcgucaccggcgacgaccgcaacgccaccgccagcuucaucuacgacgggcggcucgaggacuccaucggcucguggucccagaacauccugcgcacgcaggagucggagugcgugugcaucaacgggaccugcaccguggucaugaccgacggcuccgcgagcggccgggccgacacgcgcauccuguucaucaaggaggggaagaucgugcacaucucgccccucuccggcagcgcccagcacaucgaggagugcuccugcuacccccgguacccggacgugcgcugcaucugccgggacaacuggaagggcucgaaccgccccguccuggacaucuccauggaggacuacucgaucggguccagcuacgugugcuccggccuggugggggacacgccccggaacgacgacucguccucgaacuccaacugccgcgaccccaacaacgagcggggcaacccgggggucaagggcugggccuucgacaacggcgacgacguguggauggggcgcaccaucagcaaggaccuccgguccggcuacgagaccuucaaggugaucgggggcuggucgacccccaacuccaagagccaggucaaccgccaggugaucgucgacaacaacaacugguccggguacucgggcaucuucucgguggagggcaaguccugcaucaaccggugcuucuacguggagcugauccgcgggcgcagccaggagacccgggucugguggaccuccaacucgaucgugguguucugcggcaccuccgggacguacggcaccgggagcuggcccgacggcgccaacaucaacuucaugcccaucuga

SEQ ID NO: 16478 - RNA, 1410 nt, Artificial Sequence
  derived and/or modified CDS sequence (AUadapt) from InfluenzaA__AAO46220__NA
augaaccccaaccagaagaucaucaccaucggcucggugucccugaccaucgccacggucugcuuccucaugcagaucgccauccuggcgaccaccgugacccugcacuucaagcagcacgagugcgacucgccggccuccaaccaggugaugcccugcgagcccaucaucaucgagcgcaacaucacggagaucgucuaccucaacaacaccaccaucgagaaggagaucugccccgaggccguggaguaccggaacuggagcaagccgcagugccagaucaccggguucgcccccuucuccaaggacaacucgauccgccuguccgccggcggggacaucugggugacgcgggagcccuacgucucgugcgaccccggcaagugcuaccaguucgcgcuggggcagggcaccacccucgacaacaagcacuccaacgacaccauccacgaccgcaucccgcaccggacgcugcugaugaacgagcucggcgugcccuuccaccuggggacccgccaggugugcgucgccuggagcuccucguccugccacgacggcaaggccuggcugcacgugugcgugaccggggacgaccggaacgccaccgcgucguucaucuacgacggccgccucgucgacuccaucgggagcuggucccagaacauccugcggacgcaggagucggagugcgugugcaucaacggcaucugcaccguggucaugaccgacggcuccgccucggggcgcgccgacacccggauccuguucaucgaggagggcaagaucgugcacaucagcccccucuccgggucggcccagcacguggaggagugcuccugcuacccccgcuacccggacguccggugcaucugccgcgacaacuggaagggcucgaaccggcccgugaucgacaucaacauggaggacuacuccaucgacagcuccuacgugugcucgggccuggucggggacacgccccgcaacgacgaccgguccucgaacuccaacugccgcgaccccaacaacgagcggggcaacccgggggugaagggcugggccuucgacaacggggacgacguguggaugggccgcaccaucagcaaggaccugcgguccggcuacgagaccuucaaggucaucgggggcuggucgacccccaacuccaagucgcaggugaaccgccaggucaucguggacaacaacaacugguccggguacagcggcaucuucuccguggagggcaagucgugcaucaaccgcugcuucuacgucgagcucauccgggggcgccagcaggagacgcgggugugguggaccucgaacuccaucguggucuucugcggcaccagcgggaccuacggcacgggguccuggcccgacggcgcgaacaucaacuucaugcccaucuga

SEQ ID NO: 16479 - RNA, 1410 nt, Artificial Sequence
  derived and/or modified CDS sequence (AUadapt) from InfluenzaA__AAO46221__NA
augaaccccaaccagaagaucaucaccaucggcucggugucccugaccaucgccacggucugcuuccucaugcagaucgccauccuggcgaccaccgugacccugcacuucaagcagcacgagugcgacucgccggccuccaaccaggugaugcccugcgagcccaucaucaucgagcgcaacaucacggagaucgucuaccucaacaacaccaccaucgagaaggagaucugccccgaggccgccgaguaccggaacuggucgaagccgcagugccagaucaccggguucgcccccuucuccaaggacaacagcauccgccuguccgcgggcggggacaucugggugacgcgggagcccuacgugucgugcgaccccggcaagugcuaccaguucgcccuggggcagggcaccacccucgacaacaagcacuccaacgacaccauccacgaccgcaucccgcaccggacgcugcugaugaacgagcucggcguccccuuccaccuggggacccgccaggugugcguggccuggucguccagcuccugccacgacggcaaggccuggcugcacgucugcgugaccggggacgaccggaacgcgaccgccucguucaucuacgacggccgccucguggacuccaucgggucguggucccagaacauccugcggacgcaggagucggagugcgucugcaucaacggcaucugcaccguggugaugaccgacggcuccgccagcgggcgcgccgacacccggauccuguucaucgaggagggcaagaucguccacaucucgccccucuccgggucggcccagcacguggaggagugcuccugcuacccccgcuacccggacgugcggugcaucugccgcgacaacuggaagggcagcaaccggcccgucaucgacaucaacauggaggacuacuccaucgacucguccuacgugugcucgggccuggugggggacacgccccgcaacgacgaccgguccucgaacuccaacugccgcgaccccaacaacgagcggggcaacccgggggucaagggcugggcguucgacaacggggacgacguguggaugggccgcaccaucagcaaggaccugcgguccggcuacgagaccuucaaggugaucgggggcuggucgacccccaacuccaagucgcaggucaaccgccaggugaucgucgacaacaacaacugguccggguacagcggcaucuucuccguggagggcaagucgugcaucaaccgcugcuucuacguggagcucauccgggggcgccagcaggagacgcgggucugguggaccucgaacuccaucgugguguucugcggcaccagcgggaccuacggcacgggguccuggcccgacggcgccaacaucaacuucaugcccaucuga

SEQ ID NO: 16480 - RNA, 1410 nt, Artificial Sequence
  derived and/or modified CDS sequence (AUadapt) from InfluenzaA__AAO46223__NA
augaaccccaaccagaagaucaucaccaucggcucggugucccugaccaucgccacggucugcuuccucaugcagaucgccauccuggugaccaccgugacccugcacuucaagcagcacgagugcgacucgccggcguccaaccaggucaugcccugcgagcccaucaucaucgagcgcaacaucacggagaucguguaccucaacaacaccaccaucgagaaggagaucugccccgagguggucgaguaccggaacuggagcaagccgcagugccagaucaccggguucgcccccuucuccaaggacaacucgauccgccuguccgccggcggggacaucugggugacgcgggagcccuacgugagcugcgaccccggcaagugcuaccaguucgcccuggggcagggcaccacccucgacaacaagcacuccaacgacaccauccacgaccgcaucccgcaccggacgcugcugaugaacgagcucggcguccccuuccaccuggggacccgccaggugugcguggccuggucguccucguccugccacgacggcaaggcguggcugcacgucugcgugaccggggacgacaagaacgccaccgccagcuucaucuacgacggccggcucguggacuccaucgggucguggucccagaacauccugcgcacgcaggagagcgagugcgucugcaucaacgggaccugcaccguggugaugaccgacggcuccgccucggggcgggcggacacgcgcauccuguucaucgaggagggcaagaucguccacaucucgccccucuccgggagcgcccagcacguggaggagugcuccugcuacccccgguacccggacgugcgcugcaucugccgggacaacuggaagggcucgaaccgccccgucaucgacaucaacauggaggacuacuccaucgacagcuccuacgugugcucgggccuggugggggacacgccccggaacgacgaccgcuccucgaacuccaacugccgggaccccaacaacgagcgcggcaacccgggggucaagggcugggccuucgacaacggggacgacguguggaugggccggaccaucagcaaggaccugcgcuccggcuacgagaccuucaaggucaucgggggcuggucgacccccaacuccaagagccagaucaaccgccaggugaucguggacuccaacaacuggucgggguacuccggcaucuucucggucgagggcaagagcugcaucaaccggugcuucuacguggagcucauccgcggccggaagcaggagacccgcgugugguggaccuccaacucgaucgucguguucugcggcaccuccgggacguacggcaccgggagcuggcccgacggcgccaacaucaacuucaugcccaucuga

SEQ ID NO: 16481 - RNA, 1410 nt, Artificial Sequence; identical to SEQ ID NO: 16480
  derived and/or modified CDS sequence (AUadapt) from InfluenzaA__AAO46224__NA

SEQ ID NO: 16482 - RNA, 1410 nt, Artificial Sequence
  derived and/or modified CDS sequence (AUadapt) from InfluenzaA__AAO46225__NA
augaaccccaaccagaagaucaucaccaucggcuucgugucgcugaucaucgccaccgucugcuuccucaugcagaucgccauccuggcgacgaccgugacccugcacuucaagcagcacgagugcgacuccccggccucgaaccaggugaugcccugcgagcccaucaucaucgagcgcaacaucaccaagaucgucuaccucaacaacacgaccaucgagaaggagaucugccccgaggugguggaguaccggaacugguccaagccgcagugccacaucaccggguucgcccccuucagcaaggacaacuccauccgccugucggccggcggggacaucugggucacccgggagcccuacguguccugcgaccccggcaagugcuaccaguucgcccuggggcagggcacgacccucgacaacaagcacagcaacgacaccauccacgaccgcaucccgcaccggacccugcugaugaacgagcucggcgugcccuuccaccuggggacgcgccaggucugcguggcgugguccucguccucgugccacgacggcaaggccuggcugcacgugugcgucaccggggacgacaagaacgccaccgccuccuucaucuacgacggccggcucguggacagcaucggguccuggucgcacaacauccugcgcacccaggaguccgagugcgugugcaucaacggcacgugcaccgucgugaugaccgacggcagcgcguccgggcgggccgacacccgcauccuguucaucaaggagggcaagaucgugcacaucucgccccucagcggguccgcccagcacgucgaggagugcucgugcuacccccgguacccggacgugcgcugcaucugccgggacaacuggaagggcuccaaccgccccgugaucgacaucaacauggaggacuacucgaucgacuccagcuacgucugcuccggccuggugggggacacgccccggaacaacgacggcucguccaacagcaacugccgcgaccccaacaacgagcgggggaacccgggcgugaaggggugggccuucgacaacggcgacgacgucuggaugggccgcaccaucuccaaggaccugcggucgggguacgagaccuucaaggugaucggcgggugguccacccccaacucgaagucccaggucaaccgccaggugaucguggacaacaacaacuggagcggcuacuccgggaucuucucggucgagggcaaguccugcaucaaccggugcuucuacguggagcucauccgcggccgccagcaggagacgcgggugugguggaccagcaacucgaucgucguguucugcgggaccuccggcaccuacgggacgggcagcuggcccgacggggccaacaucaacuucaugcccaucuga

SEQ ID NO: 16483 - RNA, 1410 nt, Artificial Sequence
  derived and/or modified CDS sequence (AUadapt) from InfluenzaA__AAO46226__NA
augaaccccaaccagaagaucaucaccaucggcucggugucccugaccaucgccacggucugcuuccucaugcagaucgccauccuggugaccaccgugacccugcacuucaagcagcacgagugcgacucgccggcguccaaccaggucaugcccugcgagcccaucaucaucgagcgcaacaucacggagaucguguaccucaacaacaccaccaucgagaaggagaucugccccgagguggucgaguaccggaacuggagcaagccgcagugccagaucaccggguucgcccccuucuccaaggacaacucgauccgccuguccgccggcggggacaucugggugacgcgggagcccuacgugagcugcgaccccggcaagugcuaccaguucgcccuggggcagggcaccacccucgacaacaagcacuccaacgacaccauccacgaccgcaucccgcaccggacgcugcugaugaacgagcucggcguccccuuccaccuggggacccgccaggugugcguggccuggucguccucguccugccacgacggcaaggcguggcugcacgucugcgugaccggggacgacgagaacgccaccgccagcuucaucuacgacggccggcucguggacuccaucgggucguggucccagaacauccugcgcacgcaggagagcgagugcgucugcaucaacgggaccugcaccguggugaugaccgacggcuccgccucggggcgggcggacacgcgcauccuguucaucgaggagggcaagaucguccacaucucgccccucuccgggagcgcccagcacguggaggagugcuccugcuacccccgguacccggacgugcgcugcaucugccgggacaacuggaagggcucgaaccgccccgucaucgacaucaacauggaggacuacuccaucgacagcuccuacgugugcucgggccuggugggggacacgccccggaacgacgaccgcuccucgaacuccaacugccgggaccccaacaacgagcgcggcaacccgggggucaagggcugggccuucgacaacggggacgacguguggaugggccggaccaucagcaaggaccugcgcuccggcuacgagaccuucaaggucaucgggggcuggucgacccccaacuccaagagccagaucaaccgccaggugaucguggacuccaacaacuggucgggguacuccggcaucuucucggucgagggcaagagcugcaucaaccggugcuucuacguggagcucauccgcggccggcagcaggagacccgcgugugguggaccuccaacucgaucgucguguucugcggcaccuccgggacguacggcaccgggagcuggcccgacggcgccaacaucaacuucaugcccaucuga

SEQ ID NO: 16484 - RNA, 1410 nt, Artificial Sequence
  derived and/or modified CDS sequence (AUadapt) from InfluenzaA__AAO46229__NA
augaaccccaaccagaagaucaucaccaucggcucggugucccugaccaucgccacggucugcuuccucaugcagaucgccauccuggugaccaccgugacccugcacuucaagcagcacgagugcgacucgccggcguccaaccaggucaugcccugcgagcccaucaucaucgagcgcaacaucacggagaucauguaccucaacaacaccaccaucgagaaggagaucugccccgaggugguggaguaccggaacuggagcaagccgcagugccagaucaccggguucgcccccuucuccaaggacaacucgauccgccuguccgccggcggggacaucugggucacgcgggagcccuacgugagcugcgaccccggcaagugcuaccaguucgcccuggggcagggcaccacccucgacaacaagcacuccaacgacaccauccacgaccgcaucccgcaccggacgcugcugaugaacgagcucggcgugcccuuccaccuggggacccgccaggucugcguggccuggucguccucguccugccacgacggcaaggcguggcugcacgugugcgucaccggggacgacaagaacgccaccgccagcuucaucuacgacggccggcucguggacuccaucgggucguggucccagaacauccugcgcacgcaggagagcgagugcgugugcaucaacgggaccugcaccgucgugaugaccgacggcuccgccucggggcgggcggacacgcgcauccuguucaucgaggagggcaagaucgugcacaucucgccccucuccgggagcgcccagcacgucgaggagugcuccugcuacccccgguacccggacgugcgcugcaucugccgggacaacuggaagggcucgaaccgccccaucaucgacaucaacauggaggacuacuccaucgacagcuccuacgugugcucgggccuggucggggacacgccccggaacgacgaccgcuccucgaacuccaacugccggaaccccaacaacgagcgcggcaacccgggggugaagggcugggccuucgacaacggggacgacguguggaugggccggaccaucagcaaggaccugcgcuccggcuacgagaccuucaaggucaucgggggcuggucgacccccaacuccaagagccagaucaaccgccaggugaucgucgacuccaacaacuggucgggguacuccggcaucuucucgguggagggcaagagcugcaucaaccggugcuucuacguggagcucauccgcggccggcagcaggagacccgcgucugguggaccuccaacucgaucgugguguucugcggcaccuccgggacguacggcaccgggagcuggcccgacggcgccaacaucaacuucaugcccaucuga

SEQ ID NO: 16485 - RNA, 1410 nt, Artificial Sequence
  derived and/or modified CDS sequence (AUadapt) from InfluenzaA__AAO46230__NA
augaaccccaaccagaagaucaucaccaucggcucggugucccugaccaucgccacggucugcuuccucaugcagaucgccauccuggugaccaccgugacccugcacuucaagcagcacgagugcgacucgccggcguccaaccaggucaugcccugcgagcccaucaucaucgagcgcaaccucacggagaucguguaccugaacaacaccaccaucgagaaggagaucugccccgagguggucgaguaccggaacuggagcaagccgcagugccagaucaccggguucgcccccuucuccaaggacaacucgauccgccuguccgccggcggggacaucugggugacgcgggagcccuacgugagcugcgaccccggcaagugcuaccaguucgcccucgggcagggcaccacccuggacaacaagcacuccaacgacaccauccacgaccgcaucccgcaccggacgcugcucaugaacgagcugggcguccccuuccaccuggggacccgccaggugugcguggccuggucguccucguccugccacgacggcaaggcguggcuccacgucugcgugaccggggacgacaagaacgccaccgccagcuucaucuacgacggccggcugguggacuccaucgggucguggucccagaacauccugcgcacgcaggagagcgagugcgucugcaucaacgggaccugcaccguggugaugaccgacggcuccgccucggggcgggcggacacgcgcauccucuucaucgaggagggcaagaucguccacaucucgccccuguccgggagcgcccagcacguggaggagugcuccugcuacccccgguacccggacgugcgcugcaucugccgggacaacuggaagggcucgaaccgccccgucaucgacaucaacauggaggacuacuccaucgacagcuccuacgugugcucgggccuggugggggacacgccccggaacgacgaccgcuccucgaacuccaacugccgggaccccaacaacgagcgcggcaacccgggggucaagggcugggccuucgacaacggggacgacguguggaugggccggaccaucagcaaggaccuccgcuccggcuacgagaccuucaaggucaucgggggcuggucgacccccaacuccaagagccagaucaaccgccaggugaucguggacuccaacaacuggucgggguacuccggcaucuucucggucgagggcaagagcugcaucaaccggugcuucuacguggagcugauccgcggccggcagcaggagacccgcgugugguggaccuccaacucgaucgucguguucugcggcaccuccgggacguacggcaccgggagcuggcccgacggcgccaacaucaacuucaugcccaucuga

SEQ ID NO: 16486 - RNA, 1410 nt, Artificial Sequence
  derived and/or modified CDS sequence (AUadapt) from InfluenzaA__AAO46231__NA
augaaccccaaccagaagaucaucaccaucggcucggugucccugaccaucgccacggucugcuuccucaugcagaucgccauccuggugaccaccgugacccugcacuucaagcagcacgacugcgacucgccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacucgauccgccuguccgccggcggggacaucugggugacgcgggagcccuacgugagcugcgaccccgucaagugcuaccaguucgcccugggccaggggaccacccucgacaacaagcacuccaacgacaccgugcacgaccgcaucccgcaccggacgcugcugaugaacgagcucggcgugcccuuccaccugggcacccgccaggucugcaucgccuggucguccagcuccugccacgacgggaaggcguggcugcacgugugcgugaccggcgacgacaagaacgccaccgccucguucaucuacgacgggcggcucgucgacuccaucggcucguggucccagaacauccugcgcacgcaggagagcgagugcgugugcaucaacgggaccugcaccguggucaugaccgacggcuccgccucgggccgggcggacacgcgcauccuguucaucgaggaggggaagaucgugcacaucagcccccucuccggcucggcccagcacguggaggagugcuccugcuacccccgguacccggacguccgcugcaucugccgggacaacuggaaggggagcaaccgccccgugaucgacaucaacauggaggacuacuccaucgacucguccuacgugugcagcggccuggucggcgacacgccccggaacgacgaccgcuccucgaacuccaacugccggaaccccaacaacgagcgcgggaacccgggcgugaaggggugggccuucgacaacggcgacgacgucuggauggggcggaccaucucgaaggaccugcgcuccggcuacgagaccuucaaggugaucggcggguggagcacccccaacuccaagucgcagaucaaccgccaggugaucgucgacuccaacaacuggagcggcuacuccgggaucuucucgguggagggcaagagcugcaucaaccggugcuucuacguggagcucauccgcgggcggcagcaggagacccgcgucugguggaccuccaacucgaucgugguguucugcggcaccuccggcacguacgggaccggcagcuggcccgacggggccaacaucaacuucaugcccaucuga

SEQ ID NO: 16487 - RNA, 1410 nt, Artificial Sequence
  derived and/or modified CDS sequence (AUadapt) from InfluenzaA__AAO46232__NA
augaaccccaaccagaagaucaucaccaucggcucggugucccugaccaucgccacggucugcuuccucaugcagaucgccauccuggugaccaccgugacccugcacuucaagcagcacgagugcgacucgccggcguccaaccaggucaugcccugcgagcccacgaucaucgagcgcaacaucaccgagaucguguaccucaacaacaccaccaucgagaaggagaucugccccaagguggucgaguaccggaacuggagcaagccgcagugccagaucacgggguucgcccccuucuccaaggacaacucgauccgccuguccgccggcggggacaucugggugacccgggagcccuacgugucgugcgaccccggcaagugcuaccaguucgcccuggggcagggcaccacccucgacaacaagcacuccaacgacacgauccacgaccgcaucccgcaccggacccugcugaugaacgagcucggcguccccuuccaccuggggacccgccaggugugcaucgccuggagcuccucguccugccacgacggcaaggcguggcugcacgugugcgucaccggggacgacaagaacgccacggccucguucaucuacgacggccggcucguggacuccaucgggagcuggucccagaacauccugcgcacccaggagucggagugcgugugcaucaacgggaccugcaccgucgugaugacggacggcuccgccucggggcgggcggacacccgcauccuguucaucgaggagggcaagaucgugcacaucagcccccucuccgggucggcccagcacgucgaggagugcuccugcuacccccgguacccggacgugcgcugcaucugccgggacaacuggaagggcagcaaccgccccaucaucgacaucaacauggaggacuacuccaucgacucguccuacgugugcucgggccuggucggggacacgccccggaacgacgaccgcuccagcaacuccaacugccggaaccccaacaacgagcgcggcaacccgggggugaagggcugggccuucgacaacggggacgacguguggaugggccggaccaucucgaaggaccugcgcuccggcuacgagaccuucaaggucaucgggggcuggucgacccccaacuccaagagccagaucaaccgccaggugaucgucgacuccaacaacuggucgggguacuccggcaucuucucgguggagggcaagagcugcaucaaccggugcuucuacguggagcucauccgcggccggcagcaggagacccgcgucugguggaccuccaacucgaucgugguguucugcggcacguccgggaccuacggcaccgggagcuggcccgacggcgccaacaucaacuucaugcccaucuga

SEQ ID NO: 16488 - RNA, 1410 nt, Artificial Sequence
  derived and/or modified CDS sequence (AUadapt) from InfluenzaA__AAO46233__NA
augaaccccaaccagaagaucaucaccaucggcucggugucccugaccaucgccgccgucugcuuccucaugcagaucgcgauccuggugacgaccgugacccugcacuucaagcagcacgagugcgacucgccggccuccaaccaggucaugcccugcgagcccaucaucaucgagcgcaacaucaccgagaucguguaccucaacaacacgaccaucgagaaggagaucugccccaagguggucgaguaccggaacuggagcaagccgcagugccagaucaccggguucgcccccuucuccaaggacaacucgauccgccuguccgccggcggggacaucugggugacccgggagcccuacgugucgugcgaccccggcaagugcuaccaguucgcccuggggcagggcacgacccucgacaacaagcacuccaacgacaccauccacgaccgcaucccgcaccggacccugcugaugaacgagcucggcguccccuuccaccuggggacgcgccaggugugcaucgcguggagcuccucguccugccacgacggcaaggccuggcugcacgugugcgucaccggggacgacaagaacgccaccgccucguucaucuacgacggccggcucguggacuccaucgggagcuggucccagaacauccugcgcacccaggagucggagugcgugugcaucaacggcacgugcaccgucgugaugaccgacggcuccgcgucggggcgggccgacacccgcauccuguucaucgaggagggcaagaucgugcacaucagcccccucuccgggucggcccagcacgucgaggagugcuccugcuacccccgguacccggacgugcgcugcaucugccgggacaacuggaagggcucgaaccgccccguggucgacaucaacauggaggacuacuccaucgacagcuccuacgugugcucgggccuggugggggacacgccccggaacgacgaccgcuccucgaacuccaacugccggaaccccaacaacgagcgcggcaacccgggggucaagggcugggccuucgacaacggggacgacguguggaugggccggaccaucagcaaggaccugcgcuccggcuacgagaccuucaaggucaucgggggcuggucgacccccaacuccaagucgcagaucaaccgccaggugaucguggacuccaacaaccggagcggguacuccggcaucuucucggucgaggggaagggcugcaucaaccgcugcuucuacguggagcucauccggggccgccagcaggagacgcgggugugguggaccucgaacuccaucgucguguucugcgggaccagcggcaccuacgggacgggcuccuggcccgacggggccaacaucaacuucaugcccaucuga

SEQ ID NO: 16489 - RNA, 1410 nt, Artificial Sequence
  derived and/or modified CDS sequence (AUadapt) from InfluenzaA__AAO46235__NA
augaaccccaaccagaagaucaucaccaucggcucggugucccugaccaucgccacggucugcuuccucaugcagaucgccauccuggugaccaccgugacccugcacuucaagcagcacgagugcgacucgccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacucgauccgccuguccgccggcggggacaucugggugacgcgggagcccuacgugucgugcgaccccggcaagugcuaccaguucgcccuggggcagggcaccacccucgacaacaagcacuccaacgacaccauccacgaccgcaucccgcaccggacgcugcugaugaacgagcucggcguccccuuccaccuggggacccgccaggugugcaucgccuggagcuccucguccugccacgacggcaaggcguggcugcacgugugcaucaccggggacgacaagaacgccaccgccucguucaucuacgacggccggcucgucgacuccaucgggagcuggucccagaacauccugcgcacgcaggagucggagugcgugugcaucaacgggaccugcaccguggucaugaccgacggcuccgccucgggccgggcggacacgcgcauccuguucaucgaggagggcaagaucgugcacaucagcccccucuccgggucggcccagcacguggaggagugcuccugcuacccccgguacccgggcguccgcugcaucugccgggacaacuggaagggcagcaaccgccccgugguggacaucaacauggaggacuacuccaucgacucguccuacgucugcucggggcuggugggcgacacgccccggaacgacgaccgcuccagcaacuccaacugccggaaccccaacaacgagcgcgggaaccagggcgugaaggggugggccuucgacaacggcgacgacgucuggaugggccggaccaucucgaaggaccugcgcuccggguacgagaccuucaaggugaucggcggguggucgaccccgaacuccaagagccagaucaaccggcaggucaucguggacuccgacaaccgcucgggcuacuccgggaucuucucgguggagggcaagagcugcaucaaccgcugcuucuacgucgagcucauccggggccgcaagcaggagacccgggugugguggaccuccaacucgaucguggucuucugcgggaccuccggcacguacgggaccggcagcuggcccgacggggccaacaucaacuucaugcccaucuga

SEQ ID NO: 16490 - RNA, 1410 nt, Artificial Sequence
  derived and/or modified CDS sequence (AUadapt) from InfluenzaA__AAO46236__NA
augaaccccaaccagaagaucaucaccaucggcucggugucccugaccaucgccacggucugcuuccucaugcacaucgccauccuggugaccaccgugacccugcacuucaagcagcacgagugcgacucgccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacucgauccgccuguccgccggcggggacaucugggugacgcgggagcccuacgugucgugcgaccccggcaagugcuaccaguucgcccuggggcagggcaccacccucgacaacaagcacuccaacgacaccauccacgaccgcaucccgcaccggacgcugcugaugaacgagcucggcguccccuuccaccuggggacccgccaggugugcaucgccuggagcuccucguccugccacgacggcaaggcguggcugcacgugugcaucaccggggacgacaagaacgccaccgccucguucaucuacgacggccggcucgucgacuccaucgggagcuggucccagaacauccugcgcacgcaggagucggagugcgugugcaucaacgggaccugcaccguggucaugaccgacggcuccgccucgggccgggcggacacgcgcauccuguucaucgaggagggcaagaucgugcacaucagcccccucuccgggucggcccagcacguggaggagugcuccugcuacccccgguacccgggcguccgcugcaucugccgggacaacuggaagggcagcaaccgccccgugguggacaucaacauggaggacuacuccaucgacucguccuacgucugcucggggcuggugggcgacacgccccggaacgacgaccgcuccagcaacuccaacugccggaaccccaacaacgagcgcgggaaccagggcgugaaggggugggccuucgacaacggcgacgacgucuggaugggccggaccaucucgaaggaccugcgcuccggguacgagaccuucaaggugaucggcggguggucgaccccgaacuccaagagccagaucaaccggcaggucaucguggacuccgacaaccgcucgggcuacuccgggaucuucucgguggagggcaagagcugcaucaaccgcugcuucuacgucgagcucauccggggccgcaagcaggagacccgggugugguggaccuccaacucgaucguggucuucugcgggaccuccggcacguacgggaccggcagcuggcccgacggggccaacaucaacuucaugcccaucuga

SEQ ID NO: 16491 - RNA, 1410 nt, Artificial Sequence
  derived and/or modified CDS sequence (AUadapt) from InfluenzaA__AAO46237__NA
augaaccccaaccagaagaucaucaccaucggcucggugucccugaccaucgccacggucugcuuccucaugcagaucgccauccuggugaccaccgugacccugcacuucaagcagcacgagugcgacucgccggcguccaaccaggucaugcccugcgagcccaucaucaucgagcgcaacaucacggagaucguguaccucaacaacaccaccaucgagaaggagaucugccccaagaucguggaguaccggaacuggagcaagccgcagugccagaucaccggguucgcccccuucuccaaggacaacucgauccgccuguccgccggcggggacaucugggucacgcgggagcccuacgugucgugcgaccccggcaagugcuaccaguucgcccuggggcagggcaccacccucgacaacaagcacuccaacgacaccauccacgaccgcaucccgcaccggacgcugcugaugaacgagcucggcgugcccuuccaccuggggacccgccaggucugcaucgccuggagcuccucguccugccacgacggcaaggcguggcugcacgugugcaucaccggggacgacaagaacgccaccgccucguucaucuacgacggccggcucguggacuccaucgggagcuggucccagaacauccugcgcacgcaggagucggagugcgucugcaucaacgggaccugcaccguggugaugaccgacggcuccgccucgggccgggcggacacgcgcauccuguucaucgaggagggcaagaucguccacaucagcccccucuccgggucggcccagcacguggaggagugcuccugcuacccccgguacccgggcgugcgcugcaucugccgggacaacuggaagggcagcaaccgccccgucguggacaucaacauggaggacuacuccaucgacucguccuacgugugcucggggcuggucggcgacacgccccggaacgacgaccgcuccagcaacuccaacugccggaaccccaacaacgagcgcgggaaccagggcgugaaggggugggccuucgacaacggcgacgacguguggaugggccggaccaucucgaaggaccugcgcuccggguacgagaccuucaaggucaucggcggguggucgaccccgaacuccaagagccagaucaaccgccaggugaucgucgacuccgacaaccggucgggcuacuccgggaucuucucgguggagggcaagagcugcaucaaccgcugcuucuacguggagcucauccggggccgcaagcaggagacccgggucugguggaccuccaacucgaucgugguguucugcgggaccuccggcacguacgggaccggcagcuggcccgacggggccaacaucaacuucaugcccaucuga

SEQ ID NO: 16492 - RNA, 1410 nt, Artificial Sequence
  derived and/or modified CDS sequence (AUadapt) from InfluenzaA__AAO46238__NA
augaaccccaaccagaagaucaucaccaucggcucggccucccugaccaucgccacggugugcuuccucaugcagaucgcgauccuggucaccaccgugacccugcacuucaagcagcacgagugcgacucgccggccuccaaccaggugaugcccugcgagcccaucaucaucgagcgcaacaucacggagaucgucuaccucaacaacaccaccaucgagaaggagaucugccccaagaucguggaguaccggaacuggucgaagccgcagugcaagaucaccggguucgcccccuucuccaaggacaacagcauccgccuguccgccggcggggacaucugggugacgcgggagcccuacgucucgugcgaccccggcaagugcuaccaguucgcccuggggcagggcaccacccucgacaacaagcacuccaacgacaccauccacgaccgcaucccgcaccggacgcugcugaugaacgagcucggcgugcccuuccaccuggggacccgccaggugugcaucgcguggucguccucguccugccacgacggcaaggccuggcugcacgucugcgugaccggggacgacaagaacgccaccgccagcuucaucuacgacggccggcucguggacuccaucgggucguggucccagaacauccugcgcacgcaggagucggagugcgucugcaucaacgggaccugcaccguggugaugaccgacggcuccgcgagcgggcgggccgacacgcgcauccuguucaucgaggagggcaagaucguccacaucucgccccucuccgggucggcccagcacguggaggagugcuccugcuacccccgguacccggacgugcgcugcaucugccgggacaacuggaagggcucgaaccgccccgucguggacaucaacauggaggacuacuccaucgacagcuccuacgugugcucgggccuggucggggacacgccccggaacgacgaccgcuccucgaacuccaacugccggaaccccaacaacgagaagggcaaccagggggugaagggcugggccuucgacaacggggacgacguguggaugggccgcaccaucagcaaggaccugcgguccggcuacgagaccuucaaggucaucgggggcuggucgaccccgaacuccaagucgcagaucaaccgccaggugaucgucgacuccgacaaccggucgggguacuccggcaucuucagcguggagggcaagucgugcaucaaccgcugcuucuacguggagcucauccgcggccggaagcaggagacccgcgucugguggaccuccaacucgaucgugguguucugcggcaccuccgggacguacggcaccgggagcuggcccgacggcgccaacaucaaccugaugcccaucuga

SEQ ID NO: 16493 - RNA, 1410 nt, Artificial Sequence
  derived and/or modified CDS sequence (AUadapt) from InfluenzaA__AAO46241__NA
augaaccccaaccagaagaucaucaccaucggcucggugucccugaccaucgccacggucugcuuccucaugcagaucgccauccuggugaccaccgugacccugcacuucaagcagcacgagugcgacucgccggcguccaaccaggucaugcccugcgagcccaucaucaucgagcgcaacaucacggagaucguguaccucaacaacaccaccaucgagaaggagaucugccccaagguggucggguaccggaacuggagcaagccgcagugccagaucaccggcuucgcccccuucuccaaggacaacucgauccgccuguccgccgggggcgacaucugggugacgcgggagcccuacgugucgugcgaccccgggaagugcuaccaguucgcccugggccagggcaccacccucgacaacaagcacuccaacgacaccauccacgaccgcaucccgcaccggacgcugcugaugaacgagcucgggguccccuuccaccugggcacccgccaggugugcaucgccuggagcuccucguccugccacgacgggaaggcguggcugcacgugugcaucaccggcgacgacaagaacgccaccgccucguucaucuacgacgggcggcucgucgacuccaucggcagcuggucccagaacauccugcgcacgcaggagucggagugcgugugcaucaacgggaccugcaccguggucaugaccgacggcuccgccucgggccgggcggacacgcgcauccuguucaucgaggaggggaagaucgugcacaucagcccccucuccggcucggcccagcacguggaggagugcuccugcuacccccgguacccgggcguccgcugcaucugccgggacaacuggaaggggagcaaccgccccgugguggacaucaacauggaggacuacuccaucgacucguccuacgucugcucgggccuggugggggacacgccccggaacgacgaccgcuccagcaacuccaacugccggaaccccaacaacgagcgcggcaaccagggggugaagggcugggccuucgacaacggcgacgacgucuggauggggcggaccaucucgaaggaccugcgcuccggcuacgagaccuucaaggugaucgggggcuggucgaccccgaacuccaagagccagaucaaccggcaggucaucguggacuccgacaaccgcucgggguacuccggcaucuucucgguggagggcaagagcugcaucaaccgcugcuucuacgucgagcucauccgggggcgcaagcaggagacccgggugugguggaccuccaacucgaucguggucuucugcggcaccuccgggacguacggcaccgggagcuggcccgacggcgccaacaucaacuucaugcccaucuga

SEQ ID NO: 16494 - RNA, 1410 nt, Artificial Sequence
  derived and/or modified CDS sequence (AUadapt) from InfluenzaA__AAO46245__NA
augaaccccaaccagaagaucaucaccaucggcucggugucccugaccaucgccacggucugcuuccucaugcagaucgccauccuggugaccaccgugacccugcacuucaagcagcacgacugcgacucgccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacucgauccgccuguccgccggcggggacaucugggugacgcgggagcccuacgugucgugcgaccccgucaagugcuaccaguucgcccugggccaggggaccacccucgacaacaagcacuccaacgacaccgugcacgaccgcaucccgcaccggacgcugcugaugaacgagcucggcgugcccuuccaccugggcacccgccaggucugcaucgccuggagcuccucguccugccacgacgggaaggcguggcugcacgugugcaucaccggcgacgacaagaacgccaccgccagcuucaucuacgacgggcggcucguggacuccaucggcucguggucccagaacauccugcgcacgcaggagucggagugcgucugcaucaacgggaccugcaccguggugaugaccgacggcuccgccagcggccgggcggacacgcgcauccuguucaucgaggaggggaagaucguccacaucucgccccucgccggcuccgcccagcacguggaggagugcucgugcuacccccgguacccgggggugcgcugcaucugccgggacaacuggaagggcuccaaccgccccgucguggacaucaacauggaggacuacagcaucgacuccucguacgugugcuccggccuggucggggacacgccccggaacgacgaccgcagcuccaacucgaacugccggaaccccaacaacgagcgcggcacccagggggugaagggcugggccuucgacaacgggaacgaccuguggaugggccggaccaucuccaaggaccuccgcucgggcuacgagaccuucaaggucaucgggggcugguccaccccgaacagcaagucccagaucaaccgccaggugaucguggacucggacaaccgguccggguacucgggcaucuucuccgucgagggcaagagcugcaucaaccgcugcuucuacguggagcugauccgggggcgcaagcaggagacccgggugugguggaccucgaacuccaucgucguguucugcggcacgagcgggaccuacggcaccggguccuggcccgacggcgccaacaucaacuucaugcccaucuga

SEQ ID NO: 16495 - RNA, 1410 nt, Artificial Sequence
  derived and/or modified CDS sequence (AUadapt) from InfluenzaA__AAO46246__NA
augaaccccaaccagaagaucaucaccaucggcucggugucccugaccaucgccacggucugcuuccucaugcagaucgccauccuggcgaccaccgugacccugcacuucaagcagcacgagugcgacucgccggccuccaaccaggugaugcccugcgagcccaucaucaucgagcgcaacaucacggagaucgucuaccucaacaacaccaucaucgagaaggagaucugccccaaggugguggaguaccggaacuggucgaagccgcagugccagaucaccggguucgcccccuucuccaaggacaacagcauccgccuguccgccggcggggacaucugggucacccgggagcccuacgugucgugcgaccccggcaagugcuaccaguucgcccuggggcagggcacgacccucgacaacaagcacuccaacgacaccauccacgaccgcaccccgcaccggacgcugcugaugaacgagcucggcgugcccuuccaccuggggacccgccaggucugcaucgcguggucguccucguccugccacgacggcaaggccuggcugcacgugugcaucaccggggacgacaagaacgccaccgccagcuucaucuacgacggccggcucguggacuccaucgggucguggucccagaacauccugcgcacgcaggagucggagugcgucugcaucaacgggaccugcaccguggugaugaccgacggcuccgcgagcggccgggccgacacgcgcauccuguucaucgaggagggcaagaucguccacaucucgccccucuccgggucggcccagcacguggaggagugcuccugcuacccccgguacccgggcgugcgcugcaucugccgggacaacuggaagggcucgaaccgccccgucguggacaucaacauggaggacuacuccaucgacagcuccuacgugugcucggggcuggucggcgacacgccccggaacgacgaccgcuccucgaacuccaacugccggaaccccaacaacgagcgcgggaaccagggcgugaaggggugggccuucgacaacggcgacgacguguggaugggccggaccaucagcaaggaccugcgcuccggguacgagaccuucaaggucaucggcggguggucgaccccgaacuccaagucgcagaucaaccgccaggugaucgucgacuccgacaaccggucgggcuacuccgggaucuucagcguggagggcaagucgugcaucaaccgcugcuucuacguggagcucauccggggccgcaagcaggagacccgggucugguggaccuccaacucgaucgccguguucugcgggaccuccggcacguacgggaccggcagcuggcccgacggggcgaacaucaacuucaugcccaucuga

SEQ ID NO: 16496 - RNA, 1410 nt, Artificial Sequence
  derived and/or modified CDS sequence (AUadapt) from InfluenzaA__AAO46247__NA
augaaccccaaccagaagaucaucaccaucggcucggugucccugaccaucgccacggucugcuuccucaugcagaucgccauccuggugaccaccgugacccugcacuucaagcagcacgagugcgacucgccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacucgauccgccuguccgccggcggggacaucugggugacgcgggagcccuacgugucgugcgaccccggcaagugcuaccaguucgcccuggggcagggcaccacccucgacaacaagcacuccaacgacaccauccacgaccgcaucccgcaccggacgcugcugaugaacgagcucggcguccccuuccaccuggggacccgccaggugugcaucgccuggagcuccucguccugccacgacggcaaggcguggcugcacgugugcaucaccggggacgacaagaacgccaccgccucguucaucuacgacggccggcucgucgacuccaucgggagcuggucccagaacauccugcgcacgcaggagucggagugcgugugcaucaacgggaccugcaccguggucaugaccgacggcuccgccucgggccgggcggacacgcgcauccuguucaucgaggagggcaagaucgugcacaucagcccccucuccgggucggcccagcacguggaggagugcuccugcuacccccgguacccgggcguccgcugcaucugccgggacaacuggaagggcagcaaccgccccgugaucgacaucaacauggaggacuacuccaucgacucguccuacgugugcucggggcuggucggcgacacgccccggaacgacgaccgcuccagcaacuccaacugccggaaccccaacaacgagcgcgggaaccagggcgugaaggggugggccuucgacaacggcgacgacguguggaugggccggaccaucucgaaggaccugcgcuccggguacgagaccuucaaggucaucggcggguggucgaccccgaacuccaagagccagaucaaccgccaggugaucgucgacuccgacaaccggucgggcuacuccgggaucuucucgguggagggcaagagcugcaucaaccgcugcuucuacguggagcucauccggggccgcaagcaggagacccgggucugguggaccuccaacucgaucgugguguucugcgggaccuccggcacguacgggaccggcagcuggcccgacggggccaacaucaacuucaugcccaucuga

SEQ ID NO: 16497 - RNA, 1410 nt, Artificial Sequence; identical to SEQ ID NO: 16337
  derived and/or modified CDS sequence (AUadapt) from InfluenzaA__AAO46462__NA

SEQ ID NO: 16498 - RNA, 1410 nt, Artificial Sequence; identical to SEQ ID NO: 16337
  derived and/or modified CDS sequence (AUadapt) from InfluenzaA__AAO46463__NA

SEQ ID NO: 16499 - RNA, 1410 nt, Artificial Sequence; identical to SEQ ID NO: 16337
  derived and/or modified CDS sequence (AUadapt) from InfluenzaA__AAO46464__NA

SEQ ID NO: 16500 - RNA, 1410 nt, Artificial Sequence; identical to SEQ ID NO: 16337
  derived and/or modified CDS sequence (AUadapt) from InfluenzaA__AAO46465__NA

SEQ ID NO: 16501 - RNA, 1410 nt, Artificial Sequence; identical to SEQ ID NO: 16337
  derived and/or modified CDS sequence (AUadapt) from InfluenzaA__AAO46466__NA

SEQ ID NO: 16502 - RNA, 1410 nt, Artificial Sequence
  derived and/or modified CDS sequence (AUadapt) from InfluenzaA__AAO46467__NA
augaaccccaaccagaagaucaucaccaucggcucggugucccugaccaucgccacggucugcuuccucaugcagaucgccauccuggugaccaccgugacccugcacuucaagcaguacgagugcgacucgccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacucgauccgccuguccgccggcggggacaucugggugacgcgggagcccuacgugucgugcgaccacggcaagugcuaccaguucgcccuggggcagggcaccacccucgacaacaagcacuccaacgacaccauccacgaccgcaucccccaccggacgcugcugaugaacgagcucggcgucccguuccaccuggggacccgccaggugugcaucgccuggagcuccucguccugccacgacggcaaggcguggcugcacgugugcaucaccggggacgacaagaacgccaccgccagcuucaucuacgacggccggcucgucgacuccaucgggucguggucccagaacauccugcgcacgcaggagucggagugcgugugcaucaacgggaccugcaccguggucaugaccgacggcuccgccagcggccgggcggacacgcgcauccuguucaucgaggagggcaagaucgugcacaucucgccccucaccggguccgcccagcacguggaggagugcucgugcuacccccgguaccccggcguccgcugcaucugccgggacaacuggaagggcuccaaccgcccggugguggacaucaacauggaggacuacagcaucgacuccucguacgucugcuccgggcuggugggcgacacgccccggaacgacgaccgcagcuccaacucgaacugccggaaccccaacaacgagcgcgggaaccagggcgugaaggggugggccuucgacaacggcgacgacgucuggaugggccggaccaucuccaaggaccugcgcucgggguacgagaccuucaaggugaucggcgggugguccacccccaacagcaagucccagaucaaccggcaggucaucguggacucggacaaccgcuccggcuacucggggaucuucuccguggagggcaagagcugcaucaaccgcugcuucuacgucgagcucauccggggccgcaagcaggagacccgggugugguggaccucgaacuccaucguggucuucugcgggacgagcggcaccuacgggaccggcuccuggccggacggggccaacaucaacuucaugcccaucuga

SEQ ID NO: 16503 - RNA, 1410 nt, Artificial Sequence
  derived and/or modified CDS sequence (AUadapt) from InfluenzaA__AAO46468__NA
augaaccccaaccagaagaucaucaccaucggcucggugucccugaccaucgccacggucugcuuccucaugcagaucgccauccuggugaccaccgugacccugcacuucaagcaguacgagugcgacuucccggcgucgaaccaggucaugcccugcgagcccaucaucaucgagcgcaacaucacggagaucguguaccucaacaacaccaccaucgagaaggagaucugccccaagguggucgaguaccggaacugguccaagccgcagugccagaucaccggguucgcccccuucagcaaggacaacuccauccgccugucggccggcggggacaucugggugacgcgggagcccuacguguccugcgaccacggcaagugcuaccaguucgcccuggggcagggcaccacccucgacaacaagcacagcaacgacaccauccacgaccgcaucccccaccggacgcugcugaugaacgagcucggcgucccguuccaccuggggacccgccaggugugcaucgccugguccucguccagcugccacgacggcaaggcguggcugcacgugugcaucaccggggacgacaagaacgccaccgccuccuucaucuacgacggccggcucgucgacucgaucggguccuggagccagaacauccugcgcacgcaggaguccgagugcgugugcaucaacgggaccugcaccguggucaugaccgacggcucggccuccggccgggcggacacgcgcauccuguucaucgaggagggcaagaucgugcacaucagcccccucucgggguccgcccagcacguggaggagugcucgugcuacccccgguaccccggcguccgcugcaucugccgggacaacuggaagggcuccaaccgcccggugguggacaucaacauggaggacuacagcaucgacuccucguacgucugcuccgggcuggugggcgacacgccccggaacgacgaccgcagcuccaacucgaacugccggaaccccaacaacgagcgcgggaaccagggcgugaaggggugggccuucgacaacggcgacgacgucuggaugggccggaccaucuccaaggaccugcgcagcggguacgagaccuucaaggugaucggcgggugguccacccccaacucgaagucccagaucaaccggcaggucaucguggacagcgacaaccgcuccggcuacucggggaucuucuccguggagggcaagagcugcaucaaccgcugcuucuacgucgagcucauccggggccgcaagcaggagacccgggugugguggaccucgaacuccaucguggucuucugcgggaccagcggcacguacgggaccggcuccuggccggacggggccaacaucaacuucaugcccaucuga

SEQ ID NO: 16504 - RNA, 1410 nt, Artificial Sequence; identical to SEQ ID NO: 16337
  derived and/or modified CDS sequence (AUadapt) from InfluenzaA__AAO46469__NA

SEQ ID NO: 16505 - RNA, 1410 nt, Artificial Sequence
  derived and/or modified CDS sequence (AUadapt) from InfluenzaA__AAO46471__NA
augaaccccaaccagaagaucaucaccaucggcucggugucccugaccaucgccacggucugcuuccucaugcagaucgccauccuggugaccaccgugacccugcacuucaagcaguacgagugcgacucgccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacucgauccgccuguccgccggcggggacaucugggugacgcgggagcccuacgugagcugcgaccccggcaagugcuaccaguucgcccuggggcagggcaccacccucgacaacaagcacuccaacgacaccauccacgaccgcaucccgcaccggacgcugcugaugaacgagcucggcguccccuuccaccuggggacccgccaggugugcaucgccuggucguccucguccugccacgacggcaaggcguggcugcacgugugcaucaccggggacgacaagaacgccaccgccagcuucaucuacgacggccggcucgucgacuccaucgggucguggucccagaacauccugcgcacgcaggagagcgagugcgugugcaucaacgggaccugcaccguggucaugaccgacggcuccgccucgggccgggcggacacgcgcauccuguucaucgaggagggcaagaucgugcacaucucgccccucuccgggagcgcccagcacguggaggagugcuccugcuacccccgguacccgggcguccgcugcaucugccgggacaacuggaagggcucgaaccgccccgugguggacaucaacauggaggacuacuccaucgacagcuccuacgucugcucggggcuggugggcgacacgccccggaacgacgaccgcuccucgaacuccaacugccggaaccccaacaacgagcgcgggaaccagggcgugaaggggugggccuucgacaacggcgacgacgucuggaugggccggaccaucagcaaggaccugcgcuccggguacgagaccuucaaggugaucggcggguggucgaccccgaacuccaagagccagaucaaccggcaggucaucguggacuccgacaaccgcucgggcuacuccgggaucuucucgguggagggcaagagcugcaucaaccgcugcuucuacgucgagcucauccggggccgcaagcaggagacccgggugugguggaccuccaacucgaucguggucuucugcgggaccuccggcacguacgggaccggcagcuggcccgacggggccaacaucaacuucaugcccaucuga

SEQ ID NO: 16506 - RNA, 1410 nt, Artificial Sequence
  derived and/or modified CDS sequence (AUadapt) from InfluenzaA__AAO46472__NA
augaaccccaaccagaagaucaucaccaucggcucggugucccugaccaucgccacggucugcuuccucaugcagaucgccauccuggugaccaccgugacccugcacuucaagcaguacgagugcgacucgccggcguccaaccaggucaugcccugcgagcccaucacgaucgagcgcaacaucaccgagaucguguaccucaacaacaccaccaucgagaaggagaucugccccaagguggucgaguaccggaacuggagcaagccgcagugccagaucacgggguucgcccccuucuccaaggacaacucgauccgccuguccgccggcggggacaucugggugacccgggagcccuacgugagcugcgaccccggcaagugcuaccaguucgcccuggggcagggcaccacccucgacaacaagcacuccaacgacacgauccacgaccgcaucccgcaccggacccugcugaugaacgagcucggcguccccuuccaccuggggacccgccaggugugcaucgccuggucguccucguccugccacgacggcaaggcguggcugcacgugugcaucaccggggacgacaagaacgccacggccagcuucaucuacgacggccggcucgucgacuccaucgggucguggucccagaacauccugcgcacccaggagagcgagugcgugugcaucaacgggaccugcaccguggucaugacggacggcuccgccucgggccgggcggacacccgcauccuguucaucgaggagggcaagaucgugcacaucucgccccucuccgggagcgcccagcacguggaggagugcuccugcuacccccgguacccgggcguccgcugcaucugccgggacaacuggaagggcucgaaccgccccgugguggacaucaacauggaggacuacuccaucgacagcuccuacgucugcucggggcuggugggcgacacgccccggaacgacgaccgcuccucgaacuccaacugccggaaccccaacaacgagcgcgggaaccagggcgugaaggggugggccuucgacaacggcgacgacgucuggaugggccggaccaucagcaaggaccugcgcuccggguacgagaccuucaaggugaucucgggcugguccaccccgaacagcaagucccagaucaaccggcaggucaucguggacucggacaaccgcuccggguacucgggcaucuucagcguggaggggaaguccugcaucaaccgcugcuucuacgucgagcucauccggggccgcaagcaggagacccgggugugguggaccucgaacuccaucguggucuucugcggcacgagcgggaccuacggcaccggguccuggcccgacggcgccaacaucaacuucaugcccaucuga

SEQ ID NO: 16507 - RNA, 1410 nt, Artificial Sequence; identical to SEQ ID NO: 16337
  derived and/or modified CDS sequence (AUadapt) from InfluenzaA__AAO46473__NA

SEQ ID NO: 16508 - RNA, 1410 nt, Artificial Sequence; identical to SEQ ID NO: 16337
  derived and/or modified CDS sequence (AUadapt) from InfluenzaA__AAO46474__NA

SEQ ID NO: 16509 - RNA, 1410 nt, Artificial Sequence; identical to SEQ ID NO: 16337
  derived and/or modified CDS sequence (AUadapt) from InfluenzaA__AAO46475__NA

SEQ ID NO: 16510 - RNA, 1410 nt, Artificial Sequence
  derived and/or modified CDS sequence (AUadapt) from InfluenzaA__AAO46476__NA
augaaccccaaccagaagaucaucaccaucggcucggugucccugaccaucgccacggucugcuuccucaugcagaucgccauccuggugaccaccgugacccugcacuuccgccaguacgagugcgacucgccggcgaacaaccaggucaugcccugcgagcccacgaucaucgagcggaacaucaccgagaucguguaccucaacaacaccaccaucgagaaggagaucugccccaagcugguggaguaccgcaacugguccaagccgcagugcaagaucacgggguucgcccccuucucgaaggacaacuccauccggcugagcgccggcggggacaucugggucacccgcgagcccuacguguccugcgaccccggcaagugcuaccaguucgcccucgggcagggcaccacccuggacaacaagcacucgaacgacacgauccacgaccggaucccgcaccgcacccugcucaugaacgagcugggcgugcccuuccaccuggggacccggcaggucugcaucgccugguccucguccagcugccacgacggcaaggcguggcuccacgugugcgugaccggggacgacaagaacgccacggccuccuucaucuacgacggccgccuggucgacucgaucggguccuggucgcagaacauccugcggacccaggaguccgagugcgugugcaucaacgggaccugcaccguggucaugacggacggcucggccuccggccgcgcggacacccggauccucuucaucgaggagggcaagaucgugcacaucagcccccugucgggguccgcccagcacguggaggagugcucgugcuacccccgcuacccgggcguccggugcaucugccgcgacaacuggaagggcuccaaccggcccgugguggacaucaacgucgaggacuacagcaucgacuccucguacgugugcuccgggcuggugggcgacacgccccgcaacaacgaccggucguccaacucgaacugccgcaaccccaacaacgagcgggggaaccacggcgucaaggggugggccuucgacgacggcaacgacguguggaugggccgcaccaucuccaaggaccuccggagcggguacgagaccuucaaggucaucggcgggugguccaccccgaacucgaagucccagaucaaccgccaggugaucguggacucggacaaccgcuccggcuacagcgggaucuucuccgucgagggcaagucgugcaucaaccggugcuucuacguggagcugauccgcggccgggagcaggagacccgcgugugguggaccucgaacuccaucgucguguucugcgggacgagcggcaccuacgggaccggcuccuggcccgacggggccgacaucaaccugaugcccaucuga

SEQ ID NO: 16511 - RNA, 1410 nt, Artificial Sequence; identical to SEQ ID NO: 16337
  derived and/or modified CDS sequence (AUadapt) from InfluenzaA__AAO46477__NA

SEQ ID NO: 16512 - RNA, 1410 nt, Artificial Sequence
  derived and/or modified CDS sequence (AUadapt) from InfluenzaA__AAO46478__NA
augaaccccaaccagaagaucaucaccaucggcucggugucccugaucaucgccaccgucugcuuccucaugcagaucgccauccuggugacgaccgugacccugcacuucaagcagcacgagugcgacucgccguccagcaaccaggucaugcccugcgagcccaucaucaucgagcgcaacaucaccgagaucguguaccucaacaacacgaccaucgagaaggagaccugccccaagcugguggaguaccggaacugguccaagccgcagugcaagaucaccggguucgcgcccuucucgaaggacaacuccauccgccugucggccggcggggacaucugggucacgcgggagcccuacguguccugcgaccccggcaagugcuaccaguucgcccucgggcagggcaccacccuggacaacaagcacagcaacgacaccauccacgaccgcaucccgcaccggacgcugcucaugaacgagcugggcgugcccuuccaccuggggacccgccaggucugcaucgccugguccucguccucgugccacgacggcaaggccuggcuccacgugugcgugaccggggacgacaagaacgcgaccgccuccuucaucuacgacggccggcuggucgacagcaucggguccuggucgcagaacauccugcgcacgcaggaguccgagugcgugugcaucaacgggaccugcaccguggucaugaccgacggcaacgccucggggcgggccgacacgcgcauccucuucaucgaggagggcaagaucgugcacaucagcccccuguccgggucggcgcagcacguggaggagugcuccugcuacccccgguacccggacguccgcugcaucugccgggacaacuggaagggcagcaaccgccccaucguggacaucaacaugaaggacuacuccaucgacucguccuacgugugcucgggccuggucggggacacgccccggaacgacgaccgcuccagcaaguccaacugccggaaccccaacaacgagcgcggcaaccacggggugaagggcugggccuucgacaacgggaacgacguguggaugggccggaccaucucgaaggaccuccgcuccggcuacgagaccuucaaggucaucgggggcuggucgaccccgaacuccaagagccagaucaaccgccaggugaucgucgacuccgacaaccggucgggguacuccggcaucuucucgguggagggcaagagcugcaucaaccgcugcuucuacguggagcugauccggggccgcgagcaggagacccgggucugguggaccuccaacucgaucgugguguucugcggcaccuccgggacguacggcaccgggagcuggcccgacggcgccaacaucaacuucaugcccaucuga

SEQ ID NO: 16513 - RNA, 1410 nt, Artificial Sequence
  derived and/or modified CDS sequence (AUadapt) from InfluenzaA__AAO46479__NA
augaaccccaaccagaagaucaucaccaucggcucggugucccugaccaucgccacggucugcuuccucaugcagaucgccauccuggugaccaccgugacccugcacuucaagcaguacgagugcgacucgccggcguccaaccgcgucaugcccugcgagcccaucaucaucgagcggaacaucacggagaucguguaccucaacaacaccaccaucgagaaggagaucugccccaagguggucgaguaccgcaacuggagcaagccgcagugccagaucaccggguucgcccccuucuccaaggacaacucgauccggcuguccgccggcggggacaucugggugacgcgcgagcccuacgugagcugcgaccccggcaagugcuaccaguucgcccuggggcagggcaccacccucgacaacaagcacuccaacgacaccauccacgaccggaucccgcaccgcacgcugcugaugaacgagcucggcguccccuuccaccuggggacccgccaggugugcaucgccuggucguccucguccugccacgacggcaaggcguggcugcacgugugcaucaccggggacgacaagaacgccaccgccagcuucaucuacgacggccggcucgucgacuccaucgggucguggucccagaacauccugcggacgcaggagagcgagugcgugugcaucaacgggaccugcaccguggucaugaccgacggcuccgccucgggccgcgcggacacgcggauccuguucaucgaggagggcaagaucgugcacaucucgccccucuccgggagcgcccagcacguggaggagugcuccugcuacccccgcuacccgggcguccggugcaucugccgcgacaacuggaagggcucgaaccggcccgugguggacaucaacauggaggacuacuccaucgacagcuccuacgucugcucggggcuggugggcgacacgccccgcaacgacgaccgguccucgaacuccaacugccgcaaccccaacaacgagcgggggaaccagggcgugaaggggugggccuucgacaacggcgacgacgucuggaugggccgcaccaucagcaaggaccugcgguccggguacgagaccuucaaggugaucggcggguggucgaccccgaacuccaagagccagaucaaccgccaggucaucguggacuccggcaaccgcucgggguacuccggcaucuucucgguggagggcaagagcugcaucaaccggugcuucuacgucgagcucauccgcgggcggaagcaggagacccgcgugugguggaccuccaacucgaucguggucuucugcggcaccuccgggacguacggcaccgggagcuggcccgacggcgccaacaucaacuucaugcccaucuga

SEQ ID NO: 16514 - RNA, 1410 nt, Artificial Sequence
  derived and/or modified CDS sequence (AUadapt) from InfluenzaA__AAO46481__NA
augaaccccaaccagaagaucaucaccaucggcucggugucccugaccaucgccacggucugcuuccucaugcagaucgccauccuggugaccaccgugacccugcacuucaagcaguacgagugcgacucgccggcgaacaaccaggucaugcccugcgagcccaucaucaucgagcgcaacaucacggagaucguguaccucaccaacaccaccaucgagaaggagaucugccccaagcugguggaguaccggaacugguccaagccgcagugcaagaucacgggguucgcccccuucucgaaggacaacuccauccgccugagcgccggcggggacaucugggucacccgggagcccuacguguccugcgaccccggcaagugcuaccaguucgcccucgggcagggcaccacccuggacaacaagcacucgaacgacacgauccacgaccgcaucccgcaccggacccugcucaugaacgagcugggcgugcccuuccaccuggggacccgccaggucugcaucgccugguccucguccagcugccacgacggcaaggcguggcuccacgugugcgugaccggggacgacaagaacgccacggccuccuucaucuacgacggccggcuggucgacucgaucggguccuggucgcagaacauccugcgcacccaggaguccgagugcgugugcaucaacgggaccugcaccguggucaugacggacggcagcgccuccggccgggcggacacccgcauccucuucaucgaggagggcaagaucgugcacaucucgccccugucgggguccgcccagcacguggaggagugcagcugcuacccccgguacccgggcguccgcugcaucugccgggacaacuggaagggcuccaaccgccccgugguggacaucaacgucaaggacuacucgaucgacucccgguacgugugcucggggcuggugggcgacacgccccgcaacaacgaccgguccagcaacuccaacugccgcaaccccaacaacgagcgggggaaccacggcgucaaggggugggccuucgacgacggcaacgacguguggaugggccgcaccaucucgaaggacucccggucgggguacgagaccuucaaggucaucggcgggugguccaccccgaacagcaagucccagaucaaccgccaggugaucguggacucggacaaccgcuccggcuacucggggaucuucuccgucgagagcaagucgugcaucaaccggugcuucuacguggagcucauccgcggccgggagcaggagacccgcgugugguggaccuccaacucgaucgucguguucugcggcacguccgggaccuacggcaccgggagcuggcccgacggcgccgacaucaaccugaugcccaucuga

SEQ ID NO: 16515 - RNA, 1410 nt, Artificial Sequence
  derived and/or modified CDS sequence (AUadapt) from InfluenzaA__AAO46482__NA
augaaccccaaccagaagaucaucaccaucggcucggugucccugaccaucgccacggucugcuuccucaugcagaucgccauccuggugaccaccgugacccugcacuucaagcaguacgagugcgacucgccggcgaacaaccaggucaugcccugcgagcccaugaucaucgagcgcaacaucacggagaucguguaccucaccaacaccaccaucgagaaggagaucugccccaagcugguggaguaccggaacugguccaagccgcagugcaagaucacgggguucgcccccuucucgaaggacaacuccauccgccugagcgccggcggggacaucugggucacccgggagcccuacguguccugcgaccccggcaagugcuaccaguucgcccucgggcagggcaccacccuggacaacaagcacucgaacgacacgauccacgaccgcaucccgcaccggacccugcucaugaacgagcugggcgugcccuuccaccuggggacccgccaggucugcaucgccugguccucguccagcugccacgacggcaaggcguggcuccacgugugcgugaccggggacgacaagaacgccacggccuccuucaucuacgacggccggcuggucgacucgaucggguccuggucgcagaacauccugcgcacccaggaguccgagugcgugugcaucaacgggaccugcaccguggucaugacggacggcucggccuccggccgggcggacacccgcauccucuucaucgaggagggcaagaucgugcacaucagcccccugucgggguccgcccagcacguggaggagugcucgugcuacccccgguacccgggcguccgcugcaucugccgggacaacuggaagggcuccaaccgccccgugguggacaucaacgucaaggacuacagcaucgacucccgguacgugugcucggggcuggugggcgacacgccccgcaacaacgaccgguccucgaacuccaacugccgcaaccccaacaacgacaaggggaaccacggcgucaaggggugggccuucgacgacggcaacgacguguggaugggccggaccaucucgaaggacucccgcagcggguacgagaccuucaaggucaucggcgggugguccaccccgaacucgaagucccagaucaaccgccaggugaucguggacucggacaaccgguccggcuacagcgggaucuucuccgucgagggcaagucgugcaucaaccgcugcuucuacguggagcucauccggggccgcgagcaggagacccgggugugguggaccucgaacuccaucgucguguucugcgggacgagcggcaccuacgggaccggcuccuggcccgacggggccgacaucaaccugaugcccaucuga

SEQ ID NO: 16516 - RNA, 1410 nt, Artificial Sequence
  derived and/or modified CDS sequence (AUadapt) from InfluenzaA__AAO46483__NA
augaaccccaaccagaagaucaucaccaucggcucggugucccugaccaucgccacggucugcuuccucaugcagaucgccauccuggugaccaccgugacccugcacuuccgccaguacgagugcgacucgccggcgaacaaccaggucaugcccugcgagcccaucaucaucgagcggaacaucacggagaucguguaccucaacaacaccaccaucgagaaggagaucugccccaagcugguggaguaccgcaacugguccaagccgcagugcaagaucaccggguucgcccccuucagcaaggacaacuccauccggcugucggccggcggggacaucugggucacgcgcgagcccuacguguccugcgaccccggcaagugcuaccaguucgcccucgggcagggcaccacccuggacaacaagcacucgaacgacaccauccacgaccggaucccgcaccgcacgcugcucaugaacgagcugggcgugcccuuccaccuggggacccggcaggucugcaucgccugguccagcuccucgugccacgacggcaaggcguggcuccacgugugcgugaccggggacgacaagaacgccaccgccuccuucaucuacgacggccgccuggucgacucgaucggguccuggagccagaacauccugcggacgcaggaguccgagugcgugugcaucaacgggaccugcaccguggucaugaccgacggcucggccuccggccgcgcggacacgcggauccucuucaucgaggagggcaagaucgugcacaucucgccccugagcggguccgcccagcacguggaggagugcucgugcuacccccgcuacccgggcguccggugcaucugccgcgacaacuggaagggcuccaaccggcccgugguggacaucaacgucgaggacuacucgaucgacuccagcuacgugugcuccgggcuggugggcgacacgccccgcaacaacgaccggucguccaacucgaacugccgcaaccccaacaacgagcgggggaaccacggcgucaaggggugggccuucgacgacggcaacgacguguggaugggccgcaccaucuccaaggaccuccggagcggguacgagaccuucaaggucaucggcgggugguccaccccgaacucgaagucccagaucaaccgccaggugaucguggacucggacaaccgcuccggcuacagcgggaucuucuccgucgagggcaagucgugcaucaaccggugcuucuacguggagcugauccgcggccgggagcaggagacccgcgugugguggaccucgaacuccaucgucguguucugcgggaccagcggcacguacgggaccggcuccuggcccgacggggccgacaucaaccugaugcccaucuga

SEQ ID NO: 16517 - RNA, 1410 nt, Artificial Sequence
  derived and/or modified CDS sequence (AUadapt) from InfluenzaA__AAO46485__NA
augaaccccaaccagaagaucaucaccaucggcucggugucccugaccaucgccacggucugcuuccucaugcagaucgccauccuggugaccaccgugacccugcacuucaagcaguacgagugcgacucgccggcgaacaaccaggucaugcccugcgagcccaucaucaucgagcgcaacaucacggagaucguguaccucaccaacaccaccaucgagaaggagaucugccccaagcugguggaguaccggaacugguccaagccgcagugcaagaucacgggguucgcccccuucucgaaggacaacuccauccgccugagcgccggcggggacaucugggucacccgggagcccuacguguccugcgaccccggcaagugcuaccaguucgcccucgggcagggcaccacccuggacaacaagcacucgaacgacacgauccacgaccgcaucccgcaccggacccugcucaugaacgagcugggcgugcccuuccaccuggggacccgccaggucugcaucgccugguccucguccagcugccacgacggcaaggcguggcuccacgugugcgugaccggggacgacaagaacgccacggccuccuucaucuacgacggccggcuggucgacucgaucggguccuggucgcagaacauccugcgcacccaggaguccgagugcgugugcaucaacgggaccugcaccguggucaugacggacggcucggccuccggccgggcggacacccgcauccucuucaucgaggagggcaagaucgugcacaucagcccccugucgggguccgcccagcacguggaggagugcucgugcuacccccgguacccgggcguccgcugcaucugccgggacaacuggaagggcuccaaccgccccgugguggacaucaacgucaaggacuacagcaucgacucccgguacgugugcucggggcuggugggcgacacgccccgcaacaacgaccgguccucgaacuccaacugccgcaaccccaacaacgacaaggggaaccacggcgucaaggggugggccuucgacgacggcaacgacguguggaugggccggaccaucucgaaggacucccgcagcggguacgagaccuucaaggucaucggcgggugguccaccccgaacucgaagucccagaucaaccgccaggugaucguggacucggacaaccgguccggcuacagcgggaucuucuccgucgagggcaagucgugcaucaaccgcugcuucuacguggagcucauccggggccgcgagcaggagacccgggugugguggaccucgaacuccaucgucguguucugcgggacgagcggcaccuacgggaccggcuccuggcccgacggggccgacaucaaccugaugcccaucuga

SEQ ID NO: 16518 - RNA, 1410 nt, Artificial Sequence
  derived and/or modified CDS sequence (AUadapt) from InfluenzaA__AAO46486__NA
augaaccccaaccagaagaucaucaccaucggcucggugucccugaccaucgccacgaucugcuuccucaugcagaucgccauccuggucaccaccgugacccugcacuucaagcaguacgagugcgacucgccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccauccgccugucggccggcggggacaucugggugacccgggagcccuacgucuccugcgaccccggcaagugcuaccaguucgcccucgggcagggcaccacccuggacaacaagcacucgaacgacacgauccacgaccgcaucccgcaccggacccugcucaugaacgagcugggcgugcccuuccaccuggggacccgccaggugugcaucgccugguccagcuccucgugccacgacggcaaggcguggcuccacgucugcgugaccggggacgacaagaacgccacggccuccuucaucuacgacggccggcugguggacucgaucggguccuggagccagaacauccugcgcacccaggaguccgagugcgucugcaucaacgggaccugcaccguggugaugacggacggcucggccuccggccgggcggacacccgcauccucuucaucgaggagggcaagaucguccacaucucgccccugagcggguccgcccagcacguggaggagugcucgugcuacccccgguacccgggcgugcgcugcaucugccgggacaacuggaagggcuccaaccgccccgucguggacaucaacgugaaggacuacagcaucgacuccucguacgucugcuccgggcuggugggcgacacgccccggaacaacgaccgcucguccaacagcuacugccggaaccccaacaacgagcgcgggaaccacggcgugaaggggugggccuucgacgacggcaacgacgucuggaugggccggaccaucuccaaggacucgcgcuccggguacgagaccuucaaggugaucggcggguggucgaccccgaacuccaagagccagaucaaccggcaggucaucguggacuccgacaaccgcucgggcuacuccgggaucuucucgguggagggcaagagcugcaucaaccgcugcuucuacgucgagcucauccggggccgcgagcaggagacccgggugugguggaccuccaacucgaucguggucuucugcgggacguccggcaccuacgggaccggcagcuggcccgacggggccgacaucaaccugaugcccaucuga

SEQ ID NO: 16519 - RNA, 1410 nt, Artificial Sequence
  derived and/or modified CDS sequence (AUadapt) from InfluenzaA__AAO46489__NA
augaaccccaaccagaagaucaucaccaucggcucggugucccugaccaucgccacgaucugcuuccucaugcagaucgccauccuggucaccaccgugacccugcacuucaagcaguacgagugcgacucgccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccauccgccugucggccggcggggacaucugggugacccgggagcccuacgucuccugcgaccccggcaagugcuaccaguucgcccucgggcagggcaccacccugaacaacaagcacagcaacgacacgauccacgaccgcaucccgcaccggacccugcucaugaacgagcugggcgugcccuuccaccuggggacccgccaggugugcaucgccugguccucguccucgugccacgacggcaaggcguggcuccacgucugcgugaccggggacgacaagaacgccacggccuccuucaucuacgacggccggcugguggacagcaucggguccuggucgcagaacauccugcgcacccaggaguccgagugcgucugcaucaacgggaccugcaccguggugaugacggacggcagcgccuccggcaaggcggacacccggauccucuucaucgaggagggcaagaucguccacaucucgccccugucgggguccgcccagcacguggaggagugcagcugcuacccccgcuacccgggcgugcggugcaucugccgcgacaacuggaagggcuccaaccggcccgucguggacaucaacgugaaggacuacucgaucgacuccagcuacgucugcuccgggcuggugggcgacacgccccgcaacaacgaccggucguccucguccuacugccgcaaccccaacaacgagcgggggaaccacggcgugaaggggugggccuucgacgacggcaacgacgucuggaugggccgcaccaucagcaaggacucccggucgggguacgagaccuucaaggugaucggcgggugguccaccccgaacagcaagucccagaucaaccgccaggucaucguggacucggacaaccgguccggcuacucggggaucuucagcguggagggcaaguccugcaucaaccgcugcuucuacgucgagcucauccgcggccgggagcaggagacccgcgugugguggaccucgaacuccaucguggucuucugcgggacgagcggcaccuacgggaccggcuccuggcccgacggggccgacaucaaccugaugcccaucuga

SEQ ID NO: 16520 - RNA, 1410 nt, Artificial Sequence
  derived and/or modified CDS sequence (AUadapt) from InfluenzaA__AAO46491__NA
augaaccccaaccagaagaucaucaccaucggcucggugucccugaccaucgccacgaucugcuuccucaugcagaucgccauccuggucaccaccgugacccugcacuucaagcaguacgagugcgacucgccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccauccgccugucggccggcggggacaucugggugacccgggagcccuacgucuccugcgaccccggcaagugcuaccaguucgcccucgggcagggcaccacccuggacaacaagcacucgaacgacacgauccacgaccgcaccccgcaccggacccugcucaugaacgagcugggcgugcccuuccaccuggggacccgccaggugugcaucgccugguccagcuccucgugccacgacggcaaggcguggcuccacgucugcgugacgggguacgacaagaacgccaccgccuccuucaucuacgacggccggcugguggacagcaucggguccuggucgcagaacauccugcgcacccaggaguccgagugcgucugcaucaacgggaccugcacgguggugaugaccgacggcucggccuccggccgggcggacaccaagauccucuucaucgaggagggcaagaucguccacaucagcccccugucgggguccgcccagcacguggaggagugcucgugcuacccccgcuacccgggcgugcggugcaucugccgcgacaacuggaagggcuccaaccggcccgucguggacaucaacgugaaggacuacagcaucgacuccucguacgucugcuccgggcuggugggcgacacgccccgcaacaacgaccggagcuccaacucguacugccgcaaccccaacaacgagaaggggaaccacggcgugaaggggugggccuucgacgacggcaacgacgucuggaugggccggaccaucuccgaggacucgcgcuccggguacgagaccuucaaggugaucggcggguggagcaccccgaacuccaagcuccagaucaaccggcaggucaucguggacucggacaaccgcuccggcuacucggggaucuucuccguggagggcaagagcugcaucaaccggugcuucuacgucgagcugauccgcggccgcgagcaggagacccgggugugguggacgucgaacuccaucguggucuucugcgggaccagcggcaccuacgggaccggcuccuggcccgacggggccgacaucaaccugaugcccaucuga

SEQ ID NO: 16521 - RNA, 1410 nt, Artificial Sequence; identical to SEQ ID NO: 16520
  derived and/or modified CDS sequence (AUadapt) from InfluenzaA__AAO46492__NA

SEQ ID NO: 16522 - RNA, 1410 nt, Artificial Sequence
  derived and/or modified CDS sequence (AUadapt) from InfluenzaA__AAO88264__NA
augaacaccaaccagcgcaucaucaccaucggcacggugugccugaucgucgggaucgugucgcuccugcugcagaucggcaacaucgugucccucuggaucagccacuccauccagaccgggaagaagaacuacagcaagaucugcuccaagagcgucaucaccuacgagaacaacaccugggugaaccagacguacgugaacaucuccaacaucaacaucgccgacggccagggggucaacagcaucauccuggccggcaacuccagccugugccccaucuccggcugggcgaucuacagcaaggacaacuccauccggaucgggagcaagggcgacaucuucgugauccgcgagccguucaucuccugcagccaccucgagugccggaccuucuuccugacccagggggcccugcucaacgaccgccacuccaacggcaccgugaaggaccggagccccuaccgcacgcugauguccugccccaucggggaggcccccagcccguacaacagccgguucgaguccgucgccuggagcgccuccgcgugccacgacggcaugggcuggcugaccaucgggaucagcggccccgacaacggggccguggccgugcucaaguacaacggcaucaucaccgacaccaucaaguccuggcgcaacaagauccugcggacgcaggagagcgagugcgucugcaucaacggcuccugcuucaccaucaugaccgacgggcccagcaacggccaggccuccuacaagaucuucaagauggagaaggggaagaucaucaagagcguggagcuggacgcgcccaacuaccacuacgaggagugcuccugcuacccggacaccggcaagguggucugcgugugcagcgacaacuggcacgccuccaaccgccccugggugagcuucgaccagaaccucgacuaccagaucggguacaucugcuccggcgucuucggcgacaacccccggagcaacgacgggcgcggcaacugcgggcccgugcuguccaacggcgccaacggggugaagggcuucagcuuccgguacggcaacggggucuggaucggccgcacgaaguccaucagcagccgguccggguucgagaugaucugggacccgaacggcuggaccgagaccgacagcuccuucagcaucaagcaggacgugaucgcccugaccgacugguccggguacagcggcuccuucgugcagcaccccgagcucacgggcaugaacugcauccgccccugcuucugggucgagcugauccgggggcagcccaaggagagcaccaucuggaccuccggcagcuccaucagcuucugcgggguggacuccgagaccgccagcugguccuggccggacggcgcggaccugcccuucacgaucgacaaguga

SEQ ID NO: 16523 - RNA, 1410 nt, Artificial Sequence
  derived and/or modified CDS sequence (AUadapt) from InfluenzaA__AAQ10334__NA
augaaccccaaccagaagaucaucaccaucggcucggugucccugaccaucgccacgaucugcuuccucaugcagaucgccauccuggucaccaccgugacccugcacuucaagcaguacgagugcaacccgccgcccaacaaccaggugaugcucugcgagcccacgaucaucgagcgcaacaucaccgagaucgucuaccugaccaacaccacgaucgagaaggagaucugccccaagcuggcggaguaccggaacuggucgaagccccagugcaagaucaccggguucgcccccuucuccaaggacaacagcauccgccucuccgccggcggggacaucugggugacccgggagcccuacgugucgugcgacccgggcaagugcuaccaguucgcccuggggcagggcaccacgcugaacaaccgccacuccaacgacaccguccacgaccggacccccuaccgcacccuccugaugaacgagcugggcgugcccuuccaccucgggacgaagcaggucugcaucgccuggagcuccucguccugccacgacggcaaggcguggcugcacgugugcgugaccgggcacaacgagaacgccaccgccucguucaucuacaacggccggcugguggacuccaucgggagcugguccaagaacauccuccgcacccaggagucggagugcgucugcaucaacggcacgugcaccguggugaugaccgacggcuccgccagcgggcgggcggacaccaagauccuguucaucgaggagggcaagaucguccacaucucgccccuguccgggagcgcccagcacguggaggagugcuccugcuacccgcgcuaccccggcgugcggugcgucugccgcgacaacuggaagggcucgaaccggcccaucguggacaucaacgugaaggacuacuccaucgucucguccuacgugugcagcgggcucgugggcgacacgccccgcaagaacgacuccucguccagcuccuacugccugaacccgaacaacgaggagggcgggcacggggucaagggcugggccuucgacgacggcaacgacguguggauggggcggaccaucucggagaagcugcgcuccggcuacgagaccuucaaggucaucgggggcuggucgaagcccaacuccaagcuccagaucaaccgccaggugaucguggaccgggggaaccggagcggcuacuccggcaucuucucggucgaggggaaguccugcaucaaccgcugcuucuacguggagcugauccggggccgcaagcaggagaccgaggugugguggacgagcaacucgaucgucguguucugcgggaccuccggcaccuacgggaccggcagcuggcccgacggcgccgacaucaaccugaugcccaucuga

SEQ ID NO: 16524 - RNA, 1410 nt, Artificial Sequence; identical to SEQ ID NO: 16523
  derived and/or modified CDS sequence (AUadapt) from InfluenzaA__AAQ10335__NA

SEQ ID NO: 16525 - RNA, 1410 nt, Artificial Sequence
  derived and/or modified CDS sequence (AUadapt) from InfluenzaA__AAQ10336__NA
augaaccccaaccagaagaucaucaccaucggcucggugucccugaccaucgccacgaucugcuuccucaugcagaucgccauccuggucaccaccgugacccugcacuucaagcaguacgagugcaacccgccgcccaacaaccaggugaugcucugcgagcccacgaucaucgagcgcaacaucaccgagaucgucuaccugaccaacaccacgaucgagaaggagaucugccccaagcuggcggaguaccggaacuggucgaagccccagugcaagaucaccggguucgcccccuucuccaaggacaacagcauccgccucuccgccggcggggacaucugggugacccgggagcccuacgugucgugcgacccgggcaagugcuaccaguucgcccuggggcagggcaccacgcugaacaaccgccacuccaacgacaccguccacgaccggacccccuaccgcacccuccugaugaacgagcugggcgugcccuuccaccucgggacgaagcaggucugcaucgccuggagcuccucguccugccacgacggcaaggcguggcugcacgugugcgugaccgggcacaacgagaacgccaccgccucguucaucuacaacggccggcugguggacuccaucgggagcugguccaagaacauccuccgcacccaggagucggagugcgucugcaucaacggcacgugcaccguggugaugaccgacggcuccgccagcgggcgggcggacaccaagauccuguucaucgaggagggcaagaucguccacaucucgccccuguccgggagcgcccagcacguggaggagugcuccugcuacccgcgcuaccccggcgugcggugcgucugccgcgacaacuggaagggcucgaaccggcccaucguggacaucaacgugaaggacuacuccaucgucucguccuacgugugcagcgggcucgugggcgacacgccccgcaagaacgacuccucguccagcuccuacugccugaacccgaacaacgaggagggcgggcacggggucaagggcugggccuucgacgacggcaacgacguguggauggggcggaccaucucggagaagcugcgcuccggcuacgagaccuucaaggucaucgggggcuggucgaagcccaacuccaagcuccagaucaaccgccaggugaucguggaccgggggaaccggagcggcuacuccggcaucuucucggucgaggggaaguccugcaucaaccgcugcuucuacguggagcugauccggggccgcaagcaggagaccgaggugugguggacgagcaacucgaucgucguguucugcgggaccuccggcaccuacgggaccggcagcuggcccgacggcgccgagaucaaccugaugcccaucuga

SEQ ID NO: 16526 - RNA, 1410 nt, Artificial Sequence; identical to SEQ ID NO: 16523
  derived and/or modified CDS sequence (AUadapt) from InfluenzaA__AAQ10337__NA

SEQ ID NO: 16527 - RNA, 1410 nt, Artificial Sequence
  derived and/or modified CDS sequence (AUadapt) from InfluenzaA__AAQ10339__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccgacaagugcuaccaguucgcccugggccaggggaccacgcugaacaaccgccacagcaacgacaccguccacgaccggaccccguaccgcacccuccugaugaacgagcugggcgugcccuuccaccucggcacgaagcaggucugcaucgccugguccucguccucgugccacgacgggaaggcguggcugcacgugugcgugaccggccacgacgagaacgccaccgccuccuucaucuacgacgggcggcugguggacagcaucggcuccuggucgaagaagauccuccgcacccaggaguccgagugcgucugcaucaacgggacgugcaccguggugaugaccgacggcagcgccuccggccgggcggacaccaagauccuguucaucgaggaggggaagaucguccacaucucgccccugagcggcuccgcccagcacguggaggagugcucgugcuacccccgcuacccgggggugcggugcgucugccgcgacaacuggaagggcuccaaccggcccaucguggacaucaacgugaaggacuacucgaucgucuccagcuacgugugcuccggccucgugggggacacgccccgcaagaacgacucguccagcuccucgcacugccugaaccccaacaacgaggagggcgggcacggcgucaaggggugggccuucgacgacggcaacgacguguggaugggccggaccaucuccgagacccugcgcucgggguacgagaccuucaaggucaucgagggcugguccaagccgaacagcaagcuccagaucaaccgccaggugaucguggaccgggggaaccgguccggcuacucggggaucuucuccgucgagggcaagagcugcaucaaccgcugcuucuacguggagcugauccggggccgcaagcaggagacggaggugugguggaccucgaacuccaucgucguguucugcgggaccagcggcaccuacgggacgggcuccuggcccgacggggccgacaucaaccugaugcccaucuga

SEQ ID NO: 16528 - RNA, 1410 nt, Artificial Sequence
  derived and/or modified CDS sequence (AUadapt) from InfluenzaA__AAQ10341__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccgacaagugcuaccaguucgcccugggccaggggaccacgcugaacaaccgccacagcaacgacaccguccacgaccggaccccguaccgcacccuccugaugaacgagcugggcgugcccuuccaccucggcacgaagcaggucugcaucgccugguccucguccucgugccacgacgggaaggcguggcugcacgugugcgugaccggccacgacgagaacgccaccgccuccuucaucuacgacgggcggcugguggacagcaucggcuccuggucgaagaagauccuccgcacccaggaguccgagugcgucugcaucaacgggacgugcaccguggugaugaccgacggcagcgccuccggccgggcggacaccaagauccuguucaucgaggaggggaagaucguccacaucucgccccugagcggcuccgcccagcacguggaggagugcucgugcuacccccgcuacccgggggugcggugcgucugccgcgacaacuggaagggcuccaaccggcccaucguggacaucaacgugaaggacuacucgaucgucuccagcuacgugugcuccggccucgugggggacacgccccgcaagaacgacucguccagcuccucgcacugccugaaccccaacaacgaggagggcgggcacggcgucaaggggugggccuucgacgacggcaacgacguguggaugggccggaccaucuccgagaagcugcgcucgggguacgagaccuucaaggucaucgagggcugguccaagccgaacagcaagcuccagaucaaccgccaggugaucguggaccgggggaaccgguccggcuacucggggaucuucuccgucgagggcaagagcugcaucaaccgcugcuucuacguggagcugauccggggccgcaagcaggagaccgaggugugguggacgucgaacuccaucgucguguucugcgggaccagcggcaccuacgggaccggcuccuggcccgacggggccgacaucaaccugaugcccaucuga

SEQ ID NO: 16529 - RNA, 1410 nt, Artificial Sequence
  derived and/or modified CDS sequence (AUadapt) from InfluenzaA__AAQ10343__NA
augaaccccaaccagaagaucaucaccaucggcucggugucccugaccaucgccacgaucugcuuccucaugcagaucgccauccuggucaccaccgugacccugcacuucaagcaguacgagugcucguccccgcccaacaaccaggugaugcucugcgagcccacgaucaucgagcgcaacaucaccgagaucgucuaccugaccaacaccacgaucgagaaggagaucugccccaagcuggcggaguaccggaacuggagcaagccgcagugcaagaucaccggguucgcccccuucuccaaggacaacucgauccgccucuccgccggcggggacaucugggugacccgggagcccuacgugagcugcgaccccgacaagugcuaccaguucgcccugggccaggggaccacgcugaacaaccgccacuccaacgacaccguccacgaccggaccccguaccgcacccuccugaugaacgagcugggcgugcccuuccaccucggcacgaagcaggucugcaucgccuggucguccagcuccugccacgacgggaaggcguggcugcacgugugcgugaccggccacgacgagaacgccaccgccucguucaucuacgacgggcggcugguggacuccaucggcucgugguccaagaagauccuccgcacccaggagagcgagugcgucugcaucaacgggacgugcaccguggugaugaccgacggcuccgccucgggccgggcggacaccaagauccuguucaucgaggaggggaagaucguccacaucagcccccuguccggcucggcccagcacguggaggagugcuccugcuacccccgcuacccgggggugcggugcgucugccgcgacaacuggaagggcagcaaccggcccaucguggacaucaacgugaaggacuacuccaucgucucguccuacgugugcagcggccucgugggggacacgccccgcaagaacgacuccucguccucgucccacugccugaaccccaacaacgaggagggcgggcacggcgucaaggggugggccuucgacgacggcaacgacguguggaugggccggaccaucagcgagaaguuccgcuccggguacgagaccuucaaggucaucgagggcuggucgaagccgaacuccaagcugcagaucaaccgccaggugaucguggaccgggggaaccggagcggcuacuccgggaucuucucggucgagggcaagagcugcaucaaccgcugcuucuacguggagcucauccggggccgcaagcaggagaccgaggugugguggacguccaacucgaucgucgccuucugcgggaccuccggcaccuacgggaccggcagcuggcccgacggggccgacaucaaccugaugcccaucuga

SEQ ID NO: 16530 - RNA, 1191 nt, Artificial Sequence
  derived and/or modified CDS sequence (AUadapt) from InfluenzaA__AAQ10344__NA
augaaucccaaccaaaagaucaucaccaucggcagugugucccugaccaucgccaccaucugcuuucucaugcagaucgccauccuggucaccaccgugacccugcacuucaagcaguaugaaugcaauagcccgcccaauaaccaggcgaugcucugcgagcccacgaucaucgagcgcaauaucaccgagaucguguaccugaccaauaccacgaucgagaaagagaucugccccaagcuggccgaguaccggaauugguccaagccgcagugcaaaaucaccggguuugcccccuucaguaaggacaacuccauccgccucagugccggcggggacaucugggucacccgggagcccuauguguccugcgaucccgacaagugcuaucaguucgcccugggccaagggaccacgcugaauaaccgccacaguaacgauaccgugcacgaucggaccccguaccgcacccuccugaugaacgagcugggcguccccuuucaccucggcacgaagcaggucuguaucgcgugguccagcuccaguugccacgaugggaaggccuggcugcacgugugugugaccggccacgacgagaaugccaccgccuccuucaucuaugacgggcggcugguggauagcaucggcuccuggagcaaaaagauccuccgcacccaggaguccgagugugugugcaucaaugggacgugcaccgucgugaugaccgacggcagugcguccggccgggccgacaccaagauccuguuuaucgaagaggggaagaucgugcacacgaguaagcugagcggcuccgcccagcacgucgaagaguguagcuguuacccccgcuaucccggggugcggugcgugugccgcgauaacuggaagggcuccaaucggccgaucgucgacaucaacgugaaggauuacaguaucguguccagcuaugucugcuccggccucgugggggacacgccccgcaagaaugacaguuccagcuccagucacugccugaaucccaacaaugaggaaggcgggcacggcgugaaggggugggccuucgaugacggcaaugacgucuggaugggccggaccaucuccgagaaguuucgcagcggguacgagaccuuuaaggugaucgaaggcugguccaagcccaacaguaagcugcagaucaacuccaagagcuga

SEQ ID NO: 16531 - RNA, 1416 nt, Artificial Sequence
  derived and/or modified CDS sequence (AUadapt) from InfluenzaA__AAR11366__NA
augaaucccaaccagaagcuguucgcccucucgggcguggccaucgcgcuguccguccugaaccuccugaucgggaucucgaacgugggccugaacgugucccuccaccugaaggagaaggggccgaagcaggaggagaaccugaccugcaccacgaucaaccagaacaacaccaccgucguggagaacaccuacgugaacaauacgaccaucaucaccaagggcaccgaccucaagacgcccucguaccugcugcucaacaagucccugugcaacgucgagggguggguggugaucgccaaggacaacgccguccgcuucggcgagucggagcagaucaucgugacccgggagcccuacguguccugcgaccccaccggcugcaagauguacgcccugcaccaggggaccacgauccgcaauaagcacucgaacggcaccauccacgaccggaccgccuuccgcgggcucaucuccaccccgcugggcacgccgcccaccgucucgaacuccgacuucaugugcgugggguggucguccacgaccugccacgacggcaucgcgcggaugaccaucugcauccagggcaauaacgacaacgccaccgccaccguguacuacaaccgccggcugaccacgaccaucaagaccugggcccgcaacauccuccggacccaggagucggagugcgucugccacaacgggacgugcgcgguggugaugaccgacggcuccgccucgucccaggccuacaccaaggucauguauuuccacaaggggcugguggugaaggaggaggagcugcgcggcucggcccggcacaucgaggagugcuccugcuacggccacaaccagaaggugaccugcgucugccgcgacaacuggcagggggccaaccggcccaucaucgagaucgacaugaacacgcucgagcauaccucgcgcuacgugugcaccggcauccugaccgacacgucgcggcccggggacaaguccucgggcgacugcuccaaccccaucaccgggucgcccggcgcgcccggcgucaagggguucggcuuccugaacggggacaacaccuggcucggccgcaccaucuccccgcggagucgcuccggguucgagaugcugaagauccccaacgccggcaccgaccccaacucgcggaucgccgagcgccaggagaucguggacaacaacaacugguccggcuacucgggguccuucaucgacuacuggaacgacaauucggagugcuacaaccccugcuucuacgucgagcugauccggggccgcccggaggaggccaaguacgugugguggacguccaacucgcucaucgcccugugcgggucccccuuccccgugggccccgggucguucccggacggcgcgcagauccaguacuucuccuga

SEQ ID NO: 16532 - RNA, 1350 nt, Artificial Sequence
  derived and/or modified CDS sequence (AUadapt) from InfluenzaA__AAS89005__NA
augaaucccaacaagaagaucaucaccaucggcucgaucugcauggugaccgggauggucucccugaugcuccagaucggcaaccugaucagcaucugggugucccacagcauccauacggggaaccagcagaaggccgagccgaucuccaacaccaacuuccugaccgagaaggccguggcgagcgucaagcucgccggcaacuccagccugugccccaucaaugggugggccguguacuccaaggacaacagcauccgcaucggcuccaagggcgacguguucgucauccgggagcccuucaucaguugcucccaccuggagugccgcaccuucuuccucacgcagggggcccugcugaacgacaagcacaguaacggcaccgugaaggaccggagcccccaccgcacccucauguccugcccggugggggaggcccccucccccuacaacagucgguucgaguccgucgcguggagcgccagcgccugccacgacggcaccuccuggcugacgaucgggaucagcggccccgacuccggcgccguggcggugcugaaguauaacgggaucaucaccgacaccaucaagagcuggcgcaacaacauccuccggacccaggaguccgagugcgccugcgucaauggcucgugcuucacggugaugaccgacgggccguccaacggccaggccagccacaagaucuucaagauggagaagggcaagguggucaaguccguggagcuggaugcccccaacuaccacuacgaggagugcagcugcuaucccgacgccggggagaucacgugcgugugccgcgacaacuggcacggcuccaaccggcccugggucagcuuuaaccagaaccuggaguaccagaucggguacaucugcuccggcguguucggggacaauccgcgccccaacgacggcaccggcagcugcgggcccguguccagcaacggcgcguacggggucaagggcuucuccuuuaaguacgggaacggcguguggaucggccggaccaagagcaccaacucccgcagcggguucgagaugaucugggaccccaauggcuggaucgagaccgacagcuccuucagcgugaagcaggacaucgucgccaucaccgacugguccggguacagcggcuccuuugugcagcacccggagcucacggggcuggacugcauccggcccugcuucugggucgagcugauccgcggccggcccaaggagagcaccaucuggaccuccggcagcuccaucaguuucugcggggugaacuccgacaccgugggcuggagcuggcccgacggggccgagcucccguucacgaucgacaaguga

SEQ ID NO: 16533 - RNA, 1350 nt, Artificial Sequence
  derived and/or modified CDS sequence (AUadapt) from InfluenzaA__AAS89006__NA
augaaucccaacaagaagaucaucaccaucggcucgaucugcauggugaccgggauggucucccugaugcuccagaucggcaaccugaucagcaucugggugucccacagcauccauacggggaaccagcacaaggccgagccgaucuccaacaccaacuuccugaccgagaaggccguggcgagcgucaagcucgccggcaacuccagccugugucccaucaacgggugggccguguacuccaaggacaacagcauccgcaucggcuccaagggcgacguguucgucauccgggagcccuuuaucagcugcucccaccuggagugccgcaccuucuuccucacgcagggggcccugcugaacgacaagcauagcaacggcaccgugaaggaccggagcccccaccgcacccucauguccugcccggugggggaggcccccucccccuacaauucgcgguucgaguccgucgcguggagcgccagcgccugccacgacggcaccuccuggcugacgaucgggaucagcggccccgauaacggcgccguggcggugcugaaguacaacgggaucaucaccgacaccaucaaguccuggcgcaacaacauccuccggacccaggagagcgagugugccugcgucaacggcuccugcuucacggugaugaccgacgggccgagcaacggccaggccucccacaagaucuuuaagauggagaagggcaagguggucaagagcguggagcuggacgcccccaacuaccacuacgaggagugcuccugcuaucccgacgccggggagaucacgugcgugugccgcgacaacuggcacggcagcaaucggcccugggucuccuucaaccagaaccuggaguaccagaucggguacaucugcagcggcguguucggggauaacccgcgccccaacgacggcaccggcuccugcgggcccgugucguccaacggcgcguacggggucaagggcuuuagcuucaaguacgggaacggcguguggaucggccggaccaaguccaccaacagccgcuccggguucgagaugaucugggaccccaauggcuggaccgagaccgacagcagcuucuccgugaagcaggacaucgucgccaucacggacuggagcggguauuccggcagcuucgugcagcacccggagcucaccgggcuggacugcauccggcccugcuucugggucgagcugauccgcggccggcccaaggaguccaccaucuggaccagcggcuccaguaucuccuucugcggggugaacagcgacacggugggcugguccuggcccgacggggccgagcucccguucaccaucgacaaguga

SEQ ID NO: 16534 - RNA, 1410 nt, Artificial Sequence
  derived and/or modified CDS sequence (AUadapt) from InfluenzaA__AAT38822__NA
augaaccccaaccagaagaucaucaccaucggcguggucaacaccacgcugucgaccaucgcccucuucaucggggugggcaaccugguguucaacaccgucauccacgagaagaucggggaccaccagaucgugacccacccgacgaucaugacccccgaggugcccaacugcuccgacaccaucaucaccuacaacaacacggucaucaacaacaucaccaccaccaucaucacggaggccgagcgccccuucaagucgccgcugccccucugccccuuccggggcuucuuccccuuccacaaggacaacgcgauccgccugggggagaacaaggacgugaucgugacccgggagccguacgucuccugcgacaacgacaacugcuggucguucgcccuggcccagggcgcccuccugggcaccaagcacuccaacgggaccaucaaggaccgcacgcccuaccggagccugauccgcuuccccaucggcaccgcccccgugcucgggaacuacaaggagaucugcaucgcgugguccucguccucgugcuucgacggcaaggaguggaugcacgugugcaugaccgggaacgacaacgacgccuccgcccagaucaucuacggcggccggaugaccgacucgaucaaguccuggcgcaaggacauccugcggacgcaggagagcgagugccagugcaucgacgggaccugcgucguggccgugaccgacggcccggcggccaacuccgccgaccaccgcgucuacuggauccgggaggggcgcaucaucaaguacgagaacgugcccaagaccaagauccagcaccuggaggagugcucgugcuacguggacaucgacgucuacugcaucugccgggacaacuggaagggcuccaaccgccccuggaugcggaucaacaacgagacgauccucgagaccggcuacgugugcucgaaguuccacuccgacacgccccgcccggccgaccccucgaucaugagcugcgacucccccucgaacgugaacgggggccccggggucaagggcuucggguucaaggccggcaacgacguguggcugggccggaccguguccaccucggggcgcuccggcuucgagaucaucaaggucaccgagggguggaucaacucgccgaaccacgugaaguccaucacccagacccuggucagcaacaacgacugguccggcuacucgggguccuucaucgugaaggcgaaggacugcuuccagcccugcuucuacguggagcucauccggggccgccccaacaagaacgacgacgucucguggacguccaacucgaucgugaccuucugcggccuggacaacgagcccggguccggcaacuggccggacgggagcaacaucggcuucaugcccaaguga

SEQ ID NO: 16535 - RNA, 1350 nt, Artificial Sequence; identical to SEQ ID NO: 16533
  derived and/or modified CDS sequence (AUadapt) from InfluenzaA__AAV65827__NA

SEQ ID NO: 16536 - RNA, 1410 nt, Artificial Sequence
  derived and/or modified CDS sequence (AUadapt) from InfluenzaA__AAX11488__NA
augaaccccaaccagaagaucaucaccaucggcucggugucccugaccaucgccgccaucugcuuccucaugcagaucgcgauccuggucacgaccgugacccugcacuucaagcagcacgagugcaacucgccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucucggccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccucguccucgugccacgacggcaaggccuggcugcacgucugcgugacgggggacgacaagaacgccaccgccuccuucaucuacaacggccggcugguggacagcaucggguccuggucgaagaagauccuccgcacccaggaguccgagugcgucugcaucaacgggaccugcacgguggugaugaccgacggcagcgcguccgggaaggccgacaccaagauccuguucaucgaggagggcaagaucguccacaucucggcccugagcggguccgcccagcacguggaggagugcucgugcuacccccgguaccccggcgugcgcugcgucugccgggacaacuggaagggcuccaaccgcccgaucguggacaucaacgugaaggacuacucgaucgucuccagcuacgugugcuccgggcucgugggcgacacgccccggaagaacgacucguucuccagcucccacugccuggaccccaacaacgaggagggcggccacggggucaagggcugggccuucgacgacggcaacgacguguggauggggcgcaccaucucggagaagcugcgguccggcuacgagaccuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaaggaggagaccgaggugugguggaccagcaacucgaucgucguguucugcggcacguccgggaccuacggcaccgggagcuggccggacggcgcggacaucaaccugaugcccaucuga

SEQ ID NO: 16537 - RNA, 1410 nt, Artificial Sequence
  derived and/or modified CDS sequence (AUadapt) from InfluenzaA__AAX11508__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacaacaccguccacgaccgcaccccguaccggacccuccugaugaacgagcugggcgugcccuuccaccucgggacgcgccaggugugcaucgccugguccucguccucgugccacgacggcaaggcguggcugcacgucugcgugaccggggacgacaagaacgccaccgccuccuucaucuacaacggccggcugguggacagcaucggguccuggucgaagaagauccuccgcacccaggaguccgagugcgucugcaucaacggcacgugcaccguggugaugaccgacggcagcgccuccgggaaggcggacaccaagauccuguucaucgaggagggcaagaucguccacaucucgacgcugagcggguccgcccagcacguggaggagugcucgugcuacccccgguaccccggcgugcgcugcgucugccgggacaacuggaagggcuccaaccgcccgaucguggacaucaacgugaaggacuacucgaucgucuccagcuacgugugcuccgggcucgugggcgacacgccccggaagaacgacucguucuccagcucccacugccuggaccccaacaacgaggagggcgggcacggggucaagggcugggccuucgacgacggcaacgacguguggauggggcgcaccaucucggagaagcugcgguccggcuacgagaccuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaaggaggagaccgaggugugguggaccagcaacucgaucgucguguucugcggcaccuccgggaccuacggcacggggagcuggccggacggcgccgacaucaaccugaugcccaucuga

SEQ ID NO: 16538 - RNA, 1410 nt, Artificial Sequence
  derived and/or modified CDS sequence (AUadapt) from InfluenzaA__AAX11538__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacucgaacgacaccguccacgagcgcaccccguaccggacccuccugaugaacgagcugggcgugcccuuccaccucgggacgcgccaggugugcaucgccugguccagcuccucgugccacgacggcaaggcguggcugcacgucugcgugaccggggacgacaagaacgccaccgccuccuucaucuacaacggccggcugguggacagcaucggguccuggucgaagaagauccuccgcacccaggaguccgagugcgucugcaucaacggcacgugcaccguggugaugaccgacggcucggccuccgggaaggcggacaccaagauccuguucaucgaggagggcaagaucguccacaucagcacgcugucgggguccgcccagcacguggaggagugcucgugcuacccccgguaccccggcgugcgcugcgucugccgggacaacuggaagggcuccaaccgcccgaucguggacaucaacgugaaggacuacagcaucgucuccucguacgugugcuccgggcucgugggcgacacgccccggaagaacgacagcuccucguccucgcacugccuggaccccaacaacgaggagggcgggcacggggucaagggcugggccuucgacgacggcaacgacguguggauggggcgcaccaucuccgagaagcugcggagcggcuacgagaccuucaaggucaucgaggggugguccaagcccaacucgaagcuccagaucaaccgccaggugaucguggagcggggcaaccgcuccggguacucgggcaucuucuccgucgagggcaagagcugcaucaaccggugcuucuacguggagcugauccgcgggcggaaggaggagaccgaggugugguggaccucgaacuccaucgucguguucugcggcaccagcgggaccuacggcacgggguccuggccggacggcgccgacaucaaccugaugcccaucuga

SEQ ID NO: 16539 - RNA, 1410 nt, Artificial Sequence
  derived and/or modified CDS sequence (AUadapt) from InfluenzaA__AAX11548__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacucgaacgacaccguccacgaccgcaccccguaccggacccuccugaugaacgagcugggcgugcccuuccaccucgggacgcgccaggugugcaucgccugguccagcuccucgugccacgacggcaaggcguggcugcacgucugcgugaccggggacgacaagaacgccaccgccuccuucaucuacaacggccggcugguggacagcaucggguccuggucgaagaagauccuccgcacccaggaguccgagugcgucugcaucaacggcacgugcaccguggugaugaccgacggcucggccuccgggaaggcggacaccaagauccuguucaucgaggagggcaagaucguccacaucagcacgcugucgggguccgcccagcacguggaggagugcucgugcuacccccgguaccccggcgugcgcugcgucugccgggacaacuggaagggcuccaaccgcccgaucguggacaucaacgugaaggacuacagcaucgucuccucguacgugugcuccgggcucgugggcgacacgccccggaagaacgacagcuccucguccucgcacugccuggaccccaacaacgaggagggcgggcacggggucaagggcugggccuucgacgacggcaacgacguguggauggggcgcaccaucuccgagaagcugcggagcggcuacgagaccuucaaggucaucgaggggugguccaagcccaacucgaagcuccagaucaaccgccaggugaucguggagcggggcaaccgcuccggguacucgggcaucuucuccgucgagggcaagagcugcaucaaccggugcuucuacguggagcugauccgcgggcggaaggaggagaccgaggugugguggaccucgaacuccaucgucguguucugcggcaccagcgggaccuacggcacgggguccuggccggacggcgccgacaucaaccugaugcccaucuga

SEQ ID NO: 16540 - RNA, 1410 nt, Artificial Sequence; identical to SEQ ID NO: 16537
  derived and/or modified CDS sequence (AUadapt) from InfluenzaA__AAX11558__NA

SEQ ID NO: 16541 - RNA, 1410 nt, Artificial Sequence
  derived and/or modified CDS sequence (AUadapt) from InfluenzaA__AAX11568__NA
augaaccccaaccagaagaucaucaccaucggcucggugucccugaccaucgccacgaucugcuuccucaugcagaucgccauccuggucaccaccgugacccugcacuucaagcagcacgagugcuacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccagcugccacgacggcaaggcguggcugcacgucugcgugaccggggacgacaagaacgccaccgccuccuucaucuacaacggccggcugguggacucgaucggguccuggagcaagaagauccuccgcacccaggaguccgagugcgucugcaucaacggcacgugcaccguggugaugaccgacggcucggccuccgggaaggcggacaccaagauccuguucaucgaggagggcaagaucguccacaucagcacgcugucgggguccgcccagcacguggaggagugcucgugcuacccccgguaccccggcgugcgcugcgucugccgggacaacuggaagggcuccaaccgcccgaucguggacaucaacgugaaggacuacagcaucgucuccucguacgugugcuccgggcucgugggcgacacgccccggaagaacgacagcuucuccucgucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaaggaggagaccgaggugugguggaccagcaacucgaucgucguguucugcggcaccuccgggaccuacggcacggggagcuggccggacggcgccgacaucaaccugaugcccaucuga

SEQ ID NO: 16542 - RNA, 1410 nt, Artificial Sequence; identical to SEQ ID NO: 16537
  derived and/or modified CDS sequence (AUadapt) from InfluenzaA__AAX11578__NA

SEQ ID NO: 16543 - RNA, 1410 nt, Artificial Sequence
  derived and/or modified CDS sequence (AUadapt) from InfluenzaA__AAX11588__NA
augaaccccaaccagaagaucaucaccaucggcucggugucccugaccaucgccgccaucugcuuccucaugcagaucgcgauccuggucacgaccgugacccugcacuucaagcagcacgagugcaacucgccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucucggccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccucguccucgugccacgacggcaaggccuggcugcacgucugcgugacgggggacgacaagaacgccaccgccuccuucaucuacaacggccggcugguggacagcaucggguccuggucgaagaagauccuccgcacccaggaguccgagugcaucugcaucaacgggaccugcacggucgugaugaccgacggcagcgcguccgggaaggccgacaccaagauccuguucaucgaggagggcaagaucgugcacaucucgacccugagcggguccgcccagcacgucgaggagugcucgugcuacccccgguaccccggcgugcgcugcgugugccgggacaacuggaagggcuccaaccgcccgaucgucgacaucaacgugaaggacuacucgaucguguccagcuacgucugcuccgggcucgugggcgacacgccccggaagaacgacucguucuccagcucccacugccuggaccccaacaacgaggagggcggccacggggugaagggcugggccuucgacgacggcaacgacgucuggauggggcgcaccaucucggagaagcugcgguccggcuacgagaccuucaaggugaucgagggguggucgaagcccaacuccaagcuccagaucaaccgccaggucaucguggagcggggcaaccgcagcggguacuccggcaucuucucgguggagggcaaguccugcaucaaccggugcuucuacgucgagcugauccgcgggcggaaggagaagaccgaggugugguggacgagcaacucgaucguggucuucugcggcaccuccgggaccuacggcaccgggagcuggccggacggcgccgacaucaaccugaugcccaucuga

SEQ ID NO: 16544 - RNA, 1410 nt, Artificial Sequence; identical to SEQ ID NO: 16539
  derived and/or modified CDS sequence (AUadapt) from InfluenzaA__AAX11598__NA

SEQ ID NO: 16545 - RNA, 1410 nt, Artificial Sequence; identical to SEQ ID NO: 16539
  derived and/or modified CDS sequence (AUadapt) from InfluenzaA__AAX11608__NA

SEQ ID NO: 16546 - RNA, 1410 nt, Artificial Sequence
  derived and/or modified CDS sequence (AUadapt) from InfluenzaA__AAX11618__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacucgaacgacaccguccacgaccgcaccccguaccggacccuccugaugaacgagcugggcgugcccuuccaccucgggacgcgccaggugugcaucgccugguccagcuccucgugccacgacggcaaggcguggcugcacgucugcgugaccggggacgacaagaacgccaccgccuccuucaucuacaacggccggcugguggacagcaucggguccuggucgaagaagauccuccgcacccaggaguccgagugcgucugcaucaacggcacgugcaccguggugaugaccgacggcucggccuccgggaaggcggacaccaagauccuguucaucgaggagggcaagaucguccacaucagcgcccugucgggguccgcccagcacguggaggagugcucgugcuacccccgguaccccggcgugcgcugcgucugccgggacaacuggaagggcuccaaccgcccgaucguggacaucaacgugaaggacuacagcaucgucuccucguacgugugcuccgggcucgugggcgacacgccccggaagaacgacagcuccucguccucgcacugccuggaccccaacaacgaggagggcgggcacggggucaagggcugggccuucgacgacggcaacgacguguggauggggcgcaccaucuccgagaagcugcggagcggcuacgagaccuucaaggucaucgaggggugguccaagcccaacucgaagcuccagaucaaccgccaggugaucguggagcggggcaaccgcuccggguacucgggcaucuucuccgucgagggcaagagcugcaucaaccggugcuucuacguggagcugauccgcgggcggaaggaggagaccgaggugugguggacgucgaacuccaucgucguguucugcggcaccagcgggaccuacggcaccggguccuggccggacggcgccgacaucaaccugaugcccaucuga

SEQ ID NO: 16547 - RNA, 1410 nt, Artificial Sequence
  derived and/or modified CDS sequence (AUadapt) from InfluenzaA__AAX12744__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccucgugccacgacggcaaggcguggcugcacgucugcgugaccggggacgacaagaacgccaccgccuccuucaucuacaacggccggcugguggacagcaucggguccuggucgaagaagauccuccgcacccaggaguccgagugcgucugcaucaacggcacgugcaccguggugaugaccgacggcagcgccuccgggaaggcggacaccaagauccuguucaucgaggagggcaagaucguccacaucucgacgcugagcggguccgcccagcacguggaggagugcucgugcuacccccgguaccccggcgugcgcugcgucugccgggacaacuggaagggcuccaaccgcccgaucguggacaucaacgugaaggacuacucgaucgucuccagcuacgugugcuccgggcucgugggcgacacgccccggaagaacgacucguucuccagcucccacugccuggaccccaacaacgaggagggcgggcacggggucaagggcugggccuucgacgacggcaacgacguguggauggggcgcaccaucucggagaagcugcgguccggcuacgagaccuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaaggaggagaccgaggugugguggaccagcaacucgaucgucguguucugcggcaccuccgggaccuacggcacggggagcuggccggacggcgccgacaucaaccugaugcccaucuga

SEQ ID NO: 16548 - RNA, 1410 nt, Artificial Sequence; identical to SEQ ID NO: 16539
  derived and/or modified CDS sequence (AUadapt) from InfluenzaA__AAX12754__NA

SEQ ID NO: 16549 - RNA, 1410 nt, Artificial Sequence
  derived and/or modified CDS sequence (AUadapt) from InfluenzaA__AAX12774__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccgcgaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucucggccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccucguccagcugccacgacggcaaggccuggcugcacgucugcgugacgggggacgacaagaacgccaccgccuccuucaucuacaacggccggcugguggacucgaucggguccuggagcaagaagauccuccgcacccaggaguccgagugcgucugcaucaacgggaccugcacgguggugaugaccgacggcucggcguccgggaaggccgacaccaagauccuguucaucgaggagggcaagaucgucaacaucagcacccugucgggguccgcccagcacguggaggagugcucgugcuacccccgguaccccggcgugcgcugcgucugccgggacaacuggaagggcuccaaccgcccgaucguggacaucaacgugaaggacuacagcaucgucuccucguacgugugcuccgggcucgugggcgacacgccccggaagaacgacagcuucuccucgucccacugccuggaccccaacaacgaggagggcggccacggggucaagggcugggccuucgacgacggcaacgacguguggauggggcgcaccaucagcgagaagcugcgguccggcuacgagaccuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaaggaggagaccgaggugugguggacgagcaacucgaucgucguguucugcggcaccuccgggaccuacggcaccgggagcuggccggacggcgccgacaucaaccugaugcccaucuga

SEQ ID NO: 16550 - RNA, 1410 nt, Artificial Sequence
  derived and/or modified CDS sequence (AUadapt) from InfluenzaA__AAX12804__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacucgaacgacaccguccacgaccgcaccccguaccggacccuccugaugaacgagcugggcgugcccuuccaccucgggacgcgccaggugugcaucgccugguccagcuccucgugccacgacggcaaggcguggcugcacgucugcgugaccggggacgacgagaacgccaccgccuccuucaucuacaacggccggcugguggacagcaucggguccuggucgaagaagauccuccgcacccaggaguccgagugcgucugcaucaacggcacgugcaccguggugaugaccgacggcucggccuccgggaaggcggacaccaagauccuguucaucgaggagggcaagaucguccacaucagcacgcugucgggguccgcccagcacguggaggagugcagcugcuacccccgguaccccggcgugcgcugcgucugccgggacaacuggaagggcuccaaccgcccgaucguggacaucaacgugaaggacuacucgaucgucuccucguacgugugcuccgggcucgugggcgacacgccccggaagaacgacaacuucagcuccucgcacugccuggaccccaacaacgaggagggcgggcacggggucaagggcugggccuucgacgacggcaacgacguguggauggggcgcaccaucuccgagaagcugcggagcggcuacgagaccuucaaggucaucgaggggugguccaagcccaacucgaagcuccagaccaaccgccaggugaucguggagcggggcaaccgcuccggguacucgggcaucuucuccgucgagggcaagagcugcaucaaccggugcuucuacguggagcugauccgcgggcggaaggaggagaccgaggugugguggaccuccaacucgaucgucguguucugcggcaccagcgggacguacggcaccggguccuggccggacggcgccgacaucaaccugaugcccaucuga

SEQ ID NO: 16551 - RNA, 1410 nt, Artificial Sequence
  derived and/or modified CDS sequence (AUadapt) from InfluenzaA__AAX12814__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccgcgaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucucggccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccucguccagcugccacgacggcaaggccuggcugcacgucugcgugacgggggacgacgagaacgccaccgccuccuucaucuacaacggccggcugguggacucgaucggguccuggagcaagaagauccuccgcacccaggaguccgagugcgucugcaucaacgggaccugcacgguggugaugaccgacggcucggcguccgggaaggccgacaccaagauccuguucaucgaggagggcaagaucgucaacaucagcacccugucgggguccgcccagcacguggaggagugcucgugcuacccccgguaccccggcgugcgcugcgucugccgggacaacuggaagggcuccaaccgcccgaucguggacaucaacgugaaggacuacagcaucgucuccucguacgugugcuccgggcucgugggcgacacgccccggaagaacgacagcuucuccucgucccacugccuggaccccaacaacgaggagggcggccacggggucaagggcugggccuucgacgacggcaacgacguguggauggggcgcaccaucagcgagaagcugcgguccggcuacgagaccuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaaggaggagaccgaggugugguggacgagcaacucgaucgucguguucugcggcaccuccgggaccuacggcaccgggagcuggccggacggcgccgacaucaaccugaugcccaucuga

SEQ ID NO: 16552 - RNA, 1410 nt, Artificial Sequence
  derived and/or modified CDS sequence (AUadapt) from InfluenzaA__AAX34064__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucgagcgcaacaucaccgagaucgucuaccugaccaacaccacgaucgagcgggagaucugccccaagcuggcggaguaccgcaacugguccaagccgcagugcaacaucaccggguucgcccccuucagcaaggacaacuccauccggcucucggccggcggggacaucugggugacccgcgagcccuacguguccugcgaccccgacaagugcuaccaguucgcccugggccaggggaccacgcugaacaacggccacucgaacgacaccguccacgaccggaccccguaccgcacccuccugaugaacgagcugggcgugcccuuccaccucgggacgcgccaggugugcaucgccugguccagcuccucgugccacgacggcaaggcguggcugcacgucugcgugaccggggacgacaagaacgccaccgccuccuucaucuacaacggccggcugguggacagcaucggguccuggucgaagaagauccuccggacccaggaguccgagugcgucugcaucaacggcacgugcaccguggugaugaccgacggcucggccuccgggaaggcggacaccaagauccuguucaucgaggagggcaagaucguccacaucagcacgcugucgggguccgcccagcacguggaggagugcucgugcuacccccgcuaccccggcgugcggugcgucugccgcgacaacuggaagggcuccaaccggccgaucguggacaucaacgugaaggacuacagcaucgucuccucguacgugugcuccgggcucgugggcgacacgccccgcaagaacgacagcuccucguccucgcacugccuggaccccaacaacgaggagggcgggcacggggucaagggcugggccuucgacgacggcaacgacguguggauggggcggaccaucuccgagaagcugcgcagcggcuacgagaccuucaaggucaucgaggggugguccaagcccaacucgaagcuccagaucaaccgccaggugaucguggagcggggcaaccgguccggguacucgggcaucuucuccgucgagggcaagagcugcaucaaccgcugcuucuacguggagcugauccgggggcgcaaggaggagaccgaggugugguggaccucgaacuccaucgucguguucugcggcaccagcgggaccuacggcacgggguccuggccggacggcgccgacaucaaccugaugcccaucuga

SEQ ID NO: 16553 - RNA, 1410 nt, Artificial Sequence
  derived and/or modified CDS sequence (AUadapt) from InfluenzaA__AAX35824__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccuggcgaacaccaccaucgagaaggagaucugccccaagcuggccgaguaccggaacugguccaagccgcagugcaacaucacgggguucgcccccuucagcaaggacaacuccauccgccucucggccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccucguccucgugccacgacggcaaggccuggcugcacgucugcgugacgggggacgacaagaacgccaccgccuccuucaucuacaacggccggcugguggacagcaucggguccuggucgaagaagauccuccgcacccaggaguccgagugcgucugcaucaacgggaccugcacgguggugaugaccgacggcagcgcguccgggaaggccgacaccaagauccuguucaucgaggagggcaagaucauccacaucucgacccugagcggguccgcccagcacgucgaggagugcucgugcuacccccgguaccccggcgugcgcugcgugugccgggacaacuggaagggcuccaaccgcccgaucgucgacaucaacgugaaggacuacucgaucguguccagcuacgucugcuccgggcucgugggcgacacgccccggaagaacgacucguccagcuccucgcacugccuggaccccaacaacgaggagggcggccacggggugaagggcugggccuucgacgacggcaacgacgucuggauggggcgcaccaucuccgagaagcugcggucgggcuacgagaccuucaaggugaucgaggggugguccaagcccaacagcaagcuccagaucaaccgccaggucaucguggagcggggcaaccgcuccggguacucgggcaucuucuccguggagggcaagagcugcaucaaccggugcuucuacgucgagcugauccgcgggcggaaggaggagaccgaggugugguggacgucgaacuccaucguggucuucugcggcaccagcgggaccuacggcaccggguccuggccggacggcgccgacaucaaccugaugcccaucuga

SEQ ID NO: 16554 - RNA, 1410 nt, Artificial Sequence; identical to SEQ ID NO: 16537
  derived and/or modified CDS sequence (AUadapt) from InfluenzaA__AAX35834__NA

SEQ ID NO: 16555 - RNA, 1410 nt, Artificial Sequence
  derived and/or modified CDS sequence (AUadapt) from InfluenzaA__AAX35844__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccagcugccacgacggcaaggcguggcugcacgucugcgugaccggggacgacgagaacgccaccgccuccuucaucuacaacggccggcugguggacucgaucggguccuggagcaagaagauccuccgcacccaggaguccgagugcgucugcaucaacggcacgugcaccguggugaugaccgacggcucggccuccgggaaggcggacaccaagauccuguucaucgaggagggcaagaucguccacaucagcacgcugucgggguccgcccagcacguggaggagugcagcugcuacccccgguaccccggcgugcgcugcgucugccgggacaacuggaagggcuccaaccgcccgaucguggacaucaacgugaaggacuacucgaucgucuccagcuacgugugcuccgggcucgugggcgacacgccccggaagaacgacucguucuccaacagccacugccuggaccccaacaacgaggagggcgggcacggggucaagggcugggccuucgacgacggcaacgacguguggauggggcgcaccaucuccgagaagcugcggucgggcuacgagaccuucaaggucaucgaggggugguucaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaaggaggagaccgaggugugguggaccagcaacuccaucgucguguucugcggcaccucggggaccuacggcacggggagcuggccggacggcgccgacaucaaccugaugcccaucuga

SEQ ID NO: 16556 - RNA, 1410 nt, Artificial Sequence
  derived and/or modified CDS sequence (AUadapt) from InfluenzaA__AAX35854__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccagcugccacgacggcaaggcguggcugcacgucugcgugaccggggacgacgagaacgccaccgccuccuucaucuacaacggccggcugguggacucgaucggguccuggagcaagaagauccuccgcacccaggaguccgagugcgucugcaucaacggcacgugcaccguggugaugaccgacggcucggccuccgggaaggcggacaccaagauccuguucaucgaggagggcaagaucguccacaucagcacgcugucgggguccgcccagcacguggaggagugcucgugcuacccccgguaccccggcgugcgcugcgucugccgggacaacuggaagggcuccaaccgcccgaucguggacaucaacgugaaggacuacagcaucgucuccucguacgugugcuccgggcucgugggcgacacgccccggaagaacgacagcuucuccucgucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaaggaggagaccgaggugugguggaccagcaacucgaucgucguguucugcggcaccuccgggaccuacggcacggggagcuggccggacggcgccgacaucaaccugaugcccaucuga

SEQ ID NO: 16557 - RNA, 1410 nt, Artificial Sequence
  derived and/or modified CDS sequence (AUadapt) from InfluenzaA__AAX35864__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccgcgaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucucggccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccucguccagcugccacgacggcaaggccuggcugcacgucugcgugacgggggacgacgagaacgccaccgccuccuucaucuacaacggccggcugguggacucgaucggguccuggagcaagaacauccuccgcacccaggaguccgagugcgucugcaucaacgggaccugcacgguggugaugaccgacggcucggcguccgggaaggccgacaccaagauccuguucaucgaggagggcaagaucgucaacaucagcacccugucgggguccgcccagcacguggaggagugcucgugcuacccccgguaccccggcgugcgcugcgucugccgggacaacuggaagggcuccaaccgcccgaucguggacaucaacgugaaggacuacagcaucgucuccucguacgugugcuccgggcucgugggcgacacgccccggaagaacgacagcuucuccucgucccacugccuggaccccaacaacgaggagggcggccacggggucaagggcugggccuucgacgacggcaacgacguguggauggggcgcaccaucagcgagaagcugcgguccggcuacgagaccuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaaggaggagaccgaggugugguggacgagcaacucgaucgucguguucugcggcaccuccgggaccuacggcaccgggagcuggccggacggcgccgacaucaaccugaugcccaucuga

SEQ ID NO: 16558 - RNA, 1410 nt, Artificial Sequence
  derived and/or modified CDS sequence (AUadapt) from InfluenzaA__AAX47538__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccgcgaucaucgagcgcaacaucacggagaucgucuaccugaccaacaccaccaucgaggaggagaucugccccaagcuggccgaguaccggaacugguccaagccgcagugcaacaucacgggguucgcccccuucagcaaggacaacuccauccgccucucggccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccucguccagcugccacgacggcaaggccuggcugcacgucugcgugacgggggacgacaagaacgccaccgccuccuucaucuacaacggccggcugguggacucgaucggguccuggagcaagaagauccuccgcacccaggaguccgagugcgucugcaucaacgggaccugcacgguggugaugaccgacggcucggcguccgggaaggccgacaccaagauccuguucaucgaggagggcaagaucgucaacaucagcacccugucgggguccgcccagcacguggaggagugcucgugcuacccccgguaccccggcgugcgcugcgucugccgggacaacuggaagggcuccaaccgcccgaucguggacaucaacgugaaggacuacagcaucgucuccucguacgugugcuccgggcucgugggcgacacgccccggaagaacgacagcuucuccucgucccacugccuggaccccaacaacgaggagggcggccacggggucaagggcugggccuucgacgacggcaacgacguguggauggggcgcaccaucagcgagaagcugcgguccggcuacgagaccuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaaggaggagaccgaggugugguggacgagcaacucgaucgucguguucugcggcaccuccgggaccuacggcaccgggagcuggccggacggcgccgacaucaaccugaugcccaucuga

SEQ ID NO: 16559 - RNA, 1410 nt, Artificial Sequence; identical to SEQ ID NO: 16537
  derived and/or modified CDS sequence (AUadapt) from InfluenzaA__AAX56383__NA

SEQ ID NO: 16560 - RNA, 1410 nt, Artificial Sequence
  derived and/or modified CDS sequence (AUadapt) from InfluenzaA__AAX56393__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggcaaggggaccacgcugaacaacggccacagcaacaacaccguccacgaccgcaccccguaccggacccuccugaugaacgagcugggcgugcccuuccaccucgggacgcgccaggugugcaucgccugguccucguccucgugccacgacggcaaggcguggcugcacgucugcgugaccggggacgacaagaacgccaccgccuccuucaucuacaacggccggcugguggacagcaucggguccuggucgaagaagauccuccgcacccaggaguccgagugcgucugcaucaacggcacgugcaccguggugaugaccgacggcagcgccuccgggaaggcggacaccaagauccuguucaucgaggagggcaagaucguccacaucucgacgcugagcggguccgcccagcacguggaggagugcucgugcuacccccgguaccccggcgugcgcugcgucugccgggacaacuggaagggcuccaaccgcccgaucguggacaucaacgugaaggacuacucgaucgucuccagcuacgugugcuccgggcucgugggcgacacgccccggaagaacgacucguucuccagcucccacugccuggaccccaacaacgaggagggcgggcacggggucaagggcugggccuucgacgacggcaacgacguguggauggggcgcaccaucucggagaagcugcgguccggcuacgagaccuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaaggaggagaccgaggugugguggaccagcaacucgaucgucguguucugcggcaccuccgggaccuacggcacggggagcuggccggacggcgccgacaucaaccugaugcccaucuga

SEQ ID NO: 16561 - RNA, 1410 nt, Artificial Sequence; identical to SEQ ID NO: 16537
  derived and/or modified CDS sequence (AUadapt) from InfluenzaA__AAX56413__NA

SEQ ID NO: 16562 - RNA, 1410 nt, Artificial Sequence; identical to SEQ ID NO: 16539
  derived and/or modified CDS sequence (AUadapt) from InfluenzaA__AAX56423__NA

SEQ ID NO: 16563 - RNA, 1410 nt, Artificial Sequence; identical to SEQ ID NO: 16537
  derived and/or modified CDS sequence (AUadapt) from InfluenzaA__AAX56433__NA

SEQ ID NO: 16564 - RNA, 1410 nt, Artificial Sequence; identical to SEQ ID NO: 16556
  derived and/or modified CDS sequence (AUadapt) from InfluenzaA__AAX56443__NA

SEQ ID NO: 16565 - RNA, 1410 nt, Artificial Sequence
  derived and/or modified CDS sequence (AUadapt) from InfluenzaA__AAX56473__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccagcugccacgacggcaaggcguggcugcacgucugcgugaccggggacgacgagaacgccaccgccuccuucaucuacaacggccggcugguggacucgaucggguccuggucgaagaagauccuccgcacccaggaguccgagugcgucugcaucaacggcacgugcaccguggugaugaccgacggcagcgccuccgggaaggcggacaccaagauccuguucaucgaggagggcaagaucguccacaucucgacgcugagcggguccgcccagcacguggaggagugcucgugcuacccccgguaccccggcgugcgcugcgucugccgggacaacuggaagggcuccaaccgcccgaucguggacaucaacgugaaggacuacagcaucgucuccucguacgugugcuccgggcucgugggcgacacgccccggaagaacgacucguucuccagcucccacugccuggaccccaacaacgaggagggcgggcacggggucaagggcugggccuucgacgacggcaacgacguguggauggggcgcaccaucucggagaagcugcgguccggcuacgagaccuucaaggucaucgagggguggagcaagcccaacuccaagcuccagaucaaccgccaggugaucguggagcggggcaaccgcucgggguacuccggcaucuucagcgucgagggcaagaacugcaucaaccggugcuucuacguggagcugauccgcgggcggaaggaggagaccgaggugugguggaccuccaacucgaucgucguguucugcggcaccagcgggaccuacggcacgggguccuggccggacggcgccgacaucaaccugaugcccaucuga

SEQ ID NO: 16566 - RNA, 1410 nt, Artificial Sequence
  derived and/or modified CDS sequence (AUadapt) from InfluenzaA__AAX56483__NA
augaaccccaaccagaagaucaucaccaucggcucggugucccugaccaucgccacgaucugcuuccucaugcagaucgccauccuggucaccaccgugacccugcacuucaagcaguacgagugcgacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccagcugccacgacggcaaggcguggcugcacgucugcgugaccggggacgacgagaacgccaccgccuccuucaucuacaacggccggcugguggacucgaucggguccuggagcaagaagauccuccgcacccaggaguccgagugcgucugcaucaacggcacgugcaccguggugaugaccgacggcucggccuccgggaaggcggacaccaagauccuguucaucgaggagggcaagaucguccacaucagcacgcugucgggguccgcccagcacguggaggagugcucgugcuacccccgguaccccggcgugcgcugcgucugccgggacaacuggaagggcuccaaccgcccgaucguggacaucaacgugaaggacuacagcaucgucuccucguacgugugcuccgggcucgugggcgacacgccccggaagaacgacagcuucuccucgucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaaggaggagaccgaggugugguggaccagcaacucgaucgucguguucugcggcaccuccgggaccuacggcacggggagcuggccggacggcgccgacaucaaccugaugcccaucuga

SEQ ID NO: 16567 - RNA, 1410 nt, Artificial Sequence; identical to SEQ ID NO: 16566
  derived and/or modified CDS sequence (AUadapt) from InfluenzaA__AAX56503__NA

SEQ ID NO: 16568 - RNA, 1410 nt, Artificial Sequence
  derived and/or modified CDS sequence (AUadapt) from InfluenzaA__AAX56513__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccucgugccacgacggcaaggcguggcugcacgucugcgugaccggggacgacgagaacgccaccgccuccuucaucuacaacggccggcugguggacagcaucggguccuggucgaagaagauccuccgcacccaggaguccgagugcgucugcaucaacggcacgugcaccguggugaugaccgacggcagcgccuccgggaaggcggacaccaagauccuguucaucgaggagggcaagaucguccacaucucgacgcugagcggguccgcccagcacguggaggagugcucgugcuacccccgguaccccggcgugcgcugcgucugccgggacaacuggaagggcuccaaccgcccgaucguggacaucaacgugaaggacuacucgaucgucuccagcuacgugugcuccgggcucgugggcgacacgccccggaagaacgacucguucuccagcucccacugccuggaccccaacaacgaggagggcgggcacggggucaagggcugggccuucgacgacggcaacgacguguggauggggcgcaccaucucggagaagcugcgguccggcuacgagaccuucaaggucaucgagggguggucgaagcccaacuccaagcuccagaccaaccgccaggugaucguggagcggggcaaccgcagcggguacuccggcaucuucucggucgagggcaaguccugcaucaaccggugcuucuacguggagcugauccgcgggcggaaggaggagaccgaggugugguggaccagcaacucgaucgucguguucugcggcaccuccgggacguacggcaccgggagcuggccggacggcgccgacaucaaccugaugcccaucuga

SEQ ID NO: 16569 - RNA, 1413 nt, Artificial Sequence
  derived and/or modified CDS sequence (AUadapt) from InfluenzaA__AAX56533__NA
augaaccccaaccagaagaucaucaccaucggcucgaucuccguggccaucgggaucaucagccugauccuccagaucggcaacaucaucuccaucugggccucgcacuccauccagaccgggagccagaacuacacgggcaucugcaaccagcgcaucaucaccuacgagaaccggaccugggucaaccagaccuacgugaacaucaacaacacgaacguggucgcggggaaggacaagaccuccaugacccuggccggcaacucgucccugugcccgauccgcggcugggccaucuacaccaaggacaacagcauccggaucggguccaagggcgacguguucgugauccgcgagcccuucaucucgugcucccaccucgagugccggacguucuuccugacccagggggcccugcucaacgacaagcacagcaacggcaccaucaaggaccgcucccccuuccgggcccugaugucgugcccccugggggaggcgccgucccccuacaacagccgcuucgaguccgucgccuggucggccagcgccugccacgacggccucggcuggcugaccaucgggaucuccggccccgacaacggggcgguggccgugcugaaguacaacggcaucaucacggagaccaucaagucguggaagaagcagauccuccggacccaggaguccgagugcgucugcgugaacggcagcugcuucaccaucaugacggacgggcccuccaaccgcgccgccucguaccggaucuucaagaucgagaagggccgcgugaccaaguccaucgagcuggacgccccgaacuaccacuacgaggagugcagcugcuaccccgacaccgggaccgucaugugcgugugccgggacaacuggcacggcuccaaccgccccugggugucguucaaccagaaccuggacuaccagaucggguacaucugcuccggcgucuucggcgacaacccccggccgaaggacggggagggcagcugcaaccccgugacgguggacggggcggacggcgucaagggguucuccuaccgcuacggcaacggcguguggaucgggcggaccaagucgaaccgccuccggaagggcuucgagaugaucugggaccccaacggguggaccgacaccgacuccgacuucagcaugaagcaggacguggucgccaugaacgacugguccggcuacucgggguccuucgugcagcaccccgagcugacgggccuggacugcaugcgcccgugcuucuggguggagcucguccggggccugccccgcgagaacaccaccaucuggaccagcgggucguccaucagcuucugcggcgugaacuccgagacggccaacuggagcuggcccgacggggccgagcugcccuucaccaucgacaaguga

SEQ ID NO: 16570 - RNA, 1410 nt, Artificial Sequence
  derived and/or modified CDS sequence (AUadapt) from InfluenzaA__AAX56543__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccuccggcgacaucugggugacccgggagcccuacgugagcugcgaccccgacaagugcuaccaguucgcccuggggcagggcaccacgcugaacaacgggcacuccaacgacaccguccacgaccgcaccccguaccggacccuccugaugaacgagcugggcgugcccuuccaccucggcacgaagcaggucugcaucgccuggucguccagcuccugccacgacgggaaggcguggcugcacgugugcgugaccggcgacgacgagaacgccaccgccucguucaucuacaacgggcgccugguggacuccaucggcucgugguccaagaagauccuccggacccaggagagcgagugcgucugcaucaacgggacgugcaccguggugaugaccgacggcuccgccucgggcaaggcggacaccaagauccuguucaucgaggaggggaagaucguccacacgagcucccugucgggcuccgcccagcacguggaggagugcagcugcuacccccgcuaccccggggugcggugcgucugccgcgacaacuggaagggcuccaaccggccgaucguggacaucaacgugaaggacuacucgaucgucuccagcuacgugugcuccggccucgugggggacacgccccgcaagaacgacucguccucguccagccacugccuggaccccaacaacgaggagggcgggcacggcgucaaggggugggccuucgacgacggcaacgacguguggaugggccggaccaucuccgaggagcugcgcucgggguacgagaccuucaaggucaucgagggcugguccaagcccaacagcaagcuccagaucaaccgccaggugaucguggaccgggggaaccgguccggcuacucggggaucuucagcgucgagggcaaguccugcaucaaccgcugcuucuacguggagcugauccggggccgcaagcaggagaccgaggugcuguggaccucgaacuccaucgucguguucugcgggaccagcggcaccuacgggacgggcuccuggccggacggggccgacaucaaccucaugcccaucuga

SEQ ID NO: 16571 - RNA, 1410 nt, Artificial Sequence; identical to SEQ ID NO: 16463
  derived and/or modified CDS sequence (AUadapt) from InfluenzaA__AAX56553__NA

SEQ ID NO: 16572 - RNA, 1410 nt, Artificial Sequence
  derived and/or modified CDS sequence (AUadapt) from InfluenzaA__AAX56563__NA
augaaccccaaccagaagaucaucaccaucggcucggugucccugaccaucgccgccaucugcuuccucaugcagaucgcgauccuggucacgaccgugacccugcacuucaagcagcacgagugcaacucgccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucucggccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccucguccucgugccacgacggcaaggccuggcugcacgucugcgugacgggggacgacaagaacgccaccgccuccuucaucuacaacggccggcugguggacagcaucggguccuggucgaagaagauccuccgcacccaggaguccgagugcgucugcaucaacgggaccugcacgguggugaugaccgacggcagcgcguccgggaaggccgacaccaagauccuguucaucgaggagggcaagaucguccacaucucggcccugagcggguccgcccagcacguggaggagugcucgugcuacccccgguaccccggcgugcgcugcgucugccgggacaacuggaagggcuccaaccgcccgaucguggacaucaacgugaaggacuacucgaucgucuccagcuacgugugcuccgggcucgugggcgacacgccccggaagaacgacucguucuccagcucccacugccuggaccccaacaacgaggagggcggccacggggucaagggcugggccuucgacgacggcaacgacguguggauggggcgcaccaucucggagaagcugcgguccggcuacgagaccuucaaggucaucgagggguggucgaagcccaacuccaagcuccagaucaaccgccaggugaucguggagcgggacaaccgcagcggcuacuccgggaucuucucggucgagggcaaguccugcaucaaccggugcuucuacguggagcugauccgcggccggaaggaggagaccgaggugugguggaccagcaacucgaucgucguguucugcgggacguccggcaccuacgggaccggcagcuggccggacggggcggacaucaaccugaugcccaucuga

SEQ ID NO: 16573 - RNA, 1410 nt, Artificial Sequence
  derived and/or modified CDS sequence (AUadapt) from InfluenzaA__AAX56573__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccgcgaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucucggccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccucguccagcugccacgacggcaaggccuggcugcacgucugcgugacgggggacgacgagaacgccaccgccuccuucaucuacaacggccggcugguggacucgaucggguccuggagcaagaagauccuccgcacccaggaguccgagugcgucugcaucaacgggaccugcacgguggugaugaccgacggcucggcguccgggaaggccgacaccaagauccuguucaucgaggagggcaagaucguccacaucagcacccugucgggguccgcccagcacguggaggagugcucgugcuacccccgguaccccggcgugcgcugcgucugccgggacaacuggaagggcuccaaccgcccgaucguggacaucaacgugaaggacuacagcaucgucuccucguacgugugcuccgggcucgugggcgacacgccccggaagaacgacagcuucuccucgucccacugccuggaccccaacaacgaggagggcggccacggggucaagggcugggccuucgacgacggcaacgacguguggauggggcgcaccaucagcgagaagcugcgguccggcuacgagaccuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaaggaggagaccgaggugugguggacgagcaacucgaucgucguguucugcggcaccuccgggaccuacggcaccgggagcuggccggacggcgccgacaucaaccugaugcccaucuga

SEQ ID NO: 16574 - RNA, 1410 nt, Artificial Sequence
  derived and/or modified CDS sequence (AUadapt) from InfluenzaA__AAX56583__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccucgugccacgacggcaaggcguggcugcacgucugcgugaccggggacgacgagaacgccaccgccuccuucaucuacaacggccggcugguggacagcaucggguccuggucgaagaagauccuccgcacccaggaguccgagugcgucugcaucaacggcacgugcaccguggugaugaccgacggcagcgccuccgggaaggcggacaccaagauccuguucaucgaggagggcaagaucguccacaucucgacgcugagcggguccgcccagcacguggaggagugcucgugcuacccccgguaccccggcgugcgcugcgucugccgggaccacuggaagggcuccaaccgcccgaucguggacaucaacgugaaggacuacucgaucgucuccagcuacgugugcuccgggcucgugggcgacacgccccggaagaacgacucguucuccagcucccacugccuggaccccaacaacgaggagggcgggcacggggucaagggcugggccuucgacgacggcaacgacguguggauggggcgcaccaucucggagaagcugcgguccggcuacgagaccuucaaggucaucgagggguggucgaagcccaacuccaagcuccagaccaaccgccaggugaucguggagcggggcaaccgcagcggguacuccggcaucuucucggucgagggcaaguccugcaucaaccggugcuucuacguggagcugauccgcgggcggaaggaggagaccgaggugugguggaccagcaacucgaucgucguguucugcggcaccuccgggacguacggcaccgggagcuggccggacggcgccgacaucaaccugaugcccaucuga

SEQ ID NO: 16575 - RNA, 1410 nt, Artificial Sequence
  derived and/or modified CDS sequence (AUadapt) from InfluenzaA__AAX56593__NA
augaaccccaaccagaagaucaucaccaucggcucggugucccugaccaucgccacgaucugcuuccucaugcagaucgccauccuggucaccaccgugacccugcacuucaagcaguacgagugcaacagcccgcccaacaaccaggugaugcucugcgagcccgcgaucaucgagcgcaacaucacggagaucgucuaccugaccaacaccaccaucgagaaggagaucugccccaagcuggccgaguaccggaacugguccaagccgcagugcaacaucacgggguucgcccccuucucgaaggacaacuccauccgccucagcgccggcggggacaucugggugacccgggagcccuacguguccugcgaccccgacaagugcuaccaguucgcccugggccaggggaccacccugaacaacggccacucgaacgacacgguccacgaccgcaccccguaccggacccuccugaugaacgagcugggcgugcccuuccaccucgggacccgccaggugugcaucgcgugguccagcuccucgugccacgacggcaaggccuggcugcacgucugcgugacgggggacgacgagaacgccaccgccuccuucaucuacaacggccggcugguggacagcaucggguccuggucgaagaagauccuccgcacccaggaguccgagugcgucugcaucaacgggaccugcacgguggugaugaccgacggcagcgcguccgggaaggccgacaccaagauccuguucaucgaggagggcaagaucgucaacaucucgacccugagcggguccgcccagcacguggaggagugcucgugcuacccccgguaccccggcgugcgcugcgucugccgggacaacuggaagggcuccaaccgcccgaucguggacaucaacgugaaggacuacagcaucgucuccucguacgugugcuccgggcucgugggcgacacgccccggaagaacgacagcuucuccucgucccacugccuggaccccaacaacgaggagggcggccacggggucaagggcugggccuucgacgacggcaacgacguguggauggggcgcaccaucagcgagaaguuccgguccggcuacgagaccuucaaggucaucgagggguggucgaagcccaacuccaagcugcagaucaaccgccaggugaucguggagcggggcaaccgcagcggguacuccggcaucuucucggucgagggcaaguccugcaucaaccggugcuucuacguggagcucauccgcgggcggaaggaggagaccgaggugugguggacgagcaacucgaucgucguguucugcggcaccuccgggaccuacggcaccgggagcuggccggacggcgccgacaucaaccugaugcccaucuga

SEQ ID NO: 16576 - RNA, 1410 nt, Artificial Sequence
  derived and/or modified CDS sequence (AUadapt) from InfluenzaA__AAX56603__NA
augaaccccaaccagaagaucaucaccaucggcucggugucccugaccaucgccgccaucugcuuccucaugcagaucgcgauccuggucacgaccgugacccugcacuucaagcagcacgagugcaacucgccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucucggccggcggggacaucugggugacccgggagcccuacguguccugcgaccccgacaagugcuaccaguucgcccugggccaggggaccacccugaacaacggccacucgaacgacacggcgcacgaccgcaccccguaccggacccuccugaugaacgagcugggcguccccuuccaccucgggacccgccaggugugcaucgccugguccagcuccucgugccacgacggcaaggccuggcugcacgugugcgucacgggggacgacaagaacgccaccgcguccuucaucuacaacggccggcugguggacagcaucggguccuggucgaagaagauccuccgcacccaggaguccgagugcgugugcaucaacgggaccugcacggucgugaugaccgacggcucggccuccgggaaggccgacaccaagauccuguucaucgaggagggcaagaucgugcacaucagcacccugucgggguccgcccagcacgucgaggagugcucgugcuacccccgguaccccggcgugcgcugcgugugccgggacaacuggaagggcuccaaccgcccgaucgucgacaucaacgugaaggacuacagcaucguguccucguacgucugcuccgggcucgugggcgacacgccccggaagaacgacagcuucuccucgucccacugccuggaccccaacaacgaggagggcggccacggggugaagggcugggccuucgacgacggcaacgacgucuggauggggcgcaccaucucggagaagcugcgguccggcuacgagaccuucaaggugaucgagggguggagcaagcccaacuccaagcuccagaucaaccgccaggucaucguggagcggggcaaccgcucgggguacuccggcaucuucucgguggagggcaaguccugcaucaaccggugcuucuacgucgagcugauccgcgggcggaaggaggagaccgaggugugguggacgagcaacucgaucguggucuucugcggcaccuccgggaccuacggcaccgggagcuggccggacggcgcggacaucaaccugaugcccaucuga

SEQ ID NO: 16577 - RNA, 1410 nt, Artificial Sequence; identical to SEQ ID NO: 16547
  derived and/or modified CDS sequence (AUadapt) from InfluenzaA__AAX57647__NA

SEQ ID NO: 16578 - RNA, 1410 nt, Artificial Sequence; identical to SEQ ID NO: 16537
  derived and/or modified CDS sequence (AUadapt) from InfluenzaA__AAX57657__NA

SEQ ID NO: 16579 - RNA, 1410 nt, Artificial Sequence; identical to SEQ ID NO: 16575
  derived and/or modified CDS sequence (AUadapt) from InfluenzaA__AAX57667__NA

SEQ ID NO: 16580 - RNA, 1410 nt, Artificial Sequence; identical to SEQ ID NO: 16556
  derived and/or modified CDS sequence (AUadapt) from InfluenzaA__AAX57677__NA

SEQ ID NO: 16581 - RNA, 1410 nt, Artificial Sequence
  derived and/or modified CDS sequence (AUadapt) from InfluenzaA__AAX57687__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccgcgaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucucggccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccucguccagcugccacgacggcaaggccuggcugcacgucugcgugacgggggacgacgagaacgccaccgccuccuucaucuacgacggccggcugguggacucgaucggguccuggagcaagaagauccuccgcacccaggaguccgagugcgucugcaucaacgggaccugcacgguggugaugaccgacggcucggcguccgggaaggccgacaccaagauccuguucaucgaggagggcaagaucgucaacaucagcacccugucgggguccgcccagcacguggaggagugcucgugcuacccccgguaccccggcgugcgcugcgucugccgggacaacuggaagggcuccaaccgcccgaucguggacaucaacgugaaggacuacagcaucgucuccucguacgugugcuccgggcucgugggcgacacgccccggaagaacgacagcuucuccucgucccacugccuggaccccaacaacgaggagggcggccacggggucaagggcugggccuucgacgacggcaacgacguguggauggggcgcaccaucagcgagaagcugcgguccggcuacgagaccuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaaggaggagaccgaggugugguggacgagcaacucgaucgucguguucugcggcaccuccgggaccuacggcaccgggagcuggccggacggcgccgacaucaaccugaugcccaucuga

SEQ ID NO: 16582 - RNA, 1410 nt, Artificial Sequence
  derived and/or modified CDS sequence (AUadapt) from InfluenzaA__AAX57697__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccucgugccacgacggcaaggcguggcugcacgucugcgugaccggggacgacgagaacgccaccgccuccuucaucuacaacggccggcugguggacagcaucggguccuggucgaagaagauccuccgcacccaggaguccgagugcgucugcaucaacggcacgugcaccguggugaugaccgacggcagcgccuccgggaaggcggacaccaagauccuguucaucgaggagggcaagaucguccacaucucgacgcugagcggguccgcccagcacguggaggagugcucgugcuacccccgguaccccggcgugcgcugcgucugccgggacaacuggaagggcuccaaccgcccgaucguggacaucaacgugaaggaccacucgaucgucuccagcuacgugugcuccgggcucgugggcgacacgccccggaagaacgacucguucuccagcucccacugccuggaccccaacaacgaggagggcgggcacggggucaagggcugggccuucgacgacggcaacgacguguggauggggcgcaccaucucggagaagcugcgguccggcuacgagaccuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaaggaggagaccgaggugugguggaccagcaacucgaucgucguguucugcggcaccuccgggaccuacggcacggggagcuggccggacggcgccgacaucaaccugaugcccaucuga

SEQ ID NO: 16583 - RNA, 1410 nt, Artificial Sequence
  derived and/or modified CDS sequence (AUadapt) from InfluenzaA__AAX57707__NA
augaaccccaaccagaagaucaucaccaucggcucggugucccugaccaucgccgccaucugcuuccucaugcagaucgcgauccuggucacgaccgugacccugcacuucaagcagcacgagugcaacucgccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucucggccggcggggacaucugggugacccgggagcccuacguguccugcgaccccgacaagugcuaccaguucgcccugggccaggggaccacccugaacaacggccacucgaacgacacgguccacgaccgcaccccguaccggacccuccugaugaacgagcugggcgugcccuuccaccucgggacccgccaggugugcaucgcgugguccagcuccucgugccacgacggcaaggccuggcugcacgucugcgugacgggggacgacaagaacgccaccgccuccuucaucuacaacggccggcugguggacagcaucggguccuggucgaagaagauccuccgcacccaggaguccgagugcgucugcaucaacgggaccugcacgguggugaugaccgacggcucggcguccgggaaggccgacaccaagauccuguucaucgaggagggcaagaucguccacaucagcacccugucgggguccgcccagcacguggaggagugcagcugcuacccccgguaccccggcgugcgcugcgucugccgggacaacuggaagggcuccaaccgcccgaucguggacaucaacgugaaggacuacucgaucgucuccucguacgugugcuccgggcucgugggcgacacgccccggaagaacgaccgcuucagcuccucgcacugccuggaccccaacaacgaggagggcggccacggggucaagggcugggccuucgacgacggcaacgacguguggauggggcggaccaucuccgagaagcugcgcagcggcuacgagaccuucaaggucaucgaggggugguccaagcccaacucgaagcuccagaucaaccgccaggugaucguggagcggggcaaccgguccggguacucgggcaucuucuccgucgagggcaagagcugcaucaaccgcugcuucuacguggagcugauccgggggcgcaaggaggagaccgaggugugguggacguccaacucgaucgucguguucugcggcaccagcgggaccuacggcaccggguccuggccggacggcgccgacaucaaccugaugcccaucuga

SEQ ID NO: 16584 - RNA, 1410 nt, Artificial Sequence; identical to SEQ ID NO: 16556
  derived and/or modified CDS sequence (AUadapt) from InfluenzaA__AAX57717__NA

SEQ ID NO: 16585 - RNA, 1410 nt, Artificial Sequence; identical to SEQ ID NO: 16575
  derived and/or modified CDS sequence (AUadapt) from InfluenzaA__AAX57726__NA

SEQ ID NO: 16586 - RNA, 1410 nt, Artificial Sequence; identical to SEQ ID NO: 16575
  derived and/or modified CDS sequence (AUadapt) from InfluenzaA__AAX57737__NA

SEQ ID NO: 16587 - RNA, 1410 nt, Artificial Sequence; identical to SEQ ID NO: 16463
  derived and/or modified CDS sequence (AUadapt) from InfluenzaA__AAX57747__NA

SEQ ID NO: 16588 - RNA, 1410 nt, Artificial Sequence; identical to SEQ ID NO: 16463
  derived and/or modified CDS sequence (AUadapt) from InfluenzaA__AAX57757__NA

SEQ ID NO: 16589 - RNA, 1410 nt, Artificial Sequence
  derived and/or modified CDS sequence (AUadapt) from InfluenzaA__AAX57767__NA
augaaccccaaccagaagaucaucaccaucggcucggugucccugaccaucgccacgaucugcuuccucaugcagaucgccauccuggucaccaccgugacccugcacuucaagcaguacgagugcaacccgccgcccaacaaccaggugaugcucugcgagcccacgaucaucgagcgcaacaucaccgagaucgucuaccugaccaacaccacgaucgagaaggagaucugccccaagcuggcggaguaccggaacuggucgaagccccagugcaacaucaccggguucgcccccuucuccaaggacaacagcauccgccucuccgccggcggggacaucugggugacccgggagcccuacgugucgugcgacccggacaagugcuaccaguucgcccugggccaggggaccacgcugaacaacggccacuccaacgacaccguccacgaccgcacccccuaccggacccuccugaugaacgagcugggcgugcccuuccaccucgggacgaagcaggucugcaucgccuggucguccagcuccugccacgacggcaaggcguggcugcacgugugcgugaccggggacgacgagaacgccaccgccucguucaucuacaacggccgccugguggacuccaucgggagcugguccaagaagauccuccggacccaggagucggagugcgucugcaucaacggcacgugcaccguggugaugaccgacggcuccgccucggggaaggcggacaccaagauccuguucaucgaggagggcaagaucguccacacgucccugcucagcgggucggcccagcacguggaggagugcuccugcuacccccgcuacccgggcgugcggugcgucugccgcgacaacuggaagggcucgaaccggcccaucguggacaucaacgugaaggacuacuccaucgucagcuccuacgugugcucggggcuggugggcgacacgccccgcaagaacgacuccagcuccucgucccacugccuggaccccaacaacgaggagggcgggcacggggucaagggcugggccuucgacgacggcaacgacguguggauggggcggaccaucucggagaagcuccgcuccggcuacgagaccuucaaggucaucgagggguggagcaagccgaacuccaagcugcagaucaaccgccaggugaucguggaccggggcaaccggucgggguacuccggcaucuucucggucgagggcaaguccugcaucaaccgcugcuucuacguggagcugauccgggggcgcaagcaggagaccgaggugcucuggaccagcaacucgaucgucguguucugcggcaccuccgggaccuacggcacggggagcuggcccgacggcgccgacaucaaccugaugcccaucuga

SEQ ID NO: 16590 - RNA, 1410 nt, Artificial Sequence
  derived and/or modified CDS sequence (AUadapt) from InfluenzaA__AAX57777__NA
augaaccccaaccagaagaucaucaccaucggcucggugucccugaucaucgccaccaucugcuuccucaugcagaucgccauccuggucacgaccgugacccugcacuucaagcaguacgagugcaacucgccgcccaacaaccaggugaugcucugcgagcccaccaucaucgagcgcaacaucacggagaucgucuaccugaccaacaccaccaucgagaaggagaucugccccaagcuggcggaguaccggaacugguccaagccgcagugcaacaucacgggguucgcccccuucagcaaggacaacuccauccgccucucggccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggaccaagcaggucugcaucgccugguccucguccagcugccacgacggcaaggcguggcugcacgugugcgugacgggggacgacgagaacgccaccgccuccuucaucuacaacggccgccugguggacucgaucggguccuggucgaagaagauccuccggacccaggaguccgagugcgucugcaucaacgggaccugcacgguggugaugaccgacggcagcgccuccgggaaggcggacaccaagauccuguucaucgaggagggcaagaucguccacaccucgagccuguccgggucggcccagcacguggaggagugcuccugcuacccccgcuaccccggcgugcggugcgucugccgcgacaacuggaagggcagcaaccggccgaucguggacaucaacgugaaggacuacuccaucgucucguccuacgugugcagcgggcucgugggcgacacgccccgcaagaacgacuccucguccucgucccacugccuggaccccaacaacgaggagggcggccacggggucaagggcugggccuucgacgacggcaacgacguguggauggggcggaccaucagcgagaagcugcgcuccggcuacgagaccuucaaggucaucgagggguggucgaagcccaacuccaagcuccagaucaaccgccaggugaucguggaccggggcaaccggagcggguacuccggcaucuucucggucgagggcaagagcugcaucaaccgcugcuucuacguggagcugauccgggggcgcaagcaggagaccgaggugcuguggacguccaacucgaucgucguguucugcggcaccuccgggaccuacggcaccgggagcuggccggacggcgccgacaucaaccucaugcccaucuga

SEQ ID NO: 16591 - RNA, 1410 nt, Artificial Sequence
  derived and/or modified CDS sequence (AUadapt) from InfluenzaA__AAX57787__NA
augaaccccaaccagaagaucaucaccaucggcucggugucccugaccaucgccacgaucugcuuccucaugcagaucgccauccuggucaccaccgugacccugcacuucaagcaguacgagugcaacagcccgcccaacaaccaggugaugcucugcgagcccgcgaucaucgagcgcaacaucacggagaucgucuaccugaccaacaccaccaucgagaaggagaucugccccaagcuggccgaguaccggaacugguccaagccgcagugcaacaucacgggguucgcccccuucucgaaggacaacuccauccgccucagcgccggcggggacaucugggugacccgggagcccuacguguccugcgaccccgacaagugcuaccaguucgcccugggccaggggaccacccugaacaacggccacucgaacgacacgguccacgaccgcaccccguaccggacccuccugaugaacgagcugggcgugcccuuccaccucgggacccgccaggugugcaucgcgugguccagcuccucgugccacgacggcaaggccuggcugcacgucugcgugacgggggacgacgagaacgccaccgccuccuucaucuacaacggccggcugguggacagcaucggguccuggucgaagaagauccuccgcacccaggaguccgagugcgucugcaucaacgggaccugcacgguggugaugaccgacggcagcgcguccgggaaggccaacaccaagauccuguucaucgaggagggcaagaucgucaacaucucgacccugagcggguccgcccagcacguggaggagugcucgugcuacccccgguaccccggcgugcgcugcgucugccgggacaacuggaagggcuccaaccgcccgaucguggacaucaacgugaaggacuacagcaucgucuccucguacgugugcuccgggcucgugggcgacacgccccggaagaacgacagcuucuccucgucccacugccuggaccccaacaacgaggagggcggccacggggucaagggcugggccuucgacgacggcaacgacguguggauggggcgcaccaucagcgagaaguuccgguccggcuacgagaccuucaaggucaucgagggguggucgaagcccaacuccaagcugcagaucaaccgccaggugaucguggagcggggcaaccgcagcggguacuccggcaucuucucggucgagggcaaguccugcaucaaccggugcuucuacguggagcucauccgcgggcggaaggaggagaccgaggugugguggacgagcaacucgaucgucguguucugcggcaccuccgggaccuacggcaccgggagcuggccggacggcgccgacaucaaccugaugcccaucuga

SEQ ID NO: 16592 - RNA, 1410 nt, Artificial Sequence; identical to SEQ ID NO: 16463
  derived and/or modified CDS sequence (AUadapt) from InfluenzaA__AAX57797__NA

SEQ ID NO: 16593 - RNA, 1410 nt, Artificial Sequence; identical to SEQ ID NO: 16463
  derived and/or modified CDS sequence (AUadapt) from InfluenzaA__AAX57807__NA

SEQ ID NO: 16594 - RNA, 1410 nt, Artificial Sequence
  derived and/or modified CDS sequence (AUadapt) from InfluenzaA__AAX57817__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccucguccagcugccacgacggcaaggcguggcugcacgugugcgugaccggggacgacgagaacgccaccgccuccuucaucuacaacggccgccugguggacucgaucuccucgugguccaagaagauccuccggacccaggagagcgagugcgucugcaucaacgggacgugcaccguggugaugaccgacggcuccgccucgggcaaggcggacaccaagauccuguucaucgaggaggggaagaucguccacacgagcucccugucgggcuccgcccagcacguggaggagugcagcugcuacccccgcuaccccggggugcggugcgucugccgcgacaacuggaagggcuccaaccggccgaucguggacaucaacgugaaggacuacucgaucgucuccagcuacgugugcuccggccucgugggggacacgccccgcaagaacgacucguccucguccagccacugccuggaccccaacaacgaggagggcgggcacggcgucaaggggugggccuucgacgacggcaacgacguguggaugggccggaccaucuccgagaagcugcgcucgggguacgagaccuucaaggucaucgagggcugguccaagcccaacagcaagcuccagaucaaccgccaggugaucguggaccgggggaaccgguccggcuacucggggaucuucagcgucgagggcaaguccugcaucaaccgcugcuucuacguggagcugauccggggccgcaagcaggagaccgaggugcuguggaccucgaacuccaucgucguguucugcgggaccagcggcaccuacgggacgggcuccuggccggacggggccgacaucaaccucaugcccaucuga

SEQ ID NO: 16595 - RNA, 1410 nt, Artificial Sequence; identical to SEQ ID NO: 16463
  derived and/or modified CDS sequence (AUadapt) from InfluenzaA__AAX57837__NA

SEQ ID NO: 16596 - RNA, 1410 nt, Artificial Sequence
  derived and/or modified CDS sequence (AUadapt) from InfluenzaA__AAX57847__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccucguccagcugccacgacggcaaggcguggcugcacgugugcgugaccggggacgacgagaacgccaccgccuccuucaucuacaacggccgccugguggacucgaucggguccuggucgaagaagauccuccggacccaggaguccgagugcgucugcaucaacggcacgugcaccguggugaugaccgacggcagcgccuccgggaaggcggacaccaagauccuguucaucgaggagggcaagaucguccacacgucgcugcucagcggguccgcccagcacguggaggagugcucgugcuacccccgcuaccccggcgugcggugcgucugccgcgacaacuggaagggcuccaaccggccgaucguggacaucaacgugaaggacuacagcaucgucuccucguacgugugcuccgggcuggugggcgacacgccccgcaagaacgacagcuccucguccucgcacugccuggaccccaacaacgaggagggcgggcacggggucaagggcugggccuucgacgacggcaacgacguguggauggggcggaccaucuccgagaagcuccgcagcggcuacgagaccuucaaggucaucgaggggugguccaagcccaacucgaagcugcagaucaaccgccaggugaucguggaccggggcaaccgguccggguacagcggcaucuucuccgucgagucgaagagcugcaucaaccgcugcuucuacguggagcugauccggggccgcaagcaggagaccgaggugcucuggaccuccaacucgaucgucguguucugcgggaccuccggcaccuacgggacgggcagcuggccggacggggccgacaucaaccugaugcccaucuga

SEQ ID NO: 16597 - RNA, 1410 nt, Artificial Sequence
  derived and/or modified CDS sequence (AUadapt) from InfluenzaA__AAX57857__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaccaucgagcgcaacaucaccgagaucgucuaccugaccaacacgaccaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggacgacccugaacaacggccacucgaacgacaccguccacgaccgcaccccguaccggacgcuccugaugaacgagcugggcgugcccuuccaccucgggaccaagcaggucugcaucgccugguccagcuccucgugccacgacggcaaggcguggcugcacgugugcgugaccggggacgacgagaacgccaccgccuccuucaucuacaacggccgccugguggacucgaucggguccuggagcaagaagauccuccggacgcaggaguccgagugcgucugcaucaacgggaccugcaccguggugaugaccgacggcucggccuccgggaaggcggacacgaagauccuguucaucgaggagggcaagaucguccacaccucgagccuguccgggucggcccagcacguggaggagugcuccugcuacccccgcuaccccggcgugcggugcgucugccgcgacaacuggaagggcagcaaccggccgaucguggacaucaacgugaaggacuacuccaucgucucguccuacgugugcucggggcucgugggcgacacgccccgcaagaacgacuccagcuccucgucccacugccuggaccccaacaacgaggagggcggccacggggucaagggcugggccuucgacgacggcaacgacguguggauggggcggaccaucucggagaagcugcgcuccggcuacgagaccuucaaggucaucgagggguggagcaagcccaacuccaagcuccagaucaaccgccaggugaucguggaccggggcaaccggucgggguacuccggcaucuucucggucgagggcaagagcugcaucaaccgcugcuucuacguggagcugauccgggggcgcaagcaggagaccgaggugcuguggaccuccaacucgaucgucguguucugcggcaccuccgggacguacggcaccgggagcuggccggacggcgccgacaucaaccucaugcccaucuga

SEQ ID NO: 16598 - RNA, 1410 nt, Artificial Sequence; identical to SEQ ID NO: 16463
  derived and/or modified CDS sequence (AUadapt) from InfluenzaA__AAX57867__NA

SEQ ID NO: 16599 - RNA, 1410 nt, Artificial Sequence
  derived and/or modified CDS sequence (AUadapt) from InfluenzaA__AAX57877__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccucguccucgugccacgacggcaaggcguggcugcacgugugcgugaccggggacgacgagaacgccaccgccuccuucaucuacaacggccgccugguggacagcaucggguccuggucgaagaagauccuccggacccaggaguccgagugcgucugcaucaacggcacgugcaccguggugaugaccgacggcagcgccuccgggaaggcggacaccaagauccuguucaucgaggagggcaagaucguccacacgucgucgcuguccgggagcgcccagcacguggaggagugcuccugcuacccccgcuaccccggcgugcggugcgucugccgcgacaacuggaagggcucgaaccggccgaucguggacaucaacgugaaggacuacuccaucgucagcuccuacgugugcucggggcucgugggcgacacgccccgcaagaacgacuccucguccagcucccacugccuggaccccaacaacgaggagggcgggcacggggucaagggcugggccuucgacgacggcaacgacguguggauggggcggaccaucucggagaagcugcgcuccggcuacgagaccuucaaggucaucgagggguggagcaagcccaacuccaagcuccagaucaaccgccaggugaucguggaccggggcaaccggucgggguacuccggcaucuucucggucgagggcaagagcugcaucaaccgcugcuucuacguggagcugauccgggggcgcaagcaggagaccgaggugcuguggaccuccaacucgaucgucguguucugcggcaccuccgggaccuacggcacggggagcuggccggacggcgccgacaucaaccucaugcacaucuga

SEQ ID NO: 16600 - RNA, 1410 nt, Artificial Sequence; identical to SEQ ID NO: 16463
  derived and/or modified CDS sequence (AUadapt) from InfluenzaA__AAX57887__NA

SEQ ID NO: 16601 - RNA, 1410 nt, Artificial Sequence
  derived and/or modified CDS sequence (AUadapt) from InfluenzaA__AAX57897__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccucguccagcugccacgacggcaaggcguggcugcacgugugcgugaccggggacgacgagaacgccaccgccuccuucaucuacaacggccgccugguggacucgaucggguccuggucgaagaagauccuccggacccaggaguccgagugcgucugcaucaacggcacgugcaccguggugaugaccgacggcagcgccuccgggaaggcggacaccaagauccuguucaucgaggagggcaagaucguccacacgucgagccuguccgggucggcccagcacguggaggagugcuccugcuacccccgcuaccccggcgugcggugcgucugccgcgacaacuggaagggcagcaaccggccgaucguggacaucaacgugaaggacuacuccaucgucucguccuacgugugcagcgggcucgugggcgacacgccccgcaagaacgacuccucguccucgucccacugccuggaccccaacaacgaggagggcgggcacggggucaagggcugggccuucgacagcggcaacgacguguggauggggcggaccaucuccgagaagcugcgcucgggcuacgagaccuucaaggucaucgaggggugguccaagcccaacagcaagcuccagaucaaccgccaggugaucguggaccggggcaaccgguccggguacucgggcaucuucagcgucgagggcaaguccugcaucaaccgcugcuucuacguggagcugauccgggggcgcaagcaggagaccgaggugcuguggaccucgaacuccaucgucguguucugcggcaccagcgggaccuacggcacgggguccuggccggacggcgccgacaucaaccucaugcccaucuga

SEQ ID NO: 16602 - RNA, 1410 nt, Artificial Sequence
  derived and/or modified CDS sequence (AUadapt) from InfluenzaA__AAX57907__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccucguccucgugccacgacggcaaggcguggcugcacgugugcgugaccggggacgacgagaacgccaccgccuccuucaucuacaacggccgccugguggacagcaucggguccuggucgaagaagauccuccggacccaggaguccgagugcgucugcaucaacggcacgugcaccguggugaugaccgacggcagcgccuccgggaaggcggacaccaagauccuguucaucgaggagggcaagaucguccacacgucgucgcuguccgggagcgcccagcacguggaggagugcuccugcuacccccgcuaccccggcgugcggugcgucugccgcgacaacuggaagggcucgaaccggccgaucguggacaucaacgugaaggacuacuccaucgucagcuccuacgugugcucggggcucgugggcgacacgccccgcaagaacgacuccucguccagcucccacugccuggaccccaacaacgaggagggcgggcacggggucaagggcugggccuucgacgacggcaacgacguguggauggggcggaccaucucggagaagcugcgcuccggcuacgagaccuucaaggucaucgagggguggagcaagcccaacuccaagcuccagaugaaccgccaggugaucguggaccggggcaaccggucgggguacuccggcaucuucucggucgagggcaagagcugcaucaaccgcugcuucuacguggagcugauccgggggcgcaagcaggagaccgaggugcuguggaccuccaacucgaucgucguguucugcggcaccuccgggaccuacggcacggggagcuggccggacggcgccgacaucaaccucaugcccaucuga

SEQ ID NO: 16603 - RNA, 1410 nt, Artificial Sequence; identical to SEQ ID NO: 16463
  derived and/or modified CDS sequence (AUadapt) from InfluenzaA__AAX57917__NA

SEQ ID NO: 16604 - RNA, 1410 nt, Artificial Sequence; identical to SEQ ID NO: 16463
  derived and/or modified CDS sequence (AUadapt) from InfluenzaA__AAX57927__NA

SEQ ID NO: 16605 - RNA, 1410 nt, Artificial Sequence
  derived and/or modified CDS sequence (AUadapt) from InfluenzaA__AAX57937__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagauggucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccucguccucgugccacgacggcaaggcguggcugcacgugugcgugaccggggacgacgagaacgccaccgccuccuucaucuacaacggccgccugguggacagcaucggguccuggucgaagaagauccuccggacccaggaguccgagugcgucugcaucaacggcacgugcaccguggugaugaccgacggcagcgccuccgggaaggcggacaccaagauccuguucaucgaggagggcaagaucguccacacgucgcugcucagcggguccgcccagcacguggaggagugcucgugcuacccccgcuaccccggcgugcggugcgucugccgcgacaacuggaagggcuccaaccggccgaucguggacaucaacgugaaggacuacucgaucgucuccagcuacgugugcuccgggcuggugggcgacacgccccgcaagaacgacucguccagcuccucgcacugccuggaccccaacaacgaggagggcgggcacggggucaagggcugggccuucgacgacggcaacgacguguggauggggcggaccaucuccgagaagcuccgcucgggcuacgagaccuucaaggucaucgaggggugguccaagcccaacagcaagcugcagaucaaccgccaggugaucguggaccggggcaaccgguccggguacucgggcaucuucuccgucgagggcaagagcugcaucaaccgcugcuucuacguggagcugauccgggggcgcaagcaggagaccgaggugcucuggaccucgaacuccaucgucguguucugcggcaccagcgggaccuacggcacgggguccuggccggacggcgccgacaucaaccugaugcggaucuga

SEQ ID NO: 16606 - RNA, 1410 nt, Artificial Sequence
  derived and/or modified CDS sequence (AUadapt) from InfluenzaA__AAX57947__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccucgugccacgacggcaaggcguggcugcacgucugcgugaccggggacgacgagaacgccaccgccuccuucaucuacaacggccggcugguggacagcaucggguccuggucgcgcaagauccuccggacccaggaguccgagugcgucugcaucaacggcacgugcaccguggugaugaccgacggcagcgccuccgggaaggcggacaccaagauccuguucaucgaggagggcaagaucguccacaucucgacgcugagcggguccgcccagcacguggaggagugcucgugcuacccccgcuaccccggcgugcggugcgucugccgcgacaacuggaagggcuccaaccggccgaucguggacaucaacgugaaggacuacucgaucgccuccagcuacaugugcuccgggcucgucggcgacacgccccgcaagaacgacucguucuccagcucccacugccuggaccccaacaacgaggagggcgggcacggggugaagggcugggccuucgacgacggcaacgacguguggauggggcggaccaucucggagaagcugcgcuccggcuacgagaccuucaaggucaucgagggguggucgaagcccaacuccaagcuccagaucaaccgccaggugaucgucgagcggggcaaccggagcggguacuccggcaucuucucgguggagggcaaguccugcaucaaccgcugcuucuacguggagcugauccgggggcgcaaggaggagaccgaggucugguggaccagcaacucgaucgugguguucugcggcaccuccgggaccuacggcacggggagcuggccggacggcgccgacaucaaccugaugcccaucuga

SEQ ID NO: 16607 - RNA, 1410 nt, Artificial Sequence; identical to SEQ ID NO: 16547
  derived and/or modified CDS sequence (AUadapt) from InfluenzaA__AAX76626__NA

SEQ ID NO: 16608 - RNA, 1410 nt, Artificial Sequence
  derived and/or modified CDS sequence (AUadapt) from InfluenzaA__AAX76646__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacucgaacaacaccguccacgaccgcaccccguaccggacccuccugaugaacgagcugggcgugcccuuccaccucgggacgcgccaggugugcaucgccugguccagcuccggcugccacgacgggaaggcguggcugcacgucugcgugaccggcgacgacaagaacgccaccgccucguucaucuacaacgggcggcugguggacuccaucggcagcugguccaagaagauccuccgcacccaggagucggagugcgucugcaucaacggcacgugcaccguggugaugaccgacggguccgccucgggcaaggcggacaccaagauccuguucaucgaggaggggaagaucguccacaucuccacgcugagcggcucggcccagcacguggaggagugcuccugcuacccccgguaccccggcgugcgcugcgucugccgggacaacuggaaggggagcaaccgcccgaucguggacaucaacgugaaggacuacuccaucgucucguccuacgugugcucgggccucgugggggacacgccccggaagaacgacuccuucagcuccucgcacugccuggaccccaacaacgaggagggcgggcacggcgucaagggcugggccuucgacgacgggaacgacguguggaugggccgcaccaucuccgagaagcugcggagcggguacgagaccuucaaggucaucgagggcugguccaagcccaacucgaagcuccagaucaaccgccaggugaucguggagcgggggaaccgcuccggcuacucgggcaucuucuccgucgagggcaagagcugcaucaaccggugcuucuacguggagcugauccgcgggcggaaggaggagaccgaggugugguggaccuccaacucgaucgucguguucugcgggaccagcggcaccuacgggacgggcuccuggccggacggcgccgacaucaaccugaugcccaucuga

SEQ ID NO: 16609 - RNA, 1410 nt, Artificial Sequence; identical to SEQ ID NO: 16537
  derived and/or modified CDS sequence (AUadapt) from InfluenzaA__AAX76656__NA

SEQ ID NO: 16610 - RNA, 1410 nt, Artificial Sequence; identical to SEQ ID NO: 16582
  derived and/or modified CDS sequence (AUadapt) from InfluenzaA__AAX76666__NA

SEQ ID NO: 16611 - RNA, 1410 nt, Artificial Sequence; identical to SEQ ID NO: 16463
  derived and/or modified CDS sequence (AUadapt) from InfluenzaA__AAX76696__NA

SEQ ID NO: 16612 - RNA, 1410 nt, Artificial Sequence
  derived and/or modified CDS sequence (AUadapt) from InfluenzaA__AAX76736__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuguccgaguaccggaacuggagcaagccgcagugcaacaucaccggguucgcgcccuucuccaaggacaacucgauccgccucuccgccggcggggacaucugggugacccgggagcccuacgugagcugcgaccccgacaagugcuaccaguucgcccugggccaggggaccacgcugaacaacggccacuccaacgacaccguccacgaccgcaccccguaccggacccuccugaugaacgagcugggcgugcccuuccaccucgggacgaagcaggucugcaucgccuggucguccagcuccugccacgacggcaaggccuggcugcacgugugcgugaccggggacgacgagaacgcgaccgccucguucaucuacaacggccgccugguggacuccaucgggagcugguccaagaagauccuccggacccaggagucggagugcgucugcaucaacggcacgugcaccguggugaugaccgacggcuccgccagcgggaaggccgacaccaagauccuguucaucgaggagggcaagaucguccacaucucgacgcugucccgcucggcgcagcacguggaggagugcuccugcuacccccgguaccccggggugcgcugcgucugccgggacaacuggaagggcagcaaccgcccgaucguggacaucaacgugaaggaccacuccaucgucucguccuacgugugcagcggccucgugggggacacgccccggaagaacgacuccuucucguccagccacugccuggaccccaacaacgaggagggcgggcacggcgucaaggggugggccuucgacgacggcaacgacguguggaugggccgcaccaucuccgagaagcugcggucgggguacgagaccuucaaggucaucgagggcugguccaagcccaacagcaagcuccagaucaaccgccaggugaucguggagcgggggaaccgcuccggcuacucggggaucuucuccgucgagggcaagagcugcaucaaccggugcuucuacguggagcugauccgcggccggaaggaggagaccgaggugugguggaccucgaacuccaucgucguguucugcgggaccagcggcaccuacgggacgggcuccuggccggacggggccgacaucaaccugaugcccaucuga

SEQ ID NO: 16613 - RNA, 1410 nt, Artificial Sequence
  derived and/or modified CDS sequence (AUadapt) from InfluenzaA__AAX76766__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggugggcggggacaucugggugacccgggagcccuacgucuccugcgaccccgacaagugcuaccaguucgcccugggccaggggaccacgcugaacaacggccacagcaacgacaccgugcacgaccgcaccccguaccggacccuccugaugaacgagcugggcgugcccuuccaccucgggacgcgccaggucugcaucgccugguccucguccagcugccacgacggcaaggccuggcugcacgugugcgugaccggggacgacaagaacgcgaccgccuccuucaucuacaacggccggcuggucgacucgaucggguccuggagcaagaagauccuccgcacccaggaguccgagugcgugugcaucaacggcacgugcaccguggucaugaccgacggcucggccuccgggaaggccgacaccaagauccuguucaucgaggagggcaagaucgugcacaucagcacgcugucgggguccgcgcagcacguggaggagugcucgugcuacccccgguaccccggcguccgcugcgugugccgggacaacuggaagggcuccaaccgcccgaucguggacaucaacgucaaggacuacagcaucguguccucguacgugugcuccgggcucgucggcgacacgccccggaagaacgacagcuucuccucgucccacugccuggaccccaacaacgaggagggcgggcacggggugaagggcugggccuucgacgacggcaacgacgucuggauggggcgcaccaucagcgagaagcugcgguccggcuacgagaccuucaaggugaucgagggguggucgaagcccaacuccaagcuccagaucaaccgccaggugaucgucgagcggggcaaccgcagcggguacuccggcaucuucucgguggagggcaaguccugcaucaaccggugcuucuacguggagcugauccgcgggcggaaggaggagaccgaggucugguggaccagcaacucgaucgugguguucugcggcaccuccgggaccuacggcacggggagcuggccggacggcgccgacaucaaccugaugcccaucuga

SEQ ID NO: 16614 - RNA, 1410 nt, Artificial Sequence; identical to SEQ ID NO: 16539
  derived and/or modified CDS sequence (AUadapt) from InfluenzaA__AAY18089__NA

SEQ ID NO: 16615 - RNA, 1410 nt, Artificial Sequence
  derived and/or modified CDS sequence (AUadapt) from InfluenzaA__AAY18099__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacaacaccguccacgaccgcaccccguaccggacccuccugaugaacgagcugggcgugcccuuccaccucgggacgcgccaggugugcaucgccugguccucguccucgugccacgacggcaaggcguggcugcacgucugcgugaccggggacgacaagaacgccaccgccuccuucaucuacaacggccggcugguggacagcaucggguccuggucgaagaagauccuccgcacccaggaguccgagugcgucugcaucaacggcacgugcaccguggugaugaccgacggcagcgccuccgggaaggcggacaccaagauccuguucgucgaggagggcaagaucgugcacaucucgacgcugagcggguccgcccagcacguggaggagugcucgugcuacccccgguaccccggcguccgcugcgugugccgggacaacuggaagggcuccaaccgcccgaucguggacaucaacgucaaggacuacucgaucguguccagcuacgugugcuccgggcucgucggcgacacgccccggaagaacgacucguucuccagcucccacugccuggaccccaacaacgaggagggcgggcacggggugaagggcugggccuucgacgacggcaacgacgucuggauggggcgcaccaucucggagaagcugcgguccggcuacgagaccuucaaggugaucgagggguggucgaagcccaacuccaagcuccagaucaaccgccaggugaucgucgagcggggcaaccgcagcggguacuccggcaucuucucgguggagggcaaguccugcaucaaccggugcuucuacguggagcugauccgcgggcggaaggaggagaccgaggucugguggaccagcaacucgaucgugguguucugcggcaccuccgggaccuacggcacggggagcuggccggacggcgccgacaucaaccugaugcccaucuga

SEQ ID NO: 16616 - RNA, 1410 nt, Artificial Sequence
  derived and/or modified CDS sequence (AUadapt) from InfluenzaA__AAY18109__NA
augaaccccaaccagaagaucaucaccaucggcucggugucccugaccaucgccacgaucugcuuccucaugcagaucgccauccuggucaccacccugacccuccacuucaagcaguacgagugcaacucgccgcccaacaaccaggugaugcugugcgagcccgcgaucaucgagcgcaacaucacggagaucguguaccugaccaacaccaccaucgagaaggagaagugccccaagcucgccgaguaccggaacugguccaagccgcagugcaacaucacgggguucgcccccuucagcaaggacaacuccauccgccugucggccggcggggacaucugggucacccgggagcccuacguguccugcgaccccgacaagugcuaccaguucgcccugggccaggggaccacccucaacaacggccacagcaacgacacggugcacgaccgcaccccguaccggacccugcugaugaacgagcucggcguccccuuccaccuggggacccgccaggugugcaucgcgugguccucguccucgugccacgacggcaaggccuggcugcacgugugcgucacgggggacgacgagaacgccaccgccuccuucaucuacaacggccggcucguggacagcaucggguccuggucgaagaagauccugcgcacccaggaguccgagugcgugugcaucaacgggaccugcacggucgugaugaccgacggcagcgcguccgggaaggccgacaccaagauccuguucaucgaggagggcaagaucgugaacaucucgacccucagcggguccgcccagcacgucgaggagugcucgugcuacccccgguaccccggcgugcgcugcgugugccgggacaacuggaagggcuccaaccgcccgaucgucgacaucaacgugaaggacuacucgaucguguccagcuacgucugcuccgggcuggugggcgacacgccccggaagaacgacucguucuccagcucccacugccuggaccccaacaacgaggagggcggccacggggugaagggcugggccuucgacgacggcaacgacgucuggauggggcgcaccaucucggagaagcuccgguccggcuacgagaccuucaaggugaucgagggguggucgaagcccaacuccaagcugcagaucaaccgccaggucaucguggagcggggcaaccgcagcggguacuccggcaucuucucgguggagggcaaguccugcaucaaccggugcuucuacgucgagcugauccgcgggcggaaggaggagaccgaggugugguggacgagcaacucgaucguggucuucugcggcaccuccgggaccuacggcaccgggagcuggccggacggcgccgacaucaaccucaugcccaucuga

SEQ ID NO: 16617 - RNA, 1410 nt, Artificial Sequence; identical to SEQ ID NO: 16575
  derived and/or modified CDS sequence (AUadapt) from InfluenzaA__AAY18119__NA

SEQ ID NO: 16618 - RNA, 1410 nt, Artificial Sequence
  derived and/or modified CDS sequence (AUadapt) from InfluenzaA__AAY18129__NA
augaaccccaaccagaagaucaucaccaucggcucggugucccugaccaucgccacgaucugcuuccucaugcagaucaccauccuggucaccaccgugacgcugcacuucaagcaguacgagugcaacucgccgcccaacaaccaggugaugcucugcgagcccaccaucaucgagcgcaacaucaccgagaucgucuaccugaccaacacgaccaucgagaaggagaucugccccaagcuggccgaguaccggaacugguccaagccgcagugcaacaucaccggguucgcgcccuucagcaaggacaacuccauccgccucucggccggcggggacaucugggugacccgggagcccuacguguccugcgaccccgacaagugcuaccaguucgcccugggccaggggacgacccugaacaacggccacagcaacgacaccguccacgaccgcaccccguaccggacgcuccugaugaacgagcugggcgugcccuuccaccucgggacccgccaggugugcaucgccugguccucguccagcugccacgacggcaaggccuggcugcacgucugcgugaccggggacgacaagaacgcgaccgccuccuucaucuacaacggccggcugguggacucgaucggguccuggucgaagaagauccuccgcacgcaggaguccgagugcgucugcaucaacgggaccugcaccguggugaugaccgacggcagcgccuccgggaaggccgacacgaagauccuguucaucgaggagggcaagaucauccacaucucgacccugagcggguccgcgcagcacgucgaggagugcucgugcuacccccgguaccccggcgugcgcugcgugugccgggacaacuggaagggcuccaaccgcccgaucgucgacaucaacgugaaggacuacagcaucguguccucguacgucugcuccgggcucgugggcgacacgccccggaagaacgacagcuccucguccucgcacugccuggaccccaacaacgaggagggcggccacggggugaagggcugggccuucgacgacggcaacgacgucuggauggggcgcaccaucuccgagaagcugcggagcggcuacgagaccuucaaggugaucgaggggugguccaagucgaacuccaagcuccagaucaaccgccaggucaucguggagcggggcaaccgcagcggguacuccggcaucuucucgguggagggcaagagcugcaucaaccggugcuucuacgucgagcugauccgcgggcggaaggaggagaccgaggugugguggaccuccaacucgaucguggucuucugcggcaccuccgggacguacggcaccgggagcuggcccgacggcgccgacaucaaccugaugccgaucuga

SEQ ID NO: 16619 - RNA, 1410 nt, Artificial Sequence
  derived and/or modified CDS sequence (AUadapt) from InfluenzaA__AAY18139__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucgagcgcaacaucaccgagaucgucuaccugaccaacaccacgaucgagcgggagaucugccccaagcuggcggaguaccgcaacugguccaagccgcagugcaacaucaccggguucgcccccuucagcaaggacaacuccauccggcucucggccggcggggacaucugggugacccgcgagcccuacguguccugcgaccccgacaagugcuaccaguucgcccugggccaggggaccacgcugaacaaccggcacucgaacgacaccguccacgaccgcaccccguaccggacccuccugaugaacgagcugggcgugcccuuccaccucggcacgcgccaggugugcaucgccugguccagcuccucgugccacgacgggaaggcguggcugcacgucugcgugaccggcgacgacaagaacgccaccgccuccuucaucuacaacgggcggcugguggacagcaucggcuccuggucgaagaagauccuccgcacccaggaguccgagugcgucugcaucaacgggacgugcaccguggugaugaccgacggcucggccuccggcaaggcggacaccaagauccuguucaucgaggaggggaagaucguccacaucagcacgcugucgggcuccgcccagcacguggaggagugcucgugcuacccccgguaccccggggugcgcugcgucugccgggacaacuggaagggcuccaaccgcccgaucguggacaucaacgugaaggacuacagcaucgucuccucguacgugugcuccggccucgugggggacacgccccggaagaacgacagcuccucguccucgcacugccuggaccccaacaacgaggagggcgggcacggcgucaaggggugggccuucgacgacggcaacgacguguggaugggccgcaccaucuccgagaagcugcggagcggguacgagaccuucaaggucaucgagggcugguccaagcccaacucgaagcuccagaucaaccgccaggugaucguggagcgggggaaccgcuccggcuacucggggaucuucuccgucgagggcaagagcugcaucaaccggugcuucuacguggagcugauccgcggccgcaaggaggagaccgaggugugguggaccucgaacuccaucgucguguucugcgggaccagcggcaccuacgggacgggcuccuggccggacggggccgacaucaaccugaugcccaucuga

SEQ ID NO: 16620 - RNA, 1410 nt, Artificial Sequence
  derived and/or modified CDS sequence (AUadapt) from InfluenzaA__AAY18149__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacucgaacgacaccguccacgaccgcaccccguaccggacccuccugaugaacgagcugggcgugcccuuccaccucgggacgcgccaggugugcaucgccugguccagcuccucgugccacgacggcaaggcguggcugcacgucugcgugaccggggacgacaagaacgccaccgccuccuucaucuacaacggccggcugguggacucgaucggguccuggagcaagaagauccuccgcacccaggaguccgagugcgucugcaucaacggcacgugcaccguggugaugaccgacggcucggccuccgggaaggcggacaccaagauccuguucaucgaggagggcaagaucguccacaucucgacgcugagcggguccgcccagcacguggaggagugcucgugcuacccccgguaccccggcgugcgcugcgucugccgggacaacuggaagggcuccaaccgcccgaccguggacaucaacgugaaggacuacucgaucgucuccagcuacgugugcuccgggcucgugggcgacacgccccggaagaacgacucguccucguccagccacugccuggaccccaacaacgaggagggcgggcacggggucaagggcugggccuucgacgacggcaacgacguguggauggggcgcaccaucuccgagaagcugcggucgggcuacgagaccuucaaggucaucgaggggugguccaagcccaacucgaagcuccagaucaaccgccaggugaucguggagcggggcaaccgcuccggguacagcggcaucuucuccgucgagggcaagucgugcaucaaccggugcuucuacguggagcugauccgcgggcggaaggaggagaccgaggugugguggaccucgaacuccaucgucguguucugcggcaccagcgggacguacggcaccggguccuggccggacggcgccgacaucaaccugaugcccaucuga

SEQ ID NO: 16621 - RNA, 1410 nt, Artificial Sequence
  derived and/or modified CDS sequence (AUadapt) from InfluenzaA__AAY18159__NA
augaaccccaaccagaagaucaucaccaucggcucggugucccugaucaucgccaccaucugcuuccucaugcagaucgccauccuggucacgaccgugacccugcacuucaagcaguacgagugcaacucgccgcccaacaaccaggugaugcucugcgagcccaccaucaucgagcgcaacaucacggagaucgucuaccugaccaacaccaccaucgagaaggagaucugccccaagcuggcggaguaccggaacugguccaagccgcagugcaacaucacgggguucgcccccuucagcaaggacaacuccauccgccucucggccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggaccaagcaggucugcaucgccugguccucguccucgugccacgacggcaaggcguggcugcacgugugcgugacgggggacgacgagaacgccaccgccuccuucaucuacaacggccgccugguggacagcaucggguccuggucgaagaagauccuccggacccaggaguccgagugcgucugcaucaacgggaccugcacgguggugaugaccgacggcagcgccuccgggaaggcggacaccaagauccuguucaucgaggagggcaagaucguccacaccucgagccuguccgggucggcccagcacguggaggagugcuccugcuacccccgcuaccccggcgugcggugcgucugccgcgacaacuggaagggcucgaaccggccgaucguggacaucaacgugaaggacuacuccaucgucagcuccuacgugugcucggggcucgugggcgacacgccccgcaagaacgacuccagcuccucgucccacugccuggaccccaacaacgaggagggcggccacggggucaagggcugggccuucgacgacggcaacgacguguggauggggcggaccaucucggagaagcugcgcuccggcuacgagaccuucaaggucaucgagggguggagcaagcccaacuccaagcuccagaucaaccgccaggugaucguggaccggggcaaccggucgggguacuccggcaucuucagcgucgagggcaagaacugcaucaaccgcugcuucuacguggagcugauccgggggcgcaagcaggagaccgaggugcuguggacgucgaacuccaucgucguguucugcggcaccagcgggaccuacggcaccggguccuggccggacggcgccgacaucaaccucaugcccaucuga

SEQ ID NO: 16622 - RNA, 1410 nt, Artificial Sequence; identical to SEQ ID NO: 16463
  derived and/or modified CDS sequence (AUadapt) from InfluenzaA__AAY18179__NA

SEQ ID NO: 16623 - RNA, 1410 nt, Artificial Sequence; identical to SEQ ID NO: 16463
  derived and/or modified CDS sequence (AUadapt) from InfluenzaA__AAY18189__NA

SEQ ID NO: 16624 - RNA, 1410 nt, Artificial Sequence
  derived and/or modified CDS sequence (AUadapt) from InfluenzaA__AAY18199__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacgagaacgcgaccgccagcuucaucuacaacgggcgccugguggacuccaucgucagcugguccaagaagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcagggggucaagggcugggccuucgacgacgggaacgacguguggaugggccggaccaucucggagaagcugcacuccggcuacgagaccuucaaggucaucgagggguggagcaaccccaacuccaagcugcagaucaaccgccaggugaucguggaccggggcaaccgcucgggguacuccggcaucuucagcgucgagggcaagucgugcaucaaccggugcuucuacguggagcucauccgcgggcggaagcaggagaccgaggugcuguggaccuccaacagcaucgucguguucugcggcaccuccgggacguacggcaccgggagcuggccggacggcgccgacaucaaccugaugcccaucuga

SEQ ID NO: 16625 - RNA, 1410 nt, Artificial Sequence; identical to SEQ ID NO: 16566
  derived and/or modified CDS sequence (AUadapt) from InfluenzaA__AAY18588__NA

SEQ ID NO: 16626 - RNA, 1410 nt, Artificial Sequence; identical to SEQ ID NO: 16547
  derived and/or modified CDS sequence (AUadapt) from InfluenzaA__AAY18614__NA

SEQ ID NO: 16627 - RNA, 1410 nt, Artificial Sequence
  derived and/or modified CDS sequence (AUadapt) from InfluenzaA__AAY27846__NA
augaaccccaaccagaagaucaucaccaucggcucggugucccugaccaucgccgccaucugcuuccucaugcagaucgcgauccuggucacgaccgugacccugcacuucaagcagcacgagugcaacucgccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucucggccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccucguccucgugccacgacggcaaggccuggcugcacgucugcgugacgggggacgacaagaacgccaccgccuccuucaucuacaacggccggcugguggacagcaucggguccuggucgaagaagauccuccgcacccaggaguccgagugcgucugcaucaacgggaccugcacgguggugaugaccgacggcagcgcguccgggaaggccgacaccaagauccuguucaucgaggagggcaagaucguccacaucucgacccugagcggguccgcccagcacguggaggagugcucgugcuacccccgguaccccggcgugcgcugcgucugccgggacaacuggaagggcuccaaccgcccgaucguggacaucaacgugaaggacuacucgaucgucuccagcuacgugugcuccgggcucgugggcgacacgccccggaagaacgacucguucuccagcucccacugccuggaccccaacaacgaggagggcggccacggggucaagggcugggccuucgacgacggcaacgacguguggauggggcgcaccaucucggagaagcugcgguccggcuacgagaccuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaaggaggagaccgaggugugguggacgagcaacucgaucgucguguucugcggcaccuccgggaccuacggcaccgggagcuggccggacggcgccgacaucaaccugaugcccaucuga

SEQ ID NO: 16628 - RNA, 1410 nt, Artificial Sequence
  derived and/or modified CDS sequence (AUadapt) from InfluenzaA__AAY27856__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccggcaagugcuaccaguucgcccuggggcagggcaccacgcugaacaacggccacucgaacgacaccguccacgaccgcaccccguaccggacccuccugaugaacgagcugggggugcccuuccaccucggcacgcgccaggugugcaucgccugguccagcuccucgugccacgacgggaaggcguggcugcacgucugcgugaccggcgacgacaagaacgccaccgccuccuucaucuacaacgggcggcugguggacagcaucggcuccuggucgaagaagauccuccgcacccaggaguccgagugcgucugcaucaacggcacgugcaccguggugaugaccgacgggucggccuccggcaaggcggacaccaagauccuguucaucgaggaggggaagaucguccacaucagcacgcugucgggcuccgcccagcacguggaggagugcucgugcuacccccgguaccccggcgugcgcugcgucugccgggacaacuggaagggguccaaccgcccgaucguggacaucaacgugaaggacuacagcaucgucuccucguacgugugcuccggccucgugggggacacgccccggaagaacgacagcuccucguccucgcacugccuggaccccaacaacgaggagggcgggcacggcgucaagggcugggccuucgacgacgggaacgacguguggaugggccgcaccaucuccgagaagcugcggagcggguacgagaccuucaaggucaucgagggcugguccaagcccaacucgaagcuccagaucaaccgccaggugaucguggagcgggggaaccgcuccggcuacucgggcaucuucuccgucgagggcaagagcugcaucaaccggugcuucuacguggagcugauccgcgggcggaaggaggagaccgaggugugguggaccucgaacuccaucgucguguucugcgggaccagcggcaccuacgggacgggcuccuggccggacggcgccgacaucaaccugaugcccaucuga

SEQ ID NO: 16629 - RNA, 1410 nt, Artificial Sequence; identical to SEQ ID NO: 16539
  derived and/or modified CDS sequence (AUadapt) from InfluenzaA__AAY27866__NA

SEQ ID NO: 16630 - RNA, 1410 nt, Artificial Sequence
  derived and/or modified CDS sequence (AUadapt) from InfluenzaA__AAY27962__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccucgugccacgacggcaaggcguggcugcacgucugcgugaccggggacgacgagaacgccaccgccuccuucaucuacaacggccggcugguggacagcaucggguccuggucgaagaagauccuccgcacccaggaguccgagugcgucugcaucaacggcacgugcaccguggugaugaccgacggcagcgccuccgggaaggcggacaccaagauccuguucaucgaggagggcaagaucguccacaucucgacgcugagcggguccgcccagcacguggaggagugcucgugcuacccccgguaccccggcgugcgcugcgucugccgggacaacuggaagggcuccaaccgcccgaucguggacaucaacgugaaggacuacucgaucgucuccagcuacgugugcuccgggcucgugggcgacacgccccggaagaacgacucguucuccagcucccacugccuggaccccaacaacgaggagggcgggcacggggucaagggcugggccuucgacgacggcaacaacguguggauggggcgcaccaucucggagaagcugcgguccggcuacgagaccuucaaggucaucgagggguggucgaagcccaacuccaagcuccagaccaaccgccaggugaucguggagcggggcaaccgcagcggguacuccggcaucuucucggucgagggcaaguccugcaucaaccggugcuucuacguggagcugauccgcgggcggaaggaggagaccgaggugugguggaccagcaacucgaucgucguguucugcggcaccuccgggacguacggcaccgggagcuggccggacggcgccgacaucaaccugaugcccaucuga

SEQ ID NO: 16631 - RNA, 1410 nt, Artificial Sequence
  derived and/or modified CDS sequence (AUadapt) from InfluenzaA__AAY27997__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacaacaccguccacgaccgcaccccguaccggacccuccugaugaacgagaugggcgugcccuuccaccuggggacgcgccaggugugcaucgccugguccucguccucgugccacgacggcaaggcguggcuccacgucugcgugaccggggacgacaagaacgccaccgccuccuucaucuacaacggccggcugguggacagcaucggguccuggucgaagaagauccugcgcacccaggaguccgagugcgucugcaucaacggcacgugcaccguggugaugaccgacggcagcgccuccgggaaggcggacaccaagauccucuucaucgaggagggcaagaucguccacaucucgacgcugagcggguccgcccagcacguggaggagugcucgugcuacccccgguaccccggcgugcgcugcgucugccgggacaacuggaagggcuccaaccgcccgaucguggacaucaacgugaaggacuacucgaucgucuccagcuacgugugcuccgggcuggugggcgacacgccccggaagaacgacucguucuccagcucccacugccucgaccccaacaacgaggagggcgggcacggggucaagggcugggccuucgacgacggcaacgacguguggauggggcgcaccaucucggagaagcugcgguccggcuacgagaccuucaaggucaucgagggguggucgaagcccaacuccaagcugcagaucaaccgccaggugaucguggagcggggcaaccgcagcggguacuccggcaucuucucggucgagggcaaguccugcaucaaccggugcuucuacguggagcucauccgcgggcggaaggaggagaccgaggugugguggaccagcaacucgaucgucguguucugcggcaccuccgggaccuacggcacggggagcuggccggacggcgccgacaucaaccugaugcccaucuga

SEQ ID NO: 16632 - RNA, 1410 nt, Artificial Sequence; identical to SEQ ID NO: 16537
  derived and/or modified CDS sequence (AUadapt) from InfluenzaA__AAY28007__NA

SEQ ID NO: 16633 - RNA, 1410 nt, Artificial Sequence; identical to SEQ ID NO: 16582
  derived and/or modified CDS sequence (AUadapt) from InfluenzaA__AAY28017__NA

SEQ ID NO: 16634 - RNA, 1410 nt, Artificial Sequence; identical to SEQ ID NO: 16537
  derived and/or modified CDS sequence (AUadapt) from InfluenzaA__AAY28268__NA

SEQ ID NO: 16635 - RNA, 1410 nt, Artificial Sequence
  derived and/or modified CDS sequence (AUadapt) from InfluenzaA__AAY28278__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccgacaagugcuaccaguucgcccugggccaggggaccacgcugaacaaccgccacucgaacgacaccguccacgaccggaccccguaccgcacccuccugaugaacgagcugggcgugcccuuccaccucggcacgaagcaggucugcaucgccugguccagcuccucgugccacgacgggaaggcguggcugcacgugugcgugaccggccacgacgagaacgccaccgccuccuucaucuacgacgggcggcugguggacucgaucggcuccuggagcaagaagauccuccgcacccaggaguccgagugcgucugcaucaacgggacgugcaccguggugaugaccgacggcucggccuccggccgggcggacaccaagauccuguucaucgaggaggggaagaucguccacacgucgaagcugagcggcuccgcccagcacguggaggagugcucgugcuacccccgcuaccccggggugcggugcgucugccgcgacaacuggaagggcuccaaccggccgaucguggacaucaacgugaaggacuacagcaucgucuccucguacgugugcuccggccucgugggggacacgccccgcaagaacgacucguccagcuccucgcacugccuggaccccaacaacgaggagggcgggcacggcgucaaggggugggccuucgacgacggcaacgacguguggaugggccggaccaucuccgagaagucccgcucgggguacgagaccuucaaggucaucgagggcuggagcaagcccaacuccaagcugcagaucaaccgccaggugaucguggagcgggggaaccggucgggcuacuccgggaucuucucggucgagggcaagagcugcaucaaccgcugcuucuacguggagcucauccggggccgcaagccggagaccgaggugugguggaccuccaacucgaucgucguguucugcgggaccuccggcaccuacgggacgggcagcuggcccgacggggccgacaucaaccugaugcccaucuga

SEQ ID NO: 16636 - RNA, 1410 nt, Artificial Sequence; identical to SEQ ID NO: 16551
  derived and/or modified CDS sequence (AUadapt) from InfluenzaA__AAY28288__NA

SEQ ID NO: 16637 - RNA, 1410 nt, Artificial Sequence
  derived and/or modified CDS sequence (AUadapt) from InfluenzaA__AAY28298__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacucgaacgacaccguccacgaccgcaccccguaccggacccuccugaugaacgagcugggcgugcccuuccaccucgggacgcgccaggugugcaucgccugguccagcuccucgugccacgacggcaaggcguggcugcacgucugcgugaccggggacgacaagaacgccaccgccuccuucaucuacaacggccggcugguggacagcaucggguccuggucgaagaagauccuccgcacccaggaguccgagugcgucugcaucaacggcacgugcaccguggugaugaccgacggcucggccuccgggaaggcggacaccaagauccuguucaucgaggagggcaagaucguccacaucagcacgcugucgggguccgcccagcacguggaggagugcucgugcuacccccgguaccccggcgugcgcugcgucugccgggacaacuggaagggcuccaaccgcccgaucguggacaucaacgugaaggacuacagcaucgucuccucguacgugugcuccgggcucgugggcgacacgccccggaagaacgacagcuccucguccucgcacugccuggaccccaacaacgaggagggcgggcacggggucaagggcugggccuucgacgacggcaacgacguguggauggggcgcaccaucuccgagaagcugcggagcggcuacgagaccuucaaggucaucgagggguggucccgccccaacucgaagcuccagaucaaccgccaggugaucguggagcggggcaaccgguccggguacucgggcaucuucuccgucgagggcaagagcugcaucaaccgcugcuucuacguggagcugauccgggggcgcaaggaggagaccgaggugugguggaccucgaacuccaucgucguguucugcggcaccagcgggaccuacggcacgggguccuggccggacggcgccgacaucaaccugaugcccaucuga

SEQ ID NO: 16638 - RNA, 1410 nt, Artificial Sequence; identical to SEQ ID NO: 16568
  derived and/or modified CDS sequence (AUadapt) from InfluenzaA__AAY28308__NA

SEQ ID NO: 16639 - RNA, 1410 nt, Artificial Sequence
  derived and/or modified CDS sequence (AUadapt) from InfluenzaA__AAY28318__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccucgugccacgacggcaaggcguggcugcacgucugcgugaccggggacgacgagaacgccaccgccuccuucaucuacaacggccggcugguggacagcaucggguccuggucgaagaagauccuccgcacccaggaguccgagugcgucugcaucaacggcacgugcgccguggugaugaccgacggcagcgcguccgggaaggccgacaccaagauccuguucaucgaggagggcaagaucguccacaucucgacccugagcggguccgcccagcacguggaggagugcucgugcuacccccgguaccccggcgugcgcugcgucugccgggacaacuggaagggcuccaaccgcccgaucguggacaucaacgugaaggacuacucgaucgucuccagcuacgugugcuccgggcucgugggcgacacgccccggaagaacgacucguucuccagcucccacugccuggaccccaacaacgaggagggcgggcacggggucaagggcugggccuucgacgacggcaacgacguguggauggggcgcaccaucucggagaagcugcgguccggcuacgagaccuucaaggucaucgagggguggucgaagcccaacuccaagcuccagaccaaccgccaggugaucguggagcggggcaaccgcagcggguacuccggcaucuucucggucgagggcaaguccugcaucaaccggugcuucuacguggagcugauccgcgggcggaaggaggagacggaggugugguggaccagcaacucgaucgucguguucugcggcaccuccgggaccuacggcacggggagcuggccggacggcgccgacaucaaccugaugcccaucuga

SEQ ID NO: 16640 - RNA, 1410 nt, Artificial Sequence
  derived and/or modified CDS sequence (AUadapt) from InfluenzaA__AAY28338__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccgcgaucaucgagcgcaacaucacggagaucgucuaccugaccaacaccaccaucgagaaggagauccggcccaagcuggccgaguaccgcaacugguccaagccgcagugcaacaucacgggguucgcccccuucagcaaggacaacuccauccggcucucggccggcggggacaucugggugacccgcgagcccuacguguccugcgaccccgacaagugcuaccaguucgcccugggccaggggaccacccugaacaacggccacagcaacgacacgguccacgaccggaccccguaccgcacccuccugaugaacgagcugggcgugcccuuccaccucgggacccgccaggugugcaucgcgugguccucguccucgugccacgacggcaaggccuggcugcacgucugcgugacgggggacgacgagaacgccaccgccuccuucaucuacaacggccggcugguggacagcaucggguccuggucgaagaagauccuccggacccaggaguccgagugcgucugcaucaacgggaccugcacgguggugaugaccgacggcagcgcguccgggaaggccgacaccaagauccuguucaucgaggagggcaagaucgucaacaucucgacccugagcggguccgcccagcacguggaggagugcucgugcuacccccgcuaccccggcgugcggugcgucugccgcgacaacuggaagggcuccaaccggccgaucguggacaucaacgugaaggacuacucgaucgucuccagcuacgugugcuccgggcucgugggcgacacgccccgcaagaacgacucguucuccagcucccacugccuggaccccaacaacgaggagggcggccacggggucaagggcugggccuucgacgacggcaacgacguguggauggggcggaccaucucggagaagcugcgcuccggcuacgagaccuucaaggucaucgagggguggucgaagcccaacuccaagcuccagaucaaccgccaggugaucguggagcggggcaaccggagcggguacuccggcaucuucucggucgagggcaaguccugcaucaaccgcugcuucuacguggagcugauccgggggcgcaaggaggagaccgaggugugguggacgagcaacucgaucgucguguucugcggcaccuccgggaccuacggcaccgggagcuggccggacggcgccgacaucaaccugaugcccaucuga

SEQ ID NO: 16641 - RNA, 1410 nt, Artificial Sequence; identical to SEQ ID NO: 16547
  derived and/or modified CDS sequence (AUadapt) from InfluenzaA__AAY28348__NA

SEQ ID NO: 16642 - RNA, 1410 nt, Artificial Sequence; identical to SEQ ID NO: 16463
  derived and/or modified CDS sequence (AUadapt) from InfluenzaA__AAY28358__NA

SEQ ID NO: 16643 - RNA, 1410 nt, Artificial Sequence; identical to SEQ ID NO: 16547
  derived and/or modified CDS sequence (AUadapt) from InfluenzaA__AAY28388__NA

SEQ ID NO: 16644 - RNA, 1410 nt, Artificial Sequence; identical to SEQ ID NO: 16552
  derived and/or modified CDS sequence (AUadapt) from InfluenzaA__AAY28398__NA

SEQ ID NO: 16645 - RNA, 1410 nt, Artificial Sequence; identical to SEQ ID NO: 16566
  derived and/or modified CDS sequence (AUadapt) from InfluenzaA__AAY28408__NA

SEQ ID NO: 16646 - RNA, 1410 nt, Artificial Sequence; identical to SEQ ID NO: 16539
  derived and/or modified CDS sequence (AUadapt) from InfluenzaA__AAY28505__NA

SEQ ID NO: 16647 - RNA, 1410 nt, Artificial Sequence
  derived and/or modified CDS sequence (AUadapt) from InfluenzaA__AAY28524__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacuacaccguccacgaccgcaccccguaccggacccuccugaugaacgagcugggcgugcccuuccaccucgggacgcgccaggugugcaucgccugguccucguccucgugccacgacggcaaggcguggcugcacgucugcgugaccggggacgacaagaacgccaccgccuccuucaucuacaacggccggcugguggacagcaucggguccuggucgaagaagauccuccgcacccaggaguccgagugcgucugcaucaacggcacgugcaccguggugaugaccgacggcagcgccuccgggaaggcggacaccaagauccuguucaucgaggagggcaagaucguccacaucucgacgcugagcggguccgcccagcacguggaggagugcucgugcuacccccgguaccccggcgugcgcugcgucugccgggacaacuggaagggcuccaaccgcccgaucguggacaucaacgugaaggacuacucgaucgucuccagcuacgugugcuccgggcucgugggcgacacgccccggaagaacgacucguccagcuccucgcacugccuggaccccaacaacgaggagggcgggcacggggucaagggcugggccuucgacgacggcaacgacguguggauggggcgcaccaucuccgagaagcugcggucgggcuacgagaccuucaaggucaucgaggggugguccaagcccaacagcaagcuccagaucaaccgccaggugaucguggagcggggcaaccgcuccggguacucgggcaucuucuccgucgagggcaagagcugcaucaaccggugcuucuacguggagcugauccgcgggcggaaggaggagaccgaggugugguggaccucgaacuccaucgucguguucugcggcaccagcgggaccuacggcacgggguccuggccggacggcgccgacaucaaccugaugcccaucuga

SEQ ID NO: 16648 - RNA, 1410 nt, Artificial Sequence; identical to SEQ ID NO: 16537
  derived and/or modified CDS sequence (AUadapt) from InfluenzaA__AAY28534__NA

SEQ ID NO: 16649 - RNA, 1410 nt, Artificial Sequence
  derived and/or modified CDS sequence (AUadapt) from InfluenzaA__AAY28544__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccaacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccucgugccacgacggcaaggcguggcugcacgucugcgugaccggggacgacaagaacgccaccgccuccuucaucuacaacggccggcugguggacagcaucggguccuggucgaagaagauccuccgcacccaggaguccgagugcgucugcaucaacggcacgugcaccguggugaugaccgacggcagcgccuccgggaaggcggacaccaagauccuguucaucgaggagggcaagaucguccacaucucgacgcugagcggguccgcccagcacguggaggagugcucgugcuacccccgguaccccggcgugcgcugcgucugccgggacaacuggaagggcuccaaccgcccgaucguggacaucaacgugaaggacuacucgaucgucuccagcuacgugugcuccgggcucgugggcgacacgccccggaagaacgacucguucuccagcucccacugccuggaccccaacaacgaggagggcgggcacggggucaagggcugggccuucgacgacggcaacgacguguggauggggcgcaccaucucggagaagcugcgguccggcuacgagaccuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaaggaggagaccgaggugugguggaccagcaacucgaucgucguguucugcggcaccuccgggaccuacggcacggggagcuggccggacggcgccgacaucaaccugaugcccaucuga

SEQ ID NO: 16650 - RNA, 1410 nt, Artificial Sequence; identical to SEQ ID NO: 16463
  derived and/or modified CDS sequence (AUadapt) from InfluenzaA__AAY28554__NA

SEQ ID NO: 16651 - RNA, 1410 nt, Artificial Sequence
  derived and/or modified CDS sequence (AUadapt) from InfluenzaA__AAY28564__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccucgugccacgacggcaaggcguggcugcacgucugcgugaccggggacgacaagaacgccaccgccuccuucaucuacaacggccggcugguggacagcaucggguccuggucgaagaagauccuccgcacccaggaguccgagugcgucugcaucaacggcacgugcaccguggugaugaccgacggcagcgccuccgggaaggcggacaccaagauccuguucaucgaggagggcaagaucguccacaucucgacgcugucgggguccgcccagcacguggaggagugcagcugcuacccccgguaccccggcgugcgcugcgucugccgggacaacuggaagggcuccaaccgcccgaucguggacaucaacgugaaggacuacucgaucgucuccagcuacgugugcuccgggcucgugggcgacacgccccggaagaacgacucguccucguccagccacugccuggaccccaacaacgaggagggcgggcacggggucaagggcugggccuucgacgacggcaacgacguguggauggggcgcaccaucuccgagaagcugcggucgggcuacgagaccuucaaggucaucgagggguggucccgccccaacagcaagcuccagaucaaccgccaggugaucguggagcggggcaaccgguccggguacucgggcaucuucuccgucgagucgaagagcugcaucaaccgcugcuucuacguggagcugauccggggccgcaaggaggagaccgaggugugguggaccuccaacucgaucgucguguucugcgggaccuccggcaccuacgggacgggcagcuggccggacggggccgacaucaaccugaugcccaucuga

SEQ ID NO: 16652 - RNA, 1410 nt, Artificial Sequence; identical to SEQ ID NO: 16537
  derived and/or modified CDS sequence (AUadapt) from InfluenzaA__AAY28574__NA

SEQ ID NO: 16653 - RNA, 1410 nt, Artificial Sequence; identical to SEQ ID NO: 16551
  derived and/or modified CDS sequence (AUadapt) from InfluenzaA__AAY28584__NA

SEQ ID NO: 16654 - RNA, 1410 nt, Artificial Sequence; identical to SEQ ID NO: 16463
  derived and/or modified CDS sequence (AUadapt) from InfluenzaA__AAY28594__NA

SEQ ID NO: 16655 - RNA, 1410 nt, Artificial Sequence
  derived and/or modified CDS sequence (AUadapt) from InfluenzaA__AAY28611__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccucguccucgugccacgacggcaaggcguggcugcacgugugcgugaccggggacgacgagaacgccaccgccuccuucaucuacaacggccgccugguggacagcaucggguccuggucgaagaagauccuccggacccaggaguccgagugcgucugcaucaacggcacgugcaccguggugaugaccgacggcagcgccuccgggaaggcggacaccaagauccuguucaucgaggagggcaagaucguccacacgucgucgcuguccgggagcgcccagcacguggaggagugcuccugcuacccccgcuaccccggcgugcggugcgucugccgcgacaacuggaagggcucgaaccggccgaucguggacaucaacgugaaggacuacuccaucgucagcuccuacgugugcucggggcucgugggcgacacgccccgcaagaacgacuccucguccagcucccacugccuggaccccaacaacgaggagggcgggcacggggucaagggcugggccuucgacgacggcaacgacguguggauggggcggaccaucucggagaagcugcgcuccggcuacgagaccuucaaggucaucgagggguggagcaagcccaacuccaagcuccagaucaaccgccaggugaucguggaccggggcaaccggucgggguacuccggcaucuucucggucgagggcaagagcugcaucaaccgcugcuucuacguggagcugauccgggggcgcaagcaggagaccgaggugcuguggaccuccaacucgaucgucguguucugcggcaccuccgggaccuacggcacggggagcuggccggacggcgccgacaucaaccucaugcccaucuga

SEQ ID NO: 16656 - RNA, 1410 nt, Artificial Sequence; identical to SEQ ID NO: 16568
  derived and/or modified CDS sequence (AUadapt) from InfluenzaA__AAY28651__NA

SEQ ID NO: 16657 - RNA, 1410 nt, Artificial Sequence
  derived and/or modified CDS sequence (AUadapt) from InfluenzaA__AAY44613__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucgagcgcaacaucaccgagaucgucuaccugaccaacaccacgaucgagaaggagaucugccccaagaucgcggaguaccggaacugguccaagccgcagugcaacaucaccggguucgcccccuucagcaaggacaacuccauccgccugucggccggcggggacaucugggugacccgggagcccuacguguccugcgaccccgacaagugcuaccaguucgcccucggccaggggaccacgcugaacaacggccacucgaacgacaccguccacgaccgcaccccguaccggacccugcucaugaacgagcugggcgugcccuuccaccuggggacgcgccaggugugcaucgccugguccagcuccucgugccacgacggcaaggcguggcuccacgucugcgugaccggggacgacaagaacgccaccgccuccuucaucuacaacggccggcugguggacagcaucggguccuggucgaagaagauccugcgcacccaggaguccgagugcgucugcaucaacggcacgugcaccguggugaugaccgacggcucggccuccgggaaggcggacaccaagauccucuucaucgaggagggcaagaucguccacaucagcacgcugucgggguccgcccagcacguggaggagugcucgugcuacccccgguaccccggcgugcgcugcgucugccgggacaacuggaagggcuccaaccgcccgaucguggacaucaacgugaaggacuacagcaucgucuccucguacgugugcuccgggcuggugggcgacacgccccggaagaacgacagcuccucguccucgcacugccucgaccccaacaacgaggagggcgggcacggggucaagggcugggccuucgacgacggcaacgacguguggauggggcgcaccaucuccgagaagcugcggagcggcuacgagaccuucaaggucaucgaggggugguccaagcccaacucgaagcugcagaucaaccgccaggugaucguggagcggggcaaccgcuccggguacucgggcaucuucuccgucgagggcaagagcugcaucaaccggugcuucuacguggagcucauccgcgggcggaaggaggagaccgaggugugguggaccucgaacuccaucgucguguucugcggcaccagcgggaccuacggcacgggguccuggccggacggcgccgacaucaaccugaugcccaucuga

SEQ ID NO: 16658 - RNA, 1410 nt, Artificial Sequence; identical to SEQ ID NO: 16551
  derived and/or modified CDS sequence (AUadapt) from InfluenzaA__AAY44624__NA

SEQ ID NO: 16659 - RNA, 1410 nt, Artificial Sequence; identical to SEQ ID NO: 16573
  derived and/or modified CDS sequence (AUadapt) from InfluenzaA__AAY44634__NA

SEQ ID NO: 16660 - RNA, 1410 nt, Artificial Sequence; identical to SEQ ID NO: 16566
  derived and/or modified CDS sequence (AUadapt) from InfluenzaA__AAY44644__NA

SEQ ID NO: 16661 - RNA, 1410 nt, Artificial Sequence
  derived and/or modified CDS sequence (AUadapt) from InfluenzaA__AAY44654__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccucguccucgugccacgacggcaaggcguggcugcacgugugcgugaccggggacgacgagaacgccaccgccuccuucaucuacaacggccgccugguggacagcaucggguccuggucgaagaagauccuccggacccaggaguccgagugcgucugcaucaacggcacgugcaccguggugaugaccgacggcagcgccuccgggaaggcggacaccaagauccuguucaucgaggagggcaagaucguccacacgucgucgcuguccgggagcgcccagcacguggaggagugcuccugcuacccccgcuaccccggcgugcggugcgucugccgcgacaacuggaagggcucgaaccggccgaucguggacaucaacgugaaggacuacuccaucgucagcuccuacgugugcucggggcucgugggcgacacgccccgcaagaacgacuccucguccagcucccacugccuggaccccaacaacgaggagggcgggcacggggucaagggcugggccuucgacgacggcaacgacguguggauggggcggaccaucucggagaagcugcgcuccggcuacgagaccuucaaggucaucgagggguggagcaagcccaacuccaagcuccagauccaccgccaggugaucguggaccggggcaaccggucgggguacuccggcaucuucucggucgagggcaagagcugcaucaaccgcugcuucuacguggagcugauccgggggcgcaagcaggagaccgaggugcuguggaccuccaacucgaucgucguguucugcggcaccuccgggaccuacggcacggggagcuggccggacggcgccgacaucaaccucaugcccaucuga

SEQ ID NO: 16662 - RNA, 1410 nt, Artificial Sequence
  derived and/or modified CDS sequence (AUadapt) from InfluenzaA__AAY44758__NA
augaaccccaaccagaagaucaucaccaucggcucggugucccugaccaucgccacgaucugcuuccucaugcagaucgccauccuggucaccaccgugacccugcacuucaagcaguacgagugcaacucgccguccaacaaccaggugaugcucugcgagcccacgaucaucgagcgcaacaucaccgagaucgucuaccugaccaacaccacgaucgagaaggagaucugccccaagcuggcggaguaccggaacuggagcaagccccagugcaagaucaccggguucgccccguucuccaaggacaacucgauccgccucuccgccggcggggacaucugggugacccgggagcccuacgugagcugcgaccccgacaagugcuaccaguucgcccugggccaggggaccacgcugaacaaccgccacuccaacgacaccguccacgaccggacccccuaccgcacccuccugaugaacgagcugggcgugccguuccaccucggcacgaagcaggucugcaucgccuggucguccucguccugccacgacgggaaggcguggcugcacgugugcgugaccggccacgacgagaacgccaccgccagcuucaucuacgacgggcggcugguggacuccaucggcucgugguccaagaagauccuccgcacccaggagagcgagugcgucugcaucaacgggacgugcaccguggugaugaccgacggcuccgccucgggccgggcggacaccaagauccuguucaucgaggaggggaagaucguccacacgucgaagcuguccggcagcgcccagcacguggaggagugcuccugcuacccccgcuaccccggggugcggugcgucugccgcgacaacuggaagggcucgaaccggcccaucguggacaucaacgugaaggacuacuccaucgucagcuccuacgugugcucgggccucgugggggacaccccgcgcaagaacgacuccucguccagcucccacugccuggaccccaacaacgaggagggcgggcacggcgucaaggggugggccuucgacgacggcaacgacguguggaugggccggaccaucucggagaagucccgcagcggguacgagaccuucaaggucaucgagggcugguccaagcccaacucgaagcugcagaucaaccgccaggugaucguggagcgggggaaccgguccggcuacucggggaucuucagcgucgagggcaaguccugcaucaaccgcugcuucuacguggagcucauccggggccgcaagcccgagacggaggugugguggaccucgaacuccaucgucguguucugcgggaccagcggcaccuacgggacgggcuccuggccggacggggccgacaucaaccugaugcccaucuga

SEQ ID NO: 16663 - RNA, 1410 nt, Artificial Sequence; identical to SEQ ID NO: 16463
  derived and/or modified CDS sequence (AUadapt) from InfluenzaA__AAY44778__NA

SEQ ID NO: 16664 - RNA, 1410 nt, Artificial Sequence
  derived and/or modified CDS sequence (AUadapt) from InfluenzaA__AAY44788__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccucguccagcugccacgacggcaaggcguggcugcacgugugcgugaccggggacgacgagaacgccaccgccuccuucaucuacaacggccgccugguggacucgaucggguccuggagcaagaagauccuccggacccaggaguccgagugcgucugcaucaacggcacgugcaccguggugaugaccgacggcucggccuccgggaaggcggacaccaagauccuguucaucgaggagggcaagaucguccacacgagccugcucucgggguccgcccagcacguggaggagugcucgugcuacccccgcuaccccggcgugcggugcgucugccgcgacaacuggaagggcuccaaccggccgaucguggacaucaacgugaaggacuacagcaucgucuccucguacgugugcuccgggcuggugggcgacacgccccgcaagaacgacagcuccucguccagccacugccuggaccccaacaacgaggagggcgggcacggggucaagggcugggccuucgacgacggcaacgacguguggauggggcggaccaucuccgagaagcuccgcucgggcuacgagaucuucaaggucaucgaggggugguccaagcccaacagcaagcugcagaucaaccgccaggugaucguggaccggggcaaccgguccggguacucgggcaucuucuccgucgagggcaagagcugcaucaaccgcugcuucuacguggagcugauccgggggcgcaagcaggagaccgaggugcucuggaccucgaacuccaucgucguguucugcggcaccagcgggaccuacggcaccggguccuggccggacggcgccgacaucaaccugaugcccaucuga

SEQ ID NO: 16665 - RNA, 1410 nt, Artificial Sequence; identical to SEQ ID NO: 16539
  derived and/or modified CDS sequence (AUadapt) from InfluenzaA__AAY44909__NA

SEQ ID NO: 16666 - RNA, 1410 nt, Artificial Sequence; identical to SEQ ID NO: 16566
  derived and/or modified CDS sequence (AUadapt) from InfluenzaA__AAY45649__NA

SEQ ID NO: 16667 - RNA, 1410 nt, Artificial Sequence
  derived and/or modified CDS sequence (AUadapt) from InfluenzaA__AAY46374__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccuacaagugcuaccaguucgcccugggccaggggaccacgcugaacaaccgccacagcaacgacaccguccacgaccggaccccguaccgcacccuccugaugaacgagcugggcgugcccuuccaccucggcacgaagcaggucugcaucgccugguccucguccagcugccacgacgggaaggcguggcugcacgugugcgugaccggccacgacgagaacgccaccgccuccuucaucuacgacgggcggcugguggacucgaucggcuccuggucgaagaagauccuccgcacccaggaguccgagugcgucugcaucaacgggacgugcaccguggugaugaccgacggcagcgccuccggccgggcggacaccaagauccuguucaucgaggaggggaagaucguccacacgucgaagcugagcggcuccgcccagcacguggaggagugcucgugcuacccccgcuaccccggggugcggugcgucugccgcgacaacuggaagggcuccaaccggccgaucguggacaucaacgugaaggacuacagcaucgucuccucguacgugugcuccggccucgugggggacacgccccgcaagaacgacagcuccucguccucgcacugccuggaccccaacaacgaggagggcgggcacggcgucaaggggugggccuucgacgacggcaacgacguguggaugggccggaccaucuccgagaagucccgcagcggguacgagaccuucaaggucaucgagggcuggucgaagcccaacuccaagcugcagaucaaccgccaggugaucguggagcgggggaacaugagcggcuacuccgggaucuucucggucgagggcaagagcugcaucaaccggugcuucuacguggagcucauccgcggccggaagcaggagaccgaggugugguggaccuccaacucgaucgucguguucugcgggaccuccggcaccuacgggacgggcagcuggccggacggggccgacaucaaccugaugcccaucuga

SEQ ID NO: 16668 - RNA, 1410 nt, Artificial Sequence
  derived and/or modified CDS sequence (AUadapt) from InfluenzaA__AAY46384__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacgccguccacgaccgcaccccguaccggacccuccugaugaacgagcugggcgugcccuuccaccucgggacccgccaggugugcaucgcgugguccucguccucgugccacgacggcaaggccuggcugcacgucugcgugacgggggacgacaagaacgccaccgccuccuucaucuacaacggccggcugguggacagcaucggguccuggucgaagaagauccuccgcacccaggaguccgagugcgucugcaucaacgggaccugcacgguggugaugaccgacggcagcgcguccgggaaggccgacaccaagauccuguucaucgaggagggcaagaucguccacaucucgacccugagcggguccgcccagcacguggaggagugcucgugcuacccccgguaccccggcgugcgcugcgucugccgggacaacuggaagggcuccaaccgcccgaucguggacaucaacgugaaggacuacucgaucgucuccagcuacgugugcuccgggcucgugggcgacacgccccggaagaacgacucguucuccagcucccacugccuggaccccaacaacgaggagggcggccacggggucaagggcugggccuucgacgacggcaacgacguguggauggggcgcaccaucucggagaagcugcgguccggcuacgagaccuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaaggaggagaccgaggugugguggacgagcaacucgaucgucguguucugcggcaccuccgggaccuacggcaccgggagcuggccggacggcgccgacaucaaccugaugcccaucuga

SEQ ID NO: 16669 - RNA, 1410 nt, Artificial Sequence
  derived and/or modified CDS sequence (AUadapt) from InfluenzaA__AAY46394__NA
augaaccccaaccagaagaucaucaccaucggcucggugucccugaccaucgccacgaucugcuuccucaugcagaucgccauccugaucaccaccgucacccugcacuucaagcaguacgagugcaacucgccgcccaacaaccaggugaugcucugcgagcccacgaucaucgagcgcaacaucaccgagaucguguaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggucacccgggagcccuacguguccugcgaccccgacaagugcuaccaguucgcccugggccaggggaccacgcugaacaacggccacagcaacgacaccgugcacgaccgcaccccguaccggacccuccugaugaacgagcugggcguccccuuccaccucgggacgaagcaggucugcaucgccugguccucguccucgugccacgacggcaaggcguggcugcacgugugcgugaccggggacgacgagaacgccaccgccuccuucaucuacaacggccgccugguggacagcaucggguccuggucgaagaagauccuccggacccaggaguccgagugcgugugcaucaacggcacgugcaccgucgugaugaccgacggcagcgccuccgggaaggcggacaccaagauccuguucaucgaggagggcaagaucgugcacacgucgucgcuguccgggagcgcccagcacgucgaggagugcuccugcuacccccgcuaccccggcgugcggugcgugugccgcgacaacuggaagggcucgaaccggccgaucgucgacaucaacgugaaggacuacuccaucgugagcuccuacgucugcucggggcucgugggcgacacgccccgcaagaacgacuccucguccagcucccacugccuggaccccaacaacgaggagggcgggcacggggugaagggcugggccuucgacgacggcaacgacgucuggauggggcggaccaucucggagaagcugcgcuccggcuacgagaccuucaaggugaucgagggguggagcaagcccaacuccaagcuccagaucaaccggcaggucaucguggaccgcggcaaccggucgggguacuccggcaucuucucgguggagggcaagagcugcaucaaccgcugcuucuacgucgagcugauccgggggcgcaagcaggagaccgaggugcuguggaccuccaacucgaucguggucuucugcggcaccuccgggaccuacggcacggggagcuggccggacggcgccgacaucgaccucaugcccaucuga

SEQ ID NO: 16670 - RNA, 1410 nt, Artificial Sequence
  derived and/or modified CDS sequence (AUadapt) from InfluenzaA__AAY46419__NA
augaaccccaaccagaagaucaucaccaucggcucggugucccugaccaucgccacgaucugcuuccucaugcagaucgccauccuggucaccaccgugacccugcacuucaagcaguacgagugcaacagccucccgaacaaccaggugaugcugugcgagcccacgauccuggagcgcaacaucaccgagaucgucuaccucaccaacaccacgaucgagaaggagaucugccccaagcuggcggaguaccggaacugguccaagccccagugcaagaucaccggguucgccccguucucgaaggacaacuccauccgccugagcgccggcggggacaucugggugacccgggagcccuacguguccugcgaccccgacaagugcuaccaguucgcccucggccaggggaccacgcugaacaaccgccacucgaacgacaccguccacgaccggacccccuaccgcacccugcucaugaacgagcugggcgugccguuccaccugggcacgaagcaggucugcaucgccugguccagcuccucgugccacgacgggaaggcguggcuccacgugugcgugaccggccacaacgagaacgccaccgccuccuucaucuacgggggccggcugguggacagcaucggguccuggucgaagaagauccugcgcacccaggaguccgagugcgucugcaucaacggcacgugcaccguggugaugaccgacggcagcgccuccgggcgggcggacaccaagauccucuucaucgaggagggcaagaucauccacaucucgcagcugagcggguccgcccagcacgucgaggagugcucgugcuacccccgcuaccccggcgugcggugcgugugccgcgacaacuggaagggcuccaaccggcccaucgucgacaucaacgugaaggacuacagcaucguguccucguacgucugcuccgggcuggugggcgacacgccgcgcaagaacgacagcuccucguccagccacugccucaaccccaacaacgaggagggcgggcacggggugaagggcugggccuucgacgacggcaacgacgucuggauggggcggaccaucuccgagaaguuccgcucgggcuacgagaccuucaaggugaucgaggggugguccaagcccaacagcaagcugcagaucaaccggcaggucaucguggaccgcgacaaccgguccggcuacucggggaucuucuccguggagggcaagagcugcaucaaccgcugcuucuacgucgagcugauccggggccgcaagcaggagaccgaggugugguggacgucgaacuccaucguggucuucugcgggaccagcggcaccuacgggaccggcuccuggcccgacggggccgacaucaaccucaugccgaucuga

SEQ ID NO: 16671 - RNA, 1410 nt, Artificial Sequence
  derived and/or modified CDS sequence (AUadapt) from InfluenzaA__AAY47016__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccagcugccacgacggcaaggcguggcugcacgucugcgugaccggggacgacgagaacgccaccgccuccuucaucuacaacggccggcugguggacucgaucggguccuggagcaagaagauccuccgcacccaggaguccgagugcgucugcaucaacggcacgugcaccguggugaugaccgacggcucggccuccgggaaggcggacaccaagauccuguucaucgaggagggcaagaucguccacaucagcacgcugucggggaacgcccagcacguggaggagugcuccugcuacccccgguaccccggcgugcgcugcgucugccgggacaacuggaagggcucgaaccgcccgaucguggacaucaacgugaaggacuacuccaucgucagcuccuacgugugcucggggcucgugggcgacacgccccggaagaacgacuccuucagcuccucgcacugccuggaccccaacuccgaggagggcgggcacggggucaagggcugggccuucgacgacggcaacgacguguggauggggcgcaccaucagcgagaagcugcgguccggcuacgagaccuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaaggaggagaccgaggugugguggaccagcaacucgaucgucguguucugcggcaccuccgggaccuacggcacggggagcuggccggacggcgccgacaucaaccugaugcccaucuga

SEQ ID NO: 16672 - RNA, 1410 nt, Artificial Sequence
  derived and/or modified CDS sequence (AUadapt) from InfluenzaA__AAY47055__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccucguccagcugccacgacggcaaggcguggcugcacgugugcgugaccggggacgacgagaacgccaccgccuccuucaucuacaacggccgccugguggacucgaucggguccuggagcaagaagauccuccggacccaggaguccgagugcgucugcaucaacggcacgugcaccguggugaugaccgacggcucggccuccgggaaggcggacaccaagauccuguucaucgaggagggcaagaucguccacacgagccugcucucgggguccgcccagcacguggaggagugcucgugcuacccccgcuaccccggcgugcggugcgucugccgcgacaacuggaagggcuccaaccggccgaucguggacaucaacgugaaggacuacagcaucgucuccucguacgugugcuccgggcuggugggcgacacgccccgcaagaacgacagcuccucguccagccacugccuggaccccaacaacgaggagggcgggcacggggucaagggcugggccuucgacgacggcaacgacguguggauggggcggaccaucuccgagaagcuccgcucgggcuacgagaccuucaaggucaucgaggggugguccaagcccaacagcaagcugcagaucaaccgccaggugaucguggaccggggcaaccgguccggguacucgggcaucuucuccgucgagggcaagagcugcaucaaccgcugcuucuacguggagcugauccgggggcgcaagcaggagaccgaggugcucuggaccucgaacuccaucgucguguucugcggcaccagcgggaccuacggcacgggguccuggccggacggcgccgacaucaaccuguuccccaucuga

SEQ ID NO: 16673 - RNA, 1410 nt, Artificial Sequence
  derived and/or modified CDS sequence (AUadapt) from InfluenzaA__AAY47078__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccacgacaagugcuaccaguucgcccugggccaggggaccacgcugaacaacggccacagcaacgacaccguccacgaccgcacccccuaccggacccuccugaugaacgagcugggcgugccguuccaccucgggacgaagcaggucugcaucgccugguccucguccagcugccacgacggcaaggcguggcugcacgugugcgugaccggggacgacgagaacgccaccgccuccuucaucuacaacggccgccugguggacucgaucggguccuggagcaagaagauccuccggacccaggaguccgagugcgucugcaucaacggcacgugcaccguggugaugaccgacggcucggccuccgggaaggcggacaccaagauccuguucaucgaggagggcaagaucguccacaucagcacgcugucgggguccgcccagcacguggaggagugcucgugcuacccccgcuaccccggcgugcggugcgucugccgcgacaacuggaagggcuccaaccggcccaucguggacaucaacgugaaggacuacagcaucgucuccucguacgugugcuccgggcucgugggcgacaccccgcgcaagaacgacagcuucuccucgucccacugccuggaccccaacaacgaggagggcgggcacggggucaagggcugggccuucgacgacggcaacgacguguggauggggcggaccaucagcgagaagcugcgcuccggcuacgagaccuucaaggucaucgagggguggucgaagcccaacuccaagcuccagaucaaccgccaggugaucguggagcggggcaaccggagcggguacuccggcaucuucucggucgagggcaaguccugcaucaaccgcugcuucuacguggagcugauccgggggcgcaaggaggagacggaggugugguggaccagcaacucgaucgucguguucugcggcaccuccgggaccuacggcacggggagcuggcccgacggcgccgacaucaaccugaugccgaucuga

SEQ ID NO: 16674 - RNA, 1410 nt, Artificial Sequence
  derived and/or modified CDS sequence (AUadapt) from InfluenzaA__AAY47088__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacgagaacgcgaccgccagcuucaucuacaacgggcgccugguggacuccaucgucucgugguccaagaagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggaccacuccaucgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaagcaggagaccgaggugcuguggaccuccaacagcaucgucguguucugcggcaccuccgggacguacggcaccgggagcuggccggacggcgccgacaucaaccugaugcccaucuga

SEQ ID NO: 16675 - RNA, 1410 nt, Artificial Sequence; identical to SEQ ID NO: 16539
  derived and/or modified CDS sequence (AUadapt) from InfluenzaA__AAY58319__NA

SEQ ID NO: 16676 - RNA, 1392 nt, Artificial Sequence
  derived and/or modified CDS sequence (AUadapt) from InfluenzaA__AAY59038__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucucgaaggacaacuccauccgccucagcgccggcggggacaucugggugacccgggagcccuacguguccugcgaccccgacaagugcuaccaguucgcccugggccaggggaccacgaacgacaccguccacgaccgcaccccguaccggacccugcucaugaacgagcugggcgugcccuuccaccugggcacgaagcaggucugcaucgccuggucguccucguccugccacgacgggaaggcguggcuccacgugugcgugaccggcgacgacgagaacgccaccgccagcuucaucuacaacgggcgccugguggacuccaucggcucgugguccaagaagauccugcggacccaggagucggagugcgucugcaucaacgggacgugcaccguggugaugaccgacggcuccgccucgggcaaggcggacaccaagauccucuucaucgaggaggggaagaucguccacacgagcccccuguccggcucggcccagcacguggaggagugcuccugcuacccccgcuacccgggggugcggugcgucugccgcgacaacuggaagggcucgaaccggcccaucguggacaucaacgugaaggacuacuccaucgucagcuccuacgugugcucgggccuggugggggacacgccccgcaagaacgacuccucguccucgucccacugccucgaccccaacaacgaggagggcgggcacggcgucaaggggugggccuucgacgacggcaacgacguguggaugggccggaccaucagcgagaagcugcgcuccggguacgagaccuucaaggucaucgagggcuggucgaagccgaacuccaagcugcagaucaaccgccaggugaucguggaccgggggaaccggucgggcuacuccgggaucuucagcgucgagggcaaguccugcaucaaccgcugcuucuacguggagcucauccggggccgcaagcaggagaccgaggugcuguggaccucgaacucgaucgucguguucugcgggaccuccggcaccuacgggacgggcagcuggcccgacggggccgacaucaaccugaugcccaucuga

SEQ ID NO: 16677 - RNA, 1410 nt, Artificial Sequence
  derived and/or modified CDS sequence (AUadapt) from InfluenzaA__AAY64195__NA
augaaccccaaccagaagaucaucaccaucggcucggugucccugaccaucgccacgaucugcuuccucaugcagaucgccauccuggucaccaccgugacccugcacuucaagcaguacgagugcaacagccucccgaacaaccaggugaugcugugcgagcccacgaucaucgagcgcaacaucaccgagaucgucuaccugaccaacaccacgaucgagaaggagaucugccccaagcucgcggaguaccggaacugguccaagccccagugcaagaucaccggguucgccccguucucgaaggacaacuccauccgccugagcgccggcggggacaucugggugacccgggagcccuacguguccugcgaccccgacaagugcuaccaguucgcccugggccaggggaccacgcucaacaaccgccacucgaacgacaccguccacgaccggacccccuaccgcacccugcugaugaacgagcucggcgugccguuccaccugggcacgaagcaggucugcaucgccugguccagcuccucgugccacgacgggaaggcguggcugcacgugugcgugaccggccacgacgagaacgccaccgccuccuucaucuacgacgggcggcucguggacagcaucggcuccuggucgaagaagauccugcgcacccaggaguccgagugcgucugcaucaacgggacgugcaccguggugaugaccgacggcagcgccuccggccgggcggacaccaagauccuguucaucgaggaggggaagaucauccacaucucgcagcucagcggcuccgcccagcacgucgaggagugcucgugcuacccccgcuaccccggggugcggugcgugugccgcgacaacuggaagggcuccaaccggcccaucgucgacaucaacgugaaggacuacagcaucguguccucguacgucugcuccggccuggugggggacacgccgcgcaagaacgacagcuccucguccagccacugccugaaccccaacaacgaggagggcgggcacggcgugaaggggugggccuucgacgacggcaacgacgucuggaugggccggaccaucuccgagaaguuccgcucgggguacgagaccuucaaggugaucgagggcugguccaagcccaacagcaagcuccagaucaaccggcaggucaucguggaccgcgacaaccgguccggguacucgggcaucuucuccguggagggcaagagcugcaucaaccgcugcuucuacgucgagcugauccgggggcgcaagcaggaggccgaggugugguggaccucgaacuccaucguggucuucugcggcacgagcgggaccuacggcaccggguccuggcccgacggcgccgacaucaaccugaugccgaucuga

SEQ ID NO: 16678 - RNA, 1410 nt, Artificial Sequence; identical to SEQ ID NO: 16537
  derived and/or modified CDS sequence (AUadapt) from InfluenzaA__AAY64205__NA

SEQ ID NO: 16679 - RNA, 1410 nt, Artificial Sequence; identical to SEQ ID NO: 16463
  derived and/or modified CDS sequence (AUadapt) from InfluenzaA__AAY64215__NA

SEQ ID NO: 16680 - RNA, 1410 nt, Artificial Sequence
  derived and/or modified CDS sequence (AUadapt) from InfluenzaA__AAY64225__NA
augaaccccaaccagaagaucaucaccaucggcucggugucccugaccaucgccacgaucugcuuccucaugcagaucaccauccuggucaccaccgugacgcugcacuucaagcaguacgagugcaacccgccgcccaacaaccaggugaugcucugcgagcccaccaucaucgagcgcaacaucaccgagaucgucuaccugaccaacacgaccaucgagaaggagaucugccccaagcuggccgaguaccggaacuggucgaagccccagugcaacaucaccggguucgcgcccuucuccaaggacaacagcauccgccucuccgccggcggggacaucugggugacccgggagcccuacgugucgugcgacccggacaagugcuaccaguucgcccugggccaggggacgacccugaacaacggccacuccaacgacaccguccacgaccgcacccccuaccggacgcuccugaugaacgagcugggcgugcccuuccaccucgggacccgccaggugugcaucgccuggagcuccucguccugccacgacggcaaggccuggcugcacgucugcgugaccggggacgacgagaacgcgaccgccagcuucaucuacaacggccggcugguggacuccaucgggucgugguccaagaagauccuccgcacgcaggagucggagugcgucugcaucaacgggaccugcaccguggugaugaccgacggcuccgccagcgggaaggccgacacgaagauccuguucaucgaggagggcaagaucguccacaucuccacccugucggggagcgcgcagcacguggaggagugcuccugcuacccccgguacccgggcgugcgcugcgucugccgggacaacuggaagggcucgaaccgccccaucguggacaucaacgugaaggacuacuccaucgucagcuccuacgugugcucggggcucgugggcgacacgccccggaagaacgacuccuucucguccagccacugccuggaccccaacaacgaggagggcggccacggggucaagggcugggccuucgacgacggcaacgacguguggauggggcgcaccaucuccgagaagcugcggucgggcuacgagaccuucaaggucaucgaggggugguccaagccgaacagcaagcuccagaucaaccgccaggugaucguggagcggggcaaccgcuccggguacucgggcaucuucuccgucgagggcaagagcugcaucaaccggugcuucuacguggagcugauccgcgggcggaaggaggagaacgaggugugguggaccuccaacucgaucgucguguucugcggcaccagcgggaccuacggcacgggguccuggcccgacggcgccgacaucaaccugaugcccaucuga

SEQ ID NO: 16681 - RNA, 1410 nt, Artificial Sequence
  derived and/or modified CDS sequence (AUadapt) from InfluenzaA__AAY64245__NA
augaaccccaaccagaagaucaucaccaucggcucggugucccugaccaucgccacgaucugcuuccucaugcagaucgccauccuggucaccaccgugacccugcacuucaagcaguacgagugcaacagccucccgaacaaccaggugaugcugugcgagcccacgauccuggagcgcaacaucaccgagaucgucuaccucaccaacaccacgaucgagaaggagaucugccccaagcuggcggaguaccggaacugguccaagccccagugcaagaucaccggguucgccccguucucgaaggacaacuccauccgccugagcgccggcggggacaucugggugacccgggagcccuacguguccugcgaccccgacaagugcuaccaguucgcccucggccaggggaccacgcugaacaaccgccacucgaacgacaccguccacgaccggacccccuaccgcacccugcucaugaacgagcugggcgugccguuccaccugggcacgaagcaggucugcaucgccugguccagcuccucgugccacgacgggaaggcguggcuccacgugugcgugaccggccacgacgagaacgccaccgccuccuucaucuacgggggccggcugguggacagcaucggguccuggucgaagaagauccugcgcacccaggaguccgagugcgucugcaucaacggcacgugcaccguggugaugaccgacggcagcgccuccgggcgggcggacaccaagauccucuucaucgaggagggcaagaucauccacaucucgcagcugagcggguccgcccagcacgucgaggagugcucgugcuacccccgcuaccccggcgugcggugcgugugccgcgacaacuggaagggcuccaaccggcccaucgucgacaucaacgugaaggacuacagcaucguguccucguacgucugcuccgggcuggugggcgacacgccgcgcaagaacgacagcuccucguccagccacugccucaaccccaacaacgaggagggcgggcacggggugaagggcugggccuucgacgacggcaacgacgucuggauggggcggaccaucuccgagaaguuccgcucgggcuacgagaccuucaaggugaucgaggggugguccaagcccaacagcaagcugcagaucaaccggcaggucaucguggaccgcgacaaccgguccggcuacucggggaucuucuccguggagggcaagagcugcaucaaccgcugcuucuacgucgagcugauccggggccgcaagcaggagaccgaggugugguggacgucgaacuccaucguggucuucugcgggaccagcggcaccuacgggaccggcuccuggcccgacggggccgacaucaaccucaugccgaucuga

SEQ ID NO: 16682 - RNA, 1410 nt, Artificial Sequence; identical to SEQ ID NO: 16463
  derived and/or modified CDS sequence (AUadapt) from InfluenzaA__AAY64255__NA

SEQ ID NO: 16683 - RNA, 1410 nt, Artificial Sequence; identical to SEQ ID NO: 16681
  derived and/or modified CDS sequence (AUadapt) from InfluenzaA__AAY64265__NA

SEQ ID NO: 16684 - RNA, 1410 nt, Artificial Sequence; identical to SEQ ID NO: 16681
  derived and/or modified CDS sequence (AUadapt) from InfluenzaA__AAY64285__NA

SEQ ID NO: 16685 - RNA, 1410 nt, Artificial Sequence
  derived and/or modified CDS sequence (AUadapt) from InfluenzaA__AAY64295__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuguccgaguaccggaacuggagcaagccgcagugcaacaucaccggguucgcgcccuucuccaaggacaacucgauccgccucuccgccggcggggacaucugggugacccgggagcccuacgugagcugcgaccccgacaagugcuaccaguucgcccugggccaggggaccacgcugaacaacggccacuccaacgacaccguccacgaccgcaccccguaccggacccuccugaugaacgagcugggcgugcccuuccaccucgggacgaagcaggucugcaucgccuggucguccagcuccugccacgacggcaaggccuggcugcacgugugcgugaccggggacgacgagaacgcgaccgccucguucaucuacaacggccgccugguggacuccaucgggagcugguccaagaagauccuccggacccaggagucggagugcgucugcaucaacggcacgugcaccguggugaugaccgacggcuccgccagcgggaaggccgacaccaagauccuguucaucgaggagggcaagaucguccacaucucgacgcuguccgggucggcgcagcacguggaggagugcuccugcuacccccgcuaccccggcgugcggugcgucugccgcgacaacuggaagggcagcaaccggccgaucguggacaucaacgugaaggaccacuccaucgucucguccuacgugugcagcgggcucgugggcgacacgccccgcaagaacgacuccuucucguccagccacugccuggaccccaacaacgaggagggcgggcacggggucaagggcugggccuucgacgacggcaacgacguguggauggggcggaccaucuccgagaagcugcgcucgggcuacgagaccuucaaggucaucgaggggugguccaagcccaacagcaagcuccagaucaaccgccaggugaucguggagcggggcaaccgguccggguacucgggcaucuucuccgucgagggcaagagcugcaucaaccgcugcuucuacguggagcugauccgggggcgcaaggaggagaccgaggugugguggaccucgaacuccaucgucguguucugcggcaccagcgggaccuacggcacgggguccuggccggacggcgccgacaucaaccugaugcccaucuga

SEQ ID NO: 16686 - RNA, 1410 nt, Artificial Sequence
  derived and/or modified CDS sequence (AUadapt) from InfluenzaA__AAY64305__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccgacaagugcuaccaguucgcccugggccaggggaccacgcugaacaaccgccacagcaacgacaccguccacgaccggaccccguaccgcacccuccugaugaacgagcugggcgugcccuuccaccucggcacgaagcaggucugcaucgccugguccucguccucgugccacgacgggaaggcguggcugcacgugugcgugaccggccacgacgagaacgccaccgccuccuucaucuacgacgggcggcugguggacagcaucggcuccuggucgaagaagauccuccgcacccaggaguccgagugcgucugcaucaacgggacgugcaccguggugaugaccgacggcagcgccuccggccgggcggacaccaagauccuguucaucgaggaggggaagaucguccacacgucgaagcugucgggcuccgcccagcacguggaggagugcagcugcuacccccgcuaccccggggugcggugcgucugccgcgacaacuggaagggcuccaaccggccgaucguggacaucaacgugaaggacuacucgaucgucuccagcuacgugugcuccggccucgugggggacacgccccgcaagaacgacucguccucguccagccacugccuggaccccaacaacgaggagggcgggcacggcgucaaggggugggccuucgacgacggcaacgacguguggaugggccggaccaucuccgagaagucccgcucgggguacgagaccuucaaggucaucgagggcuggagcaagcccaacuccaagcugcagaucaaccgccaggugaucguggagcgggggaacaugucgggcuacuccgggaucuucucggucgagggcaagagcugcaucaaccggugcuucuacguggagcucauccgcggccggaagcaggagaccgaggugugguggaccuccaacucgaucgucguguucugcgggaccuccggcaccuacgggacgggcagcuggccggacggggccgacaucaaccugaugcccaucuga

SEQ ID NO: 16687 - RNA, 1410 nt, Artificial Sequence; identical to SEQ ID NO: 16537
  derived and/or modified CDS sequence (AUadapt) from InfluenzaA__AAY64335__NA

SEQ ID NO: 16688 - RNA, 1410 nt, Artificial Sequence; identical to SEQ ID NO: 16552
  derived and/or modified CDS sequence (AUadapt) from InfluenzaA__AAY64365__NA

SEQ ID NO: 16689 - RNA, 1410 nt, Artificial Sequence
  derived and/or modified CDS sequence (AUadapt) from InfluenzaA__AAY64385__NA
augaaccccaaccagaagaucaucaccaucggcucggugucccugaccaucgccacgaucugcuuccucaugcagaucgccauccuggucaccaccgugacccugcacuucaagcaguacgagugcaacucgcucccgaacaaccaggugaugcugugcgagcccacgauccuggagcgcaacaucaccgagaucgucuaccucaccaacaccacgaucgagaaggagaucugccccaagcuggcggaguaccggaacugguccaagccccagugcaagaucaccggguucgccccguucagcaaggacaacuccauccgccugucggccggcggggacaucugggugacccgggagcccuacguguccugcgaccccgacaagugcuaccaguucgcccucggccaggggaccacgcugaacaaccgccacagcaacgacaccguccacgaccggacccccuaccgcacccugcucaugaacgagcugggcgugccguuccaccugggcacgaagcaggucugcaucgccugguccucguccagcugccacgacgggaaggcguggcuccacgugugcgugaccggccacgacgagaacgccaccgccuccuucaucuacgggggccggcugguggacucgaucggguccuggucgaagaagauccugcgcacccaggaguccgagugcgucugcaucaacggcacgugcaccguggugaugaccgacggcagcgccuccgggcgggcggacaccaagauccucuucaucgaggagggcaagaucauccacaucucgcagcugagcggguccgcccagcacgucgaggagugcucgugcuacccccgcuaccccggcgugcggugcgugugccgcgacaacuggaagggcuccaaccggcccaucgucgacaucaacgugaaggacuacagcaucguguccucguacgucugcuccgggcuggugggcgacacgccgcgcaagaacgacagcuccucguccucgcacugccucaaccccaacaacgaggagggcgggcacggggugaagggcugggccuucgacgacggcaacgacgucuggauggggcggaccaucuccgagaagucccgcagcggcuacgagaccuucaaggugaucgagggguggucgaagcccaacuccaagcugcagaucaaccggcaggucaucguggaccgcgacaaccggagcggcuacuccgggaucuucucgguggagggcaagagcugcaucaaccgcugcuucuacgucgagcugauccggggccgcaagcaggagaccgaggugugguggacguccaacucgaucguggucuucugcgggaccuccggcaccuacgggaccggcagcuggcccgacggggccgacaucaaccucaugccgaucuga

SEQ ID NO: 16690 - RNA, 1410 nt, Artificial Sequence
  derived and/or modified CDS sequence (AUadapt) from InfluenzaA__AAY64395__NA
augaaccccaaccagaagaucaucaccaucggcucggugucccugaucaucagcaccaucugcuucuucaugcagaucgccauccucaucacgaccgucacccugcacuucaagcaguacgaguucaacuccccgcccaacaaccaggugaugcugugcgagcccaccaucaucgagcgcaacaucacggagaucguguaccucaccaacaccaccaucgagaaggagaucugccccaagcuggccgaguaccggaacuggucgaagccgcagugcgacaucacgggguucgcgcccuucuccaaggacaacagcauccgccuguccgccggcggggacaucugggucacccgggagcccuacgugagcugcgaccccgacaagugcuaccaguucgcccucggccaggggaccacccugaacaacgugcacuccaacgacacgguccacgaccgcaccccguaccggacccugcucaugaacgagcugggcgugcccuuccaccugggcaccaagcaggucugcaucgccuggucguccagcuccugccacgacgggaaggccuggcuccacgugugcgugacgggcgacgacgagaacgcgaccgccagcuucaucuacaacgggcgccugguggacuccaucgucucgugguccaagaagauccugcggacccaggagagcgagugcgugugcaucaacgggaccugcacgguggucaugaccgacggguccgccagcggcaaggccgacaccaagauccucuucaucaaggagggcaagaucgugcacaccucgacgcuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcagcggccuggugggcgacacgccccgcaagaacgacuccucguccagcucccacugccucgaccccaacaacgaggagggcggccacggggucaagggcugggccuucgacgacgggaacgacguguggaugggccggaccaucagcgagaagcugcgcuccggcuacgagaccuucaaggucaucgagggguggucgaacuccaacagcaagcugcagaucaaccgccaggugaucguggaccggggcaaccgguccggguacagcggcaucuucucggucgaggggaaguccugcaucaaccgcugcuucuacguggagcucauccggggccgcaaggaggagaccgaggugcuguggaccagcaacuccaucgucguguucugcggcaccagcgggaccuacggcacgggguccuggcccgacggcgccgacaucaaccugaugccgaucuga

SEQ ID NO: 16691 - RNA, 1410 nt, Artificial Sequence; identical to SEQ ID NO: 16686
  derived and/or modified CDS sequence (AUadapt) from InfluenzaA__AAY64405__NA

SEQ ID NO: 16692 - RNA, 1410 nt, Artificial Sequence; identical to SEQ ID NO: 16681
  derived and/or modified CDS sequence (AUadapt) from InfluenzaA__AAY98040__NA

SEQ ID NO: 16693 - RNA, 1410 nt, Artificial Sequence; identical to SEQ ID NO: 16681
  derived and/or modified CDS sequence (AUadapt) from InfluenzaA__AAY98050__NA

SEQ ID NO: 16694 - RNA, 1410 nt, Artificial Sequence; identical to SEQ ID NO: 16573
  derived and/or modified CDS sequence (AUadapt) from InfluenzaA__AAY98060__NA

SEQ ID NO: 16695 - RNA, 1410 nt, Artificial Sequence
  derived and/or modified CDS sequence (AUadapt) from InfluenzaA__AAY98070__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccagcugccacgacggcaaggcguggcugcacgucugcgugaccggggacgacgagaacgccaccgccuccuucaucuacaacggccggcugguggacucgaucggguccuggagcaagaagauccuccgcacccaggaguccgagugcgucugcaucaacggcacgugcaccguggugaugaccgacggcucggccuccgggaaggcggacaccaagauccuguucaucgaggagggcaagaucguccacaucagcacgcugucgggguccgcccagcacguggaggagugcucgugcuacccccgguaccccggcgugcgcugcgucugccgggacaacuggaagggcuccaaccgcccgaucguggacaucaacgugaaggaccacagcaucgucuccucguacgugugcuccgggcucgugggcgacacgccccggaagaacgacagcuucuccucgucccacugccuggaccccaacaacgaggagggcgggcacggggucaagggcugggccuucgacgacggcaacgacguguggauggggcgcaccaucagcgagaagcugcgguccggcuacgagaucuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaaggaggagaccgaggugugguggaccagcaacucgaucgucguguucugcggcaccuccgggaccuacggcaccgggagcuggccggacggcgccgacaucaaccugaugcccaucuga

SEQ ID NO: 16696 - RNA, 1410 nt, Artificial Sequence; identical to SEQ ID NO: 16581
  derived and/or modified CDS sequence (AUadapt) from InfluenzaA__AAY98080__NA

SEQ ID NO: 16697 - RNA, 1410 nt, Artificial Sequence
  derived and/or modified CDS sequence (AUadapt) from InfluenzaA__AAY98090__NA
augaaccccaaccagaagaucaucaccaucggcucggugucccugaccaucgccacgaucugcuuccucaugcagaucgccauccuggucaccaccgugacccugcacuucaagcaguacgagugcaacagccucccgaacaaccaggugaugcugugcgagcccacgaucaucgagcgcaacaucaccgagaucgucuaccugaccaacaccacgaucgagaaggagaucugccccaagcucgcggaguaccggaacugguccaagccccagugcaagaucaccggguucgccccguucucgaaggacaacuccauccgccugagcgccggcggggacaucugggugacccgggagcccuacguguccugcgaccccgacaagugcuaccaguucgcccugggccaggggaccacgcucaacaaccgccacucgaacgacaccguccacgaccggacccccuaccgcacccugcugaugaacgagcucggcgugccguuccaccugggcacgaagcaggucugcaucgccugguccagcuccucgugccacgacgggaaggcguggcugcacgugugcgugaccggccacgacgagaacgccaccgccuccuucaucuacgacgggcggcucguggacagcaucggcuccuggucgaagaagauccugcgcacccaggaguccgagugcgucugcaucaacgggacgugcaccguggugaugaccgacggcagcgccuccggcaaggcggacaccaagauccuguucaucgaggaggggaagaucauccacaucucgcagcucagcggcuccgcccagcacgucgaggagugcucgugcuacccccgguaccccggggugcgcugcgugugccgggacaacuggaagggcuccaaccgccccaucgucgacaucaacgugaaggacuacagcaucguguccucguacgucugcuccggccuggugggggacacgccgcggaagaacgacagcuccucguccagccacugccugaaccccaacaacgaggagggcgggcacggcgugaaggggugggccuucgacgacggcaacgacgucuggaugggccgcaccaucuccgagaaguuccggucgggguacgagaccuucaaggugaucgagggcugguccaagcccaacagcaagcuccagaucaaccgccaggucaucguggaccgggacaaccgcuccggguacucgggcaucuucuccguggagggcaagagcugcaucaaccggugcuucuacgucgagcugauccgcgggcggaagcaggagaccgaggugugguggacgucgaacuccaucguggucuucugcggcaccagcgggaccuacggcaccggguccuggcccgacggcgccgacaucaaccugaugccgaucuga

SEQ ID NO: 16698 - RNA, 1410 nt, Artificial Sequence; identical to SEQ ID NO: 16681
  derived and/or modified CDS sequence (AUadapt) from InfluenzaA__AAY98100__NA

SEQ ID NO: 16699 - RNA, 1410 nt, Artificial Sequence; identical to SEQ ID NO: 16681
  derived and/or modified CDS sequence (AUadapt) from InfluenzaA__AAY98110__NA

SEQ ID NO: 16700 - RNA, 1410 nt, Artificial Sequence; identical to SEQ ID NO: 16681
  derived and/or modified CDS sequence (AUadapt) from InfluenzaA__AAY98120__NA

SEQ ID NO: 16701 - RNA, 1410 nt, Artificial Sequence; identical to SEQ ID NO: 16681
  derived and/or modified CDS sequence (AUadapt) from InfluenzaA__AAY98130__NA

SEQ ID NO: 16702 - RNA, 1410 nt, Artificial Sequence; identical to SEQ ID NO: 16681
  derived and/or modified CDS sequence (AUadapt) from InfluenzaA__AAY98150__NA

SEQ ID NO: 16703 - RNA, 1410 nt, Artificial Sequence
  derived and/or modified CDS sequence (AUadapt) from InfluenzaA__AAY98160__NA
augaaccccaaccagaagaucaucaccaucggcucggugucccugaccaucgccacgaucugcuuccucaugcagaucgccauccuggucaccaccgugacccugcacuucaagcaguacgagugcaacucgcucccgaacaaccaggugaugcugugcgagcccacgauccuggagcgcaacaucaccgagaucgucuaccucaccaacaccacgaucgagaaggagaucugccccaagcuggcggaguaccggaacugguccaagccccagugcaagaucaccggguucgccccguucagcaaggacaacuccauccgccugucggccggcggggacaucugggugacccgggagcccuacguguccugcgaccccgacaagugcuaccaguucgcccucggccaggggaccacgcugaacaaccgccacagcaacgacaccguccacgaccggacccccuaccgcacccugcucaugaacgagcugggcgugccguuccaccugggcacgaagcaggucugcaucgccugguccucguccagcugccacgacgggaaggcguggcuccacgugugcgugaccggccacgacgagaacgccaccgccuccuucaucuacgggggccggcugguggacucgaucggguccuggagcaagaagauccugcgcacccaggaguccgagugcgucugcaucaacggcacgugcaccguggugaugaccgacggcucggccuccgggcgggcggacaccaagauccucuucaucgaggagggcaagaucauccacaucagccagcugucggggaacgcccagcacgucgaggagugcuccugcuacccccgcuaccccggcgugcggugcgugugccgcgacaacuggaagggcucgaaccggcccaucgucgacaucaacgugaaggacuacuccaucgugagcuccuacgucugcucggggcuggugggcgacacgccgcgcaagaacgacuccagcuccucguccaacugccucaaccccaacaacgaggagggcgggcacggggugaagggcugggccuucgacgacggcaacgacgucuggauggggcggaccaucagcgagaaguuccgcuccggcuacgagaccuucaaggugaucgagggguggucgaagcccaacuccaagcugcagaucaaccggcaggucaucguggaccgcgacaaccggagcggcuacuccgggaucuucucgguggagggcaaguccugcaucaaccgcugcuucuacgucgagcugauccggggccgcaagcaggagaccgaggugugguggacgagcaacucgaucguggucuucugcgggaccuccggcaccuacgggaccggcagcuggcccgacggggccgacaucaaccucaugccgaucuga

SEQ ID NO: 16704 - RNA, 1410 nt, Artificial Sequence; identical to SEQ ID NO: 16681
  derived and/or modified CDS sequence (AUadapt) from InfluenzaA__AAY98170__NA

SEQ ID NO: 16705 - RNA, 1410 nt, Artificial Sequence; identical to SEQ ID NO: 16681
  derived and/or modified CDS sequence (AUadapt) from InfluenzaA__AAY98180__NA

SEQ ID NO: 16706 - RNA, 1410 nt, Artificial Sequence; identical to SEQ ID NO: 16681
  derived and/or modified CDS sequence (AUadapt) from InfluenzaA__AAY98200__NA

SEQ ID NO: 16707 - RNA, 1410 nt, Artificial Sequence; identical to SEQ ID NO: 16681
  derived and/or modified CDS sequence (AUadapt) from InfluenzaA__AAY98210__NA

SEQ ID NO: 16708 - RNA, 1410 nt, Artificial Sequence; identical to SEQ ID NO: 16686
  derived and/or modified CDS sequence (AUadapt) from InfluenzaA__AAY98220__NA

SEQ ID NO: 16709 - RNA, 1410 nt, Artificial Sequence; identical to SEQ ID NO: 16681
  derived and/or modified CDS sequence (AUadapt) from InfluenzaA__AAY98230__NA

SEQ ID NO: 16710 - RNA, 1410 nt, Artificial Sequence
  derived and/or modified CDS sequence (AUadapt) from InfluenzaA__AAY98250__NA
augaaccccaaccagaagaucaucaccaucggcucggugucccugaccaucgccacgaucugcuuccucaugcagaucgccauccuggucaccaccgugacccugcacuucaagcaguacgagugcaacagccucccgaacaaccaggugaugcugugcgagcccacgauccuggagcgcaacaucaccgagaucgucuaccucaccaacaccacgaucgagaaggagaucugccccaagcuggcggaguaccggaacugguccaagccccagugcaagaucaccggguucgccccguucucgaaggacaacuccauccgccugagcgccggcggggacaucugggugacccgggagcccuacguguccugcgaccccgacaagugcuaccaguucgcccucggccaggggaccacgcugaacaaccgccacucgaacgacaccguccacgaccggacccccuaccgcacccugcucaugaacgagcugggcgugccguuccaccugggcacgaagcaggucugcaucgccugguccagcuccucgugccacgacgggaaggcguggcuccacgugugcgugaccggccacgacgagaacgccaccgccuccuucaucuacgggggccggcugguggacagcaucggguccuggucgaagaagauccugcgcacccaggaguccgagugcgucugcaucaacggcacgugcaccguggugaugaccgacggcagcgccuccgggcgggcggacaccaagauccucuucaucgaggagggcaagaucauccacaucucgcagcugagcggguccgcccagcacgucgaggagugcucgugcuacccccgcuaccccggcgugcggugcgugugccgcgacaacuggaagggcuccaaccggcccaucgucgacaucaacgugaaggacuacagcaucguguccucguacgucugcuccgggcuggugggcgacacgccgcgcaagaacgacagcuccucguccagccacugccucaaccccaacaacgaggagggcgggcacggggugaagggcugggccuucgacgacggcaacgacgucuggauggggcggaccaucuccgagaaguuccgcucgggcuacgagaccuucaaggugaucgaggggugguccaagcccaacagcaagcugcagaucaaccggcaggucaucguggaccgcgacaaccgguccggcuacucggggaucuucuccguggaggacaagagcugcaucaaccgcugcuucuacgucgagcugauccggggccgcaagcaggagaccgaggugugguggacgucgaacuccaucguggucuucugcggcaccagcgggaccuacggcaccggguccuggcccgacggcgccgacaucaaccucaugccgaucuga

SEQ ID NO: 16711 - RNA, 1410 nt, Artificial Sequence; identical to SEQ ID NO: 16681
  derived and/or modified CDS sequence (AUadapt) from InfluenzaA__AAY98322__NA

SEQ ID NO: 16712 - RNA, 1410 nt, Artificial Sequence; identical to SEQ ID NO: 16686
  derived and/or modified CDS sequence (AUadapt) from InfluenzaA__AAY98332__NA

SEQ ID NO: 16713 - RNA, 1410 nt, Artificial Sequence; identical to SEQ ID NO: 16681
  derived and/or modified CDS sequence (AUadapt) from InfluenzaA__AAY98342__NA

SEQ ID NO: 16714 - RNA, 1410 nt, Artificial Sequence; identical to SEQ ID NO: 16681
  derived and/or modified CDS sequence (AUadapt) from InfluenzaA__AAY98359__NA

SEQ ID NO: 16715 - RNA, 1410 nt, Artificial Sequence; identical to SEQ ID NO: 16686
  derived and/or modified CDS sequence (AUadapt) from InfluenzaA__AAY98369__NA

SEQ ID NO: 16716 - RNA, 1410 nt, Artificial Sequence
  derived and/or modified CDS sequence (AUadapt) from InfluenzaA__AAY98379__NA
augaaccccaaccagaagaucaucaccaucggcucggugucccugaccaucgccacgaucugcuuccucaugcagaucgccauccuggucaccaccgugacccugcacuucaagcaguacgagugcaacagccucccgaacaaccaggugaugcugugcgagcccacgaucaucgagcgcaacaucaccgagaucgucuaccugaccaacaccacgaucgagaaggagaucugccccaagcucgcggaguaccggaacugguccaagccccagugcaagaucaccggguucgccccguucucgaaggacaacuccauccgccugagcgccggcggggacaucugggugacccgggagcccuacguguccugcgaccccgacaagugcuaccaguucgcccugggccaggggaccacgcucaacaaccgccacucgaacgacaccguccacgaccggacccccuaccgcacccugcugaugaacgagcucggcgugccguuccaccugggcacgaagcaggucugcaucgccugguccagcuccucgugccacgacgggaaggcguggcugcacgugugcgugaccggccacgacgagaacgccaccgccuccuucaucuacgggggccggcucguggacagcaucggguccuggucgaagaagauccugcgcacccaggaguccgagugcgucugcaucaacggcacgugcaccguggugaugaccgacggcagcgccuccgggcgggcggacaccaagauccuguucaucgaggagggcaagaucauccacaucucgcagcucagcggguccgcccagcacgucgaggagugcucgugcuacccccgcuaccccggcgugcggugcgugugccgcgacaacuggaagggcuccaaccggcccaucgucgacaucaacgugaaggacuacagcaucguguccucguacgucugcuccgggcuggugggcgacacgccgcgcaagaacgacagcuccucguccagccacugccugaaccccaacaacgaggagggcgggcacggggugaagggcugggccuucgacgacggcaacgacgucuggauggggcggaccaucuccgagaaguuccgcucgggcuacgagaccuucaaggugaucgaggggugguccaagcccaacagcaagcuccagaucaaccggcaggucaucguggaccgcaacaaccgguccggcuacucggggaucuucuccguggagggcaagagcugcaucaaccgcugcuucuacgucgagcugauccggggccgcaagcaggagaccgaggugugguggacgucgaacuccaucguggucuucugcgggaccagcggcaccuacgggaccggcuccuggcccgacggggccgacaucaaccugaugccgaucuga

SEQ ID NO: 16717 - RNA, 1410 nt, Artificial Sequence
  derived and/or modified CDS sequence (AUadapt) from InfluenzaA__AAY98389__NA
augaaccccaaccagaagaucaucaccaucggcucggugucccugaccaucgccacgaucugcuuccucaugcagaucgccauccuggucaccaccgugacccugcacuucaagcaguacgagugcaacagccucccgaacaaccaggugaugcugugcgagcccacgaucaucgagcgcaacaucaccgagaucgucuaccugaccaacaccacgaucgagaaggagaucugccccaagcucgcggaguaccggaacugguccaagccccagugcaagaucaccggguucgccccguucucgaaggacaacuccauccgccugagcgccggcggggacaucugggugacccgggagcccuacguguccugcgaccccgacaagugcuaccaguucgcccugggccaggggaccacgcucaacaaccgccacucgaacgacaccguccacgaccggacccccuaccgcacccugcugaugaacgagcucggcgugccguuccaccugggcacgaagcaggucugcaucgccugguccagcuccucgugccacgacgggaaggcguggcugcacgugugcgugaccggccacgacgagaacgccaccgccuccuucaucuacgggggccggcucguggacagcaucggguccuggucgaagaagauccugcgcacccaggaguccgagugcgucugcaucaacggcacgugcaccguggugaugaccgacggcagcgccuccgggcgggcggacaccaagauccuguucaucgaggagggcaagaucauccacaucucgcagcucagcggguccgcccagcacgucgaggagugcucgugcuacccccgcuaccccggcgugcggugcgugugccgcgacaacuggaagggcuccaaccggcccaucgucgacaucaacgugaaggacuacagcaucguguccucguacgucugcuccgggcuggugggcgacacgccgcgcaagaacgacagcuccucguccagccacugccugaaccccaacaacgaggagggcgggcacggggugaagggcugggccuucgacgacggcaacgacgucuggauggggcggaccaucuccgagaaguuccgcucgggcuacgagaccuucaaggugaucgaggggugguccaagcccaacagcaagcuccagaucaaccggcaggucaucguggaccgcgacaaccgguccggcuacucggggaucuucuccguggagggcaagagcugcaucaaccgcugcuucuacgucgagcugauccggggccgcaagcaggagaccgaggugugguggacgucgaacuccaucguggucuucugcgggaccagcggcaccuacgggaccggcuccuggcccgacggggccgacaucaaccugaugccgaucuga

SEQ ID NO: 16718 - RNA, 1410 nt, Artificial Sequence; identical to SEQ ID NO: 16681
  derived and/or modified CDS sequence (AUadapt) from InfluenzaA__AAY98399__NA

SEQ ID NO: 16719 - RNA, 1410 nt, Artificial Sequence; identical to SEQ ID NO: 16681
  derived and/or modified CDS sequence (AUadapt) from InfluenzaA__AAY98409__NA

SEQ ID NO: 16720 - RNA, 1410 nt, Artificial Sequence; identical to SEQ ID NO: 16681
  derived and/or modified CDS sequence (AUadapt) from InfluenzaA__AAY98773__NA

SEQ ID NO: 16721 - RNA, 1410 nt, Artificial Sequence
  derived and/or modified CDS sequence (AUadapt) from InfluenzaA__AAZ32955__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaucguccacgagcgcaccccguaccggacccugcucaugaacgagcugggcgugcccuuccaccugggcaccaagcaggucugcaucgccuggucguccagcuccugccacgacgggaaggccuggcuccacgugugcgugacgggcgacgacgagaacgcgaccgccucguucaucuacaacgggcgccugguggacuccaucgucagcugguccaagaagauccugcggacccaggagagcgagugcgugugcaucaacgggaccugcacgguggucaugaccgacggguccgccucgggcaaggccgacaccaagauccucuucaucgaggagggcaagaucgugcacaccagcacgcuguccgggucggcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcucgggccuggugggcgacacgccccgcaagaacgacuccagcuccucgucccacugccucgaccccaacaacgaggagggcggccacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaagcaggagaccgaggugcuguggaccuccaacagcaucgucguguucugcggcaccuccgggaccuacggcacggggagcuggccggacggcgccgacaucaaccugaugcccaucuga

SEQ ID NO: 16722 - RNA, 1344 nt, Artificial Sequence
  derived and/or modified CDS sequence (AUadapt) from InfluenzaA__AAZ32957__NA
augaaucccaaccagaagaucaucaccaucggcucggugucccugaccaucucgacgaucugcuucuucaugcagaucgccauccucaucaccaccgucacccugaucgagcgcaacaucacggagaucguguaccugaccaacaccaccaucgagaaggagaucugcccgaagcucgccgaguaccggaacugguccaagccccagugcaacaucacgggguucgcgcccuucagcaaggacaacuccauccgccugucggccggcggggacaucugggugacccgggagcccuaugucuccugcgacccggacaagugcuaccaguucgcccugggccaggggaccacccucaacaacgugcacucgaacgacacggugcacgaccgcacccccuaccggacccugcugaugaacgagcucggcguccccuuccaccugggcaccaagcaggucugcaucgccugguccagcuccucgugucacgacgggaaggccuggcugcacgugugcgugacgggcgacgacgagaacgcgaccgccuccuucaucuacaacgggcgccucguggacucgaucguguccuggagcaagaagauccugcggacccaggaguccgagugcgucugcaucaacgggaccugcacgguggugaugaccgacgggaacgccucgggcaaggccgacaccaagauccuguuuaucgaggagggcaagaucguccacaccuccacgcucucggggagcgcgcagcacguggaggagugcuccugcuacccccgcuacccgggcgugcggugcgucugccgcgacaacuggaaggggucgaaccggcccaucguggacaucaacaucaaggacuacuccaucgugucguccuacgucugcaguggccuggugggcgacacgccccgcaagaacgacuccucguccucgucccacugccuggaccccaacaacgaggagggcggccacggggugaagggcugggccuucgacgacgggaacgacgucuggaugggccggaccaucagcgagaagcuccgcuccggcuacgagaccuucaaggugaucgagggguggucgaacccgaauuccaagcugcagaucaaccggcaggucaucguggaccgcggcaaccggucgggguacuccggcaucuucagcguggaggggaaguccugcaucaaccgcugcuucuacgucgagcugauccggggccgcaagcaggagaccgaggugcucuggaccucgaacucgaucguggucuucugcggcaccuccgggaccuacggcacggggagcuggcccgacggcgccgacaucaaccugaugcccaucuga

SEQ ID NO: 16723 - RNA, 1344 nt, Artificial Sequence; identical to SEQ ID NO: 16722
  derived and/or modified CDS sequence (AUadapt) from InfluenzaA__AAZ32958__NA

SEQ ID NO: 16724 - RNA, 1344 nt, Artificial Sequence; identical to SEQ ID NO: 16722
  derived and/or modified CDS sequence (AUadapt) from InfluenzaA__AAZ32959__NA

SEQ ID NO: 16725 - RNA, 1410 nt, Artificial Sequence; identical to SEQ ID NO: 16686
  derived and/or modified CDS sequence (AUadapt) from InfluenzaA__AAZ38465__NA

SEQ ID NO: 16726 - RNA, 1410 nt, Artificial Sequence; identical to SEQ ID NO: 16686
  derived and/or modified CDS sequence (AUadapt) from InfluenzaA__AAZ38476__NA

SEQ ID NO: 16727 - RNA, 1410 nt, Artificial Sequence
  derived and/or modified CDS sequence (AUadapt) from InfluenzaA__AAZ38487__NA
augaaccccaaccagaagaucaucaccaucggcucggugucccugaccaucgccacgaucugcuuccucaugcagaucgccauccuggucaccaccgugacccugcacuucaagcaguacgagugcaacagccucccgaacaaccaggugaugcugugcgagcccacgauccuggagcgcaacaucaccgagaucgucuaccucaccaacaccacgaucgagaaggagaucugccccaagcuggcggaguaccggaacugguccaagccccagugcaagaucaccggguucgccccguucucgaaggacaacuccauccgccugagcgccggcggggacaucugggugacccgggagcccuacguguccugcgaccccgacaagugcuaccaguucgcccucggccaggggaccacgcugaacaaccgccacucgaacgacaccguccacgaccggacccccuaccgcacccugcucaugaacgagcugggcgugccguuccaccugggcacgaagcaggucugcaucgccugguccagcuccucgugccacgacgggaaggcguggcuccacgugugcgugaccggccacgacgagaacgccaccgccuccuucaucuacgggggccggcugguggacagcaucggguccuggucgaagaagauccugcgcacccaggaguccgagugcgucugcaucaacggcacgugcaccguggugaugaccgacggcagcgccuccgggcgggcggacaccaagauccucuucaucgaggagggcaagaucauccacaucucgcagcugagcggguccgcccagcacgucgaggagugcucgugcuacccccgcuaccccggcgugcggugcgugugccgcgacaacuggaagggcuccaaccggcccaucgucgacaucaacgugaaggacuacagcaucguguccucguacgucugcuccgggcuggugggcgacacgccgcgcaagaacgacagcuccucguccagcaacugccucaaccccaacaacgaggagggcgggcacggggugaagggcugggccuucgacgacggcaacgacgucuggauggggcggaccaucuccgagaaguuccgcucgggcuacgagaccuucaaggugaucgaggggugguccaagcccaacagcaagcugcagaucaaccggcaggucaucguggaccgcgacaaccgguccggcuacucggggaucuucuccguggagggcaagagcugcaucaaccgcugcuucuacgucgagcugauccggggccgcaagcaggagaccgaggugugguggacgucgaacuccaucguggucuucugcgggaccagcggcaccuacgggaccggcuccuggcccgacggggccgacaucaaccucaugccgaucuga

SEQ ID NO: 16728 - RNA, 1410 nt, Artificial Sequence
  derived and/or modified CDS sequence (AUadapt) from InfluenzaA__AAZ38509__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggucguccagcuccugccacgacgggaaggccuggcuccacgugugcgugaccggcgacgacaagaacgcgaccgccucguucaucuacaacgggcgccugguggacuccaucgucagcugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcucgggccuggugggcgacacgccccgcaagaacgacuccagcuccucgucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaacuccaacucgaagcugcagaucaaccgccaggugaucguggaccggggcaaccgguccggguacagcggcaucuucucggucgaggggaaguccugcaucaaccgcugcuucuacguggagcucauccggggccgcaaggaggagaccgaggugcuguggaccagcaacuccaucgucguguucugcggcaccagcgggacguacggcaccggguccuggcccgacggcgccgacaucaaccugaugccgaucuga

SEQ ID NO: 16729 - RNA, 1410 nt, Artificial Sequence
  derived and/or modified CDS sequence (AUadapt) from InfluenzaA__AAZ38586__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaaggagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 16730 - RNA, 1410 nt, Artificial Sequence; identical to SEQ ID NO: 16729
  derived and/or modified CDS sequence (AUadapt) from InfluenzaA__AAZ38597__NA

SEQ ID NO: 16731 - RNA, 1410 nt, Artificial Sequence
  derived and/or modified CDS sequence (AUadapt) from InfluenzaA__AAZ38608__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaugugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucucgugguccaagaagauccugcggacccaggagagcgagugcgugugcaucaacggcacgugcaccguggucaugaccgacggguccgccucgggcaaggccgacaccaagauccucuucaucgaggagggcaagaucauccacacgagcacccuguccgggucggcgcagcacguggaggagugcuccugcuacccccgcuaccccggcgugcggugcgucugccgcgacaacuggaaggggagcaaccggccgaucguggacaucaacaucaaggacuacuccaucgugucguccuacgucugcagcggccuggugggcgacacgccccgcaagaacgacuccucguccagcucccacugccucgaccccaacaacgaggagggcgggcacggggugaagggcugggccuucgacgacgggaacgacgucuggaugggccggaccaucucggagaagcugcgcuccggcuacgagaccuucaaggugaucgagggguggagcaagcccaacuccaagcugcagaucaaccggcaggucaucguggaccgcggcaaccggucgggguacuccggcaucuucagcguggagggcaagucgugcaucaaccgcugcuucuacgucgagcucauccgggggcgcaaggaggagaccgaggugcuguggaccuccaacagcaucguggucuucugcggcaccuccgggacguacggcaccgggagcuggccggacggcgccgacaccaaccugaugcccaucuga

SEQ ID NO: 16732 - RNA, 1410 nt, Artificial Sequence
  derived and/or modified CDS sequence (AUadapt) from InfluenzaA__AAZ38619__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaugugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaagaagauccugcggacccaggagucggagugcgugugcaucaacggcacgugcaccguggucaugaccgacggguccgccagcggcaaggccgacaccaagauccucuucaucgaggagggcaagaucauccacacgucgacccuguccgggagcgcgcagcacguggaggagugcuccugcuacccccgcuaccccggcgugcggugcgucugccgcgacaacuggaaggggucgaaccggccgaucguggacaucaacaucaaggacuacuccaucgugagcuccuacgucugcucgggccuggugggcgacacgccccgcaagaacgacuccagcuccagcucccacugccucgaccccaacaacgaggagggcgggcacggggugaagggcugggccuucgacgacgggaacgacgucuggaugggccggaccaucucggagaagcugcgcuccggcuacgagaccuucaaggugaucgagggguggagcaagcccaacuccaagcugcagaucaaccggcaggucaucguggaccgcggcaaccggucgggguacuccggcaucuucagcguggagggcaagucgugcaucaaccgcugcuucuacgucgagcucauccgggggcgcaaggaggagaccgaggugcuguggaccuccaacagcaucguggucuucugcggcaccuccgggacguacggcaccgggagcuggccggacggcgccgacaucaaccugaugcccaucuga

SEQ ID NO: 16733 - RNA, 1410 nt, Artificial Sequence; identical to SEQ ID NO: 16729
  derived and/or modified CDS sequence (AUadapt) from InfluenzaA__AAZ38641__NA

SEQ ID NO: 16734 - RNA, 1410 nt, Artificial Sequence; identical to SEQ ID NO: 16729
  derived and/or modified CDS sequence (AUadapt) from InfluenzaA__AAZ38653__NA

SEQ ID NO: 16735 - RNA, 1410 nt, Artificial Sequence; identical to SEQ ID NO: 16520
  derived and/or modified CDS sequence (AUadapt) from InfluenzaA__AAZ43386__NA

SEQ ID NO: 16736 - RNA, 1410 nt, Artificial Sequence
  derived and/or modified CDS sequence (AUadapt) from InfluenzaA__AAZ43397__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucgagcgcaacaucaccgagaucgucuaccugaccaacaccacgaucgagcgggagaucugccccaagcuggcggaguaccgcaacugguccaagccgcagugcaacaucaccggguucgcccccuucagcaaggacaacuccauccggcucucggccggcggggacaucugggugacccgcgagcccuacguguccugcgaccccgacaagugcuaccaguucgcccugggccaggggaccacgcugaacaacggccacucgaacgacaccguccacgaccggaccccguaccgcacccuccugaugaacgagcugggcgugcccuuccaccucgggacgcgccaggugugcaucgccugguccagcuccucgugccacgacggcaaggcguggcugcacgucugcgugaccggggacgacaagaacgccaccgccuccuucaucuacaacggccggcugguggacucgaucggguccuggagcaagaagauccuccggacccaggaguccgagugcgucugcaucaacggcacgugcaccguggugaugaccgacggcucggccuccgggaaggcggacaccaagauccuguucaucgaggagggcaagaucguccacaucucgacgcugagcggguccgcccagcacguggaggagugcucgugcuacccccgcuaccccggcgugcggugcgucugccgcgacaacuggaagggcuccaaccggccgaucguggacaucaacgugaaggacuacucgaucgucuccagcuacgugugcuccgggcucgugggcgacacgccccgcaagaacgacucguccucguccagccacugccuggaccccaacaacgaggagggcgggcacggggucaagggcugggccuucgacgacggcaacgacguguggauggggcggaccaucuccgagaagcugcgcucgggcuacgagaccuucaaggucaucgaggggugguccaagcccaacucgaagcuccagaccaaccgccaggugaucguggagcggggcaaccgguccggguacagcggcaucuucuccgucgagggcaagucgugcaucaaccgcugcuucuacguggagcugauccgggggcgcaaggaggagaccgaggugugguggaccucgaacuccaucgucguguucugcggcaccagcgggacguacggcaccggguccuggccggacggcgccgacaucaaccugaugcccaucuga

SEQ ID NO: 16737 - RNA, 1410 nt, Artificial Sequence
  derived and/or modified CDS sequence (AUadapt) from InfluenzaA__AAZ43408__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaugaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccucguccagcugccacgacggcaaggcguggcugcacgugugcgugaccggggacgacgagaacgccaccgccuccuucaucuacaacggccgccugguggacucgaucggguccuggucgaagaagauccuccggacccaggaguccgagugcgucugcaucaacggcacgugcaccguggugaugaccgacggcagcgccuccgggaaggcggacaccaagauccuguucaucgaggagggcaagaucguccacacgucgagccuguccgggucggcccagcacguggaggagugcuccugcuacccccgcuaccccggcgugcggugcgucugccgcgacaacuggaagggcagcaaccggccgaucguggacaucaacgugaaggacuacuccaucgucucguccuacgugugcagcgggcucgugggcgacacgccccgcaagaacgacuccucguccucgucccacugccuggaccccaacaacgaggagggcgggcacggggucaagggcugggccuucgacgacggcaacgacguguggauggggcggaccaucagcgagaagcugcgcuccggcuacgagaccuucaaggucaucgagggguggucgaagcccaacuccaagcuccagaucaaccgccaggugaucguggaccggggcaaccggagcggguacuccggcaucuucucggucgagagcaaguccugcaucaaccgcugcuucuacguggagcugauccggggccgcaagcaggagaccgaggugcuguggaccucgaacuccaucgucguguucugcgggaccagcggcaccuacgggacgggcuccuggccggacggggccgacaucaaccucaugcccaucuga

SEQ ID NO: 16738 - RNA, 1410 nt, Artificial Sequence
  derived and/or modified CDS sequence (AUadapt) from InfluenzaA__AAZ74355__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggcgaugcccugcgagcccgccaucaucgagcgcaacacgaccgagaccguguaccucaccaacacgaccaucgagaaggagaucugcccgaagcuggccgaguaccggaacugguccaagccccagugcaacaucaccggguucgcccccuucucgaaggacaacuccauccgccugagcgccggcggggacaucugggucacccgggagcccuacguguccugcgacccggacaagugcuaccaguucgcgcucggccaggggacgacccugaacaacggccacucgaacgacaccgugcacgaccgcacccccuaccggacgcugcucaugaacgagcugggcguccccuuccaccuggggacccgccaggugugcaucgccugguccucguccucgugccacgacggcaaggccuggcuccacgugugcgucaccggggacgacgagaacgccaccgcguccuucaucuacaacggccggcugguggacagcaucggguccuggucgaagaagauccugcgcacgcaggaguccgagugcgugugcaucaacgggaccugcaccgucgugaugaccgacggcucggccuccgggaaggccgacacgaagauccucuucaucgaggagggcaagaucgugcacaucucgacccugagcggguccgcccagcacgucgaggagugcucgugcuacccccgguacccgggcgugcgcugcgugugccgggacaacuggaagggcuccaaccgccccaucgucgacaucaacgugaaggacuacucgaucguguccucguacgucugcuccgggcuggugggcgacacgccccggaagaacgacagcuucuccucgucccacugccucgaccccaacaacgaggagggcggccacggggugaagggcugggccuucgacgacggcaacgacgucuggauggggcgcaccaucucggagaagcugcgguccggcuacgagaccuucaaggugaucgagggguggucgaagccgaacuccaagcugcagaucaaccgccaggucaucguggagcggggcaaccgcagcggguacuccggcaucuucucgguggagggcaaguccugcaucaaccggugcuucuacgucgagcucauccgcgggcggaaggaggagaccgaggugugguggaccucgaacucgaucguggucuucugcggcaccuccgggacguacggcaccgggagcuggcccgacggcgcggacaucaaccugaugcccaucuga

SEQ ID NO: 16739 - RNA, 1410 nt, Artificial Sequence
  derived and/or modified CDS sequence (AUadapt) from InfluenzaA__AAZ74366__NA
augaaccccaaccagaagaucaucaccaucggcucggugucccugaccaucgccacgaucugcuuccucaugcagaucgccauccuggucaccaccgugacccugcacuucaagcaguacgagugcaacagccucccgaacaaccaggugaugcugugcgagcccacgaucaucgagcgcaacaucaccgagaucgucuaccugaccaacaccacgaucgagaaggagaucugccccaagcucgcggaguaccggaacugguccaagccccagugcaagaucaccggguucgccccguucucgaaggacaacuccauccgccugagcgccggcggggacaucugggugacccgggagcccuacguguccugcgaccccgacaagugcuaccaguucgcccugggccaggggaccacgcucaacaaccgccacucgaacgacaccguccacgaccggacccccuaccgcacccugcugaugaacgagcucggcgugccguuccaccugggcacgaagcaggucugcaucgccugguccagcuccucgugccacgacgggaaggcguggcugcacgugugcgugaccggccacgacgagaacgccaccgccuccuucaucuacgacgggcggcucguggacagcaucggcuccuggucgaagaagauccugcgcacccaggaguccgagugcgucugcaucaacgggacgugcaccguggugaugaccgacggcagcgccuccggcaaggcggacaccaagauccuguucaucgaggaggggaagaucauccacaucucgcagcucagcggcuccgcccagcacgucgaggagugcucgugcuacccccgguaccccggggugcgcugcgugugccgggacaacuggaagggcuccaaccgccccaucgucgacaucaacgugaaggacuacagcaucguguccucguacgucugcuccggccuggugggggacacgccgcggaagaacgacagcuccucguccagccacugccugaaccccaacaacgaggagggcgggcacggcgugaaggggugggccuucgacgacggcaacgacgucuggaugggccgcaccaucuccgagaaguuccggucgggguacgagaccuucaaggugaucgagggcugguccaagcccaacagcaagcuccagaucaaccgccaggucaucguggacaaggacaaccgguccggguacucgggcaucuucuccguggagggcaagagcugcaucaaccgcugcuucuacgucgagcugauccgggggcgcaagcaggagaccgaggugugguggacgucgaacuccaucguggucuucugcggcaccagcgggaccuacggcaccggguccuggcccgacggcgccgacaucaaccugaugccgaucuga

SEQ ID NO: 16740 - RNA, 1410 nt, Artificial Sequence
  derived and/or modified CDS sequence (AUadapt) from InfluenzaA__AAZ74377__NA
augaaccccaaccagaagaucaucaccaucggcucggugucccugaccaucgccacgaucugcuuccucacccagaucgccauccuggucaccaccgugacgcugcacuucaagcaguacgagugcaacucgccgcccaacaaccaggugaugcucugcgagcccaccaucaucgagcgcaacaucaccgagaucgucuaccugaccaacacgaccaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggacgacccugaacaacggccacucgaacgacaccguccacgaccgcaccccguaccggacgcuccugaugaacgagcugggcgugcccuuccaccucgggaccaagcaggucugcaucgccugguccagcuccucgugccacgacggcaaggcguggcugcacgugugcgugaccggggacgacaagaacgccaccgccuccuucaucuacaacggccgccugguggacucgaucggguccuggagcaagaagauccuccggacgcaggaguccgagugcgucugcaucaacgggaccugcaccguggugaugaccgacggcucggccuccgggaaggcggacacgaagauccuguucaucgaggagggcaagaucguccacaccucgcugcucagcggguccgcccagcacguggaggagugcucgugcuacccccgcuaccccggcgugcggugcgucugccgcgacaacuggaagggcuccaaccggccgaucguggacaucaacgugaaggacuacucgaucgucuccagcuacgugugcuccgggcuggugggcgacacgccccgcaagaacgacucguccucguccagccacugccuggaccccaacaacgaggagggcggccacggggucaagggcugggccuucgacgacggcaacgacguguggauggggcggaccauccgcgagaagcuccgguccggcuacgagaccuucaaggucaucgagggguggucgaagcccaacuccaagcugcagaucaaccgccaggugaucguggaccgggacaaccgcucgggcuacuccgggaucuucagcgucgagggcaaguccugcaucaaccggugcuucuacguggagcugauccgcggccggaaccaggagaccgaggugcucuggaccucgaacucgaucgucguguucugcgggaccuccggcacguacgggaccggcagcuggccggacggggccgacaucaaccugaugcccaucuga

SEQ ID NO: 16741 - RNA, 1410 nt, Artificial Sequence
  derived and/or modified CDS sequence (AUadapt) from InfluenzaA__AAZ74400__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccgacaagugcuaccaguucgcccugggccaggggaccacgcugaacaaccgccacucgaacgacaccguccacgaccggaccccguaccgcacccuccugaugaacgagcugggcgugcccuuccaccucggcacgaagcaggucugcaucgccugguccagcuccucgugccacgacgggaaggcguggcugcacgugugcgugaccggccacgacgagaacgccaccgccucccugaucuacgacgggcggcucguggacucgaucggcuccuggagcaagaagauccugcgcacccaggaguccgagugcgucugcaucaacgggacgugcaccguggugaugaccgacggcucggccuccggccgggcggacaccaagauccuguucaucgaggaggggaagaucguccacacgucgaagcucagcggcuccgcccagcacguggaggagugcucgugcuacccccgcuaccccggggugcggugcgucugccgcgacaacuggaagggcuccaaccggccgaucguggacaucaacgugaaggacuacagcaucgucuccucguacgugugcuccggccuggugggggacacgccccgcaagaacgacucguccagcuccucgcacugccuggaccccaacaacgaggagggcgggcacggcgucaaggggugggccuucgacgacggcaacgacguguggaugggccggaccaucuccgagaagucccgcucgggguacgagaccuucaaggucaucgagggcuggagcaagcccaacuccaagcuccagaucaaccgccaggugaucguggagcgggggaacaugucgggcuacuccgggaucuucucggucgagggcaagagcugcaucaaccggugcuucuacguggagcugauccgcggccggaagcaggagaccgaggugugguggaccuccaacucgaucgucguguucugcgggaccuccggcaccuacgggacgggcagcuggccggacggggccgacaucaaccugaugcccaucuga

SEQ ID NO: 16742 - RNA, 1410 nt, Artificial Sequence; identical to SEQ ID NO: 16681
  derived and/or modified CDS sequence (AUadapt) from InfluenzaA__AAZ74411__NA

SEQ ID NO: 16743 - RNA, 1410 nt, Artificial Sequence
  derived and/or modified CDS sequence (AUadapt) from InfluenzaA__AAZ74422__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggucgaagccccagugcgacaucaccggguucgcgcccuucuccaaggacaacagcauccgccuguccgccggcggggacaucugggucacccgggagcccuacgugucgugcgacccggacaagugcuaccaguucgcccugggccaggggaccacgcucaacaacgugcacuccaacgacaccguccacgaccgcacccccuaccggacccugcugaugaacgagcucggcgugcccuuccaccugggcacgaagcaggucugcaucgccuggagcuccucguccugccacgacgggaaggccuggcugcacgugugcgugaccggcgacgacaagaacgcgaccgccagcuucaucuacaacgggcgccucguggacuccaucgucucgugguccaaggagauccugcggacccaggagagcgagugcgugugcaucaacggcacgugcgccguggucaugaccgacggguccgccucgggcaaggcggacaccaagauccuguucaucgaggagggcaagaucgugcacaccagcaagcucuccgggucggcccagcacguggaggagugcuccugcuacccccgcuacccgggcauccggugcgucugccgcgacaacuggaaggggagcaaccggcccaucguggacaucaacaucaaggacuacuccaucgugucguccuacgucugcagcggccuggugggcgacacgccccgcaagaacgacuccucguccagcucccacugccuggaccccaacaacgaggagggcgggcacggggugaagggcugggccuucgacgacgggaacgacgucuggaugggccggaccaucucggagaagcuccgcuccggcuacgagaccuucaaggugaucgagggguggagcaacccgaacuccaagcugcagaucaaccggcaggucaucguggaccgcggcaaccggucgggguacuccggcaucuucagcguggagggcaagucgugcaucaaccgcugcuucuacgucgagcugauccgggggcgcaaggaggagaccgaggugcucuggacguccaacagcaucguggucuucugcggcaccuccgggaccuacggcaccgggagcuggcccgacggcgccgacaucaaccugaugcccaucuga

SEQ ID NO: 16744 - RNA, 1410 nt, Artificial Sequence; identical to SEQ ID NO: 16729
  derived and/or modified CDS sequence (AUadapt) from InfluenzaA__AAZ74444__NA

SEQ ID NO: 16745 - RNA, 1410 nt, Artificial Sequence
  derived and/or modified CDS sequence (AUadapt) from InfluenzaA__AAZ74455__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccucguucaucuacaacgggcgccugguggacuccaucgucagcugguccaaggacauccugcggacccaggagucggagugcgugugcaucaacggcacgugcaccguggucaugaccgacggguccgccagcggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggacuacuccaucgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucagcgagaagcugcgccugggcuacgagaccuucaaggucaucgaggggugguccaaccccaacucgaagcuccagaucaaccgccaggugaucguggagcggggcaaccgguccggguacagcggcaucuucuccgucgagggcaagucgugcaucaaccgcugcuucuacguggagcugauccgggggcgcaaggaggagaccgaggugcuguggaccagcaacuccaucgucguguucugcggcaccagcgggacguacggcaccggguccuggccggacggcgccgacaucaaccucaugcccaucuga

SEQ ID NO: 16746 - RNA, 1410 nt, Artificial Sequence; identical to SEQ ID NO: 16729
  derived and/or modified CDS sequence (AUadapt) from InfluenzaA__AAZ74477__NA

SEQ ID NO: 16747 - RNA, 1410 nt, Artificial Sequence; identical to SEQ ID NO: 16745
  derived and/or modified CDS sequence (AUadapt) from InfluenzaA__AAZ74488__NA

SEQ ID NO: 16748 - RNA, 1410 nt, Artificial Sequence
  derived and/or modified CDS sequence (AUadapt) from InfluenzaA__AAZ74499__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaaggagauccugcggacccaggagucggagugcgugugcaucaacggcacgugcgccguggucaugaccgacggguccgccagcggcaaggcggacaccaagauccucuucaucgaggagggcaagaucgugcacaccucgaagcuguccgggagcgcccagcacguggaggagugcuccugcuacccccgcuaccccggcauccggugcgucugccgcgacaacuggaaggggucgaaccggccgaucguggacaucaacaucaaggacuacuccaucgugagcuccuacgucugcucgggccuggugggcgacacgccccgcaagaacgacuccagcuccagcucccacugccucgaccccaacaacgaggagggcgggcacggggugaagggcugggccuucgacgacgggaacgacgucuggaugggccggaccaucucggagaagcugcgcuccggcuacgagaccuucaaggugaucgagggguggagcaaccccaacuccaagcugcagaucaaccggcaggucaucguggaccgcggcaaccggucgggguacuccggcaucuucagcguggagggcaagucgugcaucaaccgcugcuucuacgucgagcucauccgggggcgcaaggaggagaccgaggugcuguggacguccaacagcaucguggucuucugcggcaccuccgggaccuacggcaccgggagcuggccggacggcgccgacaucaaccugaugcccaucuga

SEQ ID NO: 16749 - RNA, 1410 nt, Artificial Sequence; identical to SEQ ID NO: 16745
  derived and/or modified CDS sequence (AUadapt) from InfluenzaA__AAZ74510__NA

SEQ ID NO: 16750 - RNA, 1410 nt, Artificial Sequence; identical to SEQ ID NO: 16748
  derived and/or modified CDS sequence (AUadapt) from InfluenzaA__AAZ74521__NA

SEQ ID NO: 16751 - RNA, 1410 nt, Artificial Sequence
  derived and/or modified CDS sequence (AUadapt) from InfluenzaA__AAZ74532__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucucgugguccaaggacauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggaacgcgcagcacguggaggagugcagcugcuacccccgcuaccccggcguccggugcgugugccgcgacaacuggaagggguccaaccggccgaucguggacaucaacaucaaggacuacucgaucgucuccagcuacgugugcuccggccuggugggcgacacgccccgcaagaacgacucguccagcuccucgcacugccucgaccccaacaacgaggagggcgggcacggggucaagggcugggccuucgacgacgggaacgacguguggaugggccggaccaucuccgagaagcugcgccugggcuacgagaccuucaaggucaucgagggguggagcaaccccaacuccaagcuccagaucaaccgccaggugaucguggagcggggcaaccggucgggguacuccggcaucuucagcgucgaggggaaguccugcaucaaccgcugcuucuacguggagcugauccggggccgcaaggaggagaccgaggugcuguggaccucgaacagcaucgucguguucugcggcaccuccgggacguacggcaccgggagcuggccggacggcgccaacaucaaccucaugcccaucuga

SEQ ID NO: 16752 - RNA, 1410 nt, Artificial Sequence; identical to SEQ ID NO: 16729
  derived and/or modified CDS sequence (AUadapt) from InfluenzaA__AAZ74543__NA

SEQ ID NO: 16753 - RNA, 1410 nt, Artificial Sequence; identical to SEQ ID NO: 16681
  derived and/or modified CDS sequence (AUadapt) from InfluenzaA__AAZ74565__NA

SEQ ID NO: 16754 - RNA, 1410 nt, Artificial Sequence; identical to SEQ ID NO: 16729
  derived and/or modified CDS sequence (AUadapt) from InfluenzaA__AAZ74598__NA

SEQ ID NO: 16755 - RNA, 1410 nt, Artificial Sequence
  derived and/or modified CDS sequence (AUadapt) from InfluenzaA__AAZ74609__NA
augaaccccaaccagaagaucaucaccaucggcucggugucccugaccaucgccacgaucugcuuccucaugcagaucgccauccuggucaccaccgugacccugcacuucaagcaguacgagugcaacagcccgcccaacaaccaggugaugcucugcgagcccaucaucaucgagcgcaacaucacggagaucgucuaccugaccaacaccaccaucgagaaggagaucugccccaagcuggcggaguaccggaacugguccaagccgcagugcaagaucacgggguucgcccccuucucgaaggacaacuccauccgccucagcgccggcggggacaucugggugacccgggagcccuacguguccugcgaccccgacaagugcuaccaguucgcccugggccaggggaccacccugaacaaccgccacucgaacgacacgguccacgaccggaccccguaccgcacccuccugaugaacgagcugggcgugcccuuccaccucggcaccaagcaggucugcaucgccugguccagcuccucgugccacgacgggaaggcguggcugcacgugugcgugacgggccacgacgagaacgccaccgccuccuucaucuacgacgggcggcugguggacagcaucuccucgugguccaagaacauccuccgcacccaggagagcgagugcgucugcaucaacgggaccugcacgguggugaugaccgacggguccgccucggagcgggcggacaccaagauccuguucaucgaggagggcaagaucguccacaucagcccccuguccggcucggcccagcacguggaggagugcuccugcuacccccgcuacccgggggugcggugcgucugccgcgacaacuggaagggcagcaaccggcccaucguggacaucaacgugaaggacuacuccaucgucucguccuacgugugcagcgggcucgugggcgacacgccccgcaagaacgacuccucguccagcuccuacugccugaaccccaacaacgaggagggcgggcacggcgucaaggggugggccuucgacgacggcaacgacguguggauggggcggaccaucucggagaagcugcgcuccggcuacgagaccuucaaggucaucggcggguggagcaagccgaacuccaagcuccagaucaaccgccaggugaucguggaccggggcaaccggucgggguacuccggcaucuucagcgucgagggcaagucgugcgugaaccgcugcuucuacguggagcugauccggggccgcaagcaggagaccgaggucugguggaccuccaacagcaucgugguguucugcggcacguccgggaccuacggcaccgggagcuggcccgacggcgccgacaucaaccugaugcccaucuga

SEQ ID NO: 16756 - RNA, 1410 nt, Artificial Sequence; identical to SEQ ID NO: 16463
  derived and/or modified CDS sequence (AUadapt) from InfluenzaA__AAZ74620__NA

SEQ ID NO: 16757 - RNA, 1410 nt, Artificial Sequence; identical to SEQ ID NO: 16575
  derived and/or modified CDS sequence (AUadapt) from InfluenzaA__AAZ79508__NA

SEQ ID NO: 16758 - RNA, 1410 nt, Artificial Sequence
  derived and/or modified CDS sequence (AUadapt) from InfluenzaA__AAZ79519__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgauccuggagcgcaacaucaccgagaucgucuaccugaccaacaccacgaucgagaaggagaucugccccaagcucgcggaguaccggaacugguccaagccgcagugcaagaucaccggguucgcccccuucagcaaggacaacuccauccgccugucggccggcggggacaucugggugacccgggagcccuacguguccugcgaccccgacaagugcuaccaguucgcccugggccaggggaccacgcucaacaaccgccacagcaacgacaccguccacgaccggaccccguaccgcacccugcugaugaacgagcucggcgugcccuuccaccugggcacgaagcaggucugcaucgccugguccucguccagcugccacgacgggaaggcguggcugcacgugugcgugaccggccacgacaagaacgccaccgccuccuucaucuacgggggccggcucguggacucgaucggguccuggagcaagaagauccugcgcacccaggaguccgagugcgucugcaucaacggcacgugcaccguggugaugaccgacggcucggccuccgggcgggcggacaccaagauccuguucaucgaggagggcaagaucauccacaucagccagcucucgggguccgcccagcacgucgaggagugcucgugcuacccccgcuaccccggcgugcggugcgugugccgcgacaacuggaagggcuccaaccggccgaucgucgacaucaacgugaaggacuacagcaucguguccucguacgucugcuccgggcuggugggcgacacgccccgcaagaacgacagcuccucguccagccacugccugaaccccaacaacgaggagggcgggcacggggugaagggcugggccuucgacgacggcaacgacgucuggauggggcggaccaucuccgagaaguuccgcucgggcuacgagaccuucaaggugaucgagggguggucccggcccaacagcaagcuccagaucaaccgccaggucaucguggaccgggacaaccgcuccggcuacucggggaucuucuccguggagggcaagagcugcaucaaccggugcuucuacgucgagcugauccgcggccgcaagcaggagaccgaggugugguggacgucgaacuccaucguggucuucugcgggaccagcggcaccuacgggaccggcuccuggccggacggggccgacaucaaccugaugcccaucuga

SEQ ID NO: 16759 - RNA, 1410 nt, Artificial Sequence; identical to SEQ ID NO: 16539
  derived and/or modified CDS sequence (AUadapt) from InfluenzaA__AAZ79530__NA

SEQ ID NO: 16760 - RNA, 1410 nt, Artificial Sequence
  derived and/or modified CDS sequence (AUadapt) from InfluenzaA__AAZ79552__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacucgaacgacaccguccacgaccgcaccccgcaccggacccuccugaugaacgagcugggcgugcccuuccaccucgggacgaagcaggucugcaucgccugguccagcuccucgugccacgacggcaaggcguggcugcacgugugcgugaccggggacgacaagaacgccaccgccuccuucaucuacaacggccgccugguggacagcaucggguccuggucgaagaagauccuccggacccaggaguccgagugcgucugcaucaacggcacgugcaccguggugaugaccgacggcucggccuccgggaaggcggacaccaagauccuguucaucgaggagggcaagaucguccacacgagccugcucucgggguccgcccagcacguggaggagugcucgugcuacccccgcuaccccggcgugcggugcgucugccgcgacaacuggaagggcuccaaccggccgaucguggacaucaacgugaaggacuacagcaucgucuccucguacgugugcuccgggcuggugggcgacacgccccgcaagaacgacagcuccucguccucgcacugccuggaccccaacaacgaggagggcgggcacggggucaagggcugggccuucgacgacggcaacgacguguggauggggcggaccaucuccgagaagcuccgcagcggcuacgagaccuucaaggucaucgaggggugguccaagcccaacucgaagcugcagaucaaccgccaggugaucguggaccgggacaaccgguccggcuacucggggaucuucuccgucgagggcaagagcugcaucaaccgcugcuucuacguggagcugauccggggccgcaaccaggagaccgaggugcucuggaccucgaacuccaucgucguguucugcgggaccagcggcaccuacgggacgggcuccuggccggacggggccgacaucaaccugaugcccaucuga

SEQ ID NO: 16761 - RNA, 1410 nt, Artificial Sequence; identical to SEQ ID NO: 16681
  derived and/or modified CDS sequence (AUadapt) from InfluenzaA__AAZ79563__NA

SEQ ID NO: 16762 - RNA, 1410 nt, Artificial Sequence; identical to SEQ ID NO: 16681
  derived and/or modified CDS sequence (AUadapt) from InfluenzaA__AAZ79574__NA

SEQ ID NO: 16763 - RNA, 1410 nt, Artificial Sequence; identical to SEQ ID NO: 16681
  derived and/or modified CDS sequence (AUadapt) from InfluenzaA__AAZ79585__NA

SEQ ID NO: 16764 - RNA, 1410 nt, Artificial Sequence; identical to SEQ ID NO: 16748
  derived and/or modified CDS sequence (AUadapt) from InfluenzaA__AAZ79618__NA

SEQ ID NO: 16765 - RNA, 1410 nt, Artificial Sequence; identical to SEQ ID NO: 16729
  derived and/or modified CDS sequence (AUadapt) from InfluenzaA__AAZ79633__NA

SEQ ID NO: 16766 - RNA, 1410 nt, Artificial Sequence; identical to SEQ ID NO: 16748
  derived and/or modified CDS sequence (AUadapt) from InfluenzaA__AAZ79945__NA

SEQ ID NO: 16767 - RNA, 1410 nt, Artificial Sequence; identical to SEQ ID NO: 16745
  derived and/or modified CDS sequence (AUadapt) from InfluenzaA__AAZ79966__NA

SEQ ID NO: 16768 - RNA, 1410 nt, Artificial Sequence; identical to SEQ ID NO: 16729
  derived and/or modified CDS sequence (AUadapt) from InfluenzaA__AAZ79977__NA

SEQ ID NO: 16769 - RNA, 1410 nt, Artificial Sequence; identical to SEQ ID NO: 16729
  derived and/or modified CDS sequence (AUadapt) from InfluenzaA__AAZ79988__NA

SEQ ID NO: 16770 - RNA, 1410 nt, Artificial Sequence
  derived and/or modified CDS sequence (AUadapt) from InfluenzaA__AAZ79999__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccagaugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggugacccgggagcccuacgucucgugcgaccccgacaagugcuaccaguucgcccucggccaggggaccacgcugaacaacgugcacuccaacgacaccgugcacgaccgcaccccguaccggacccugcucaugaacgagcugggcguccccuuccaccugggcacgaagcaggucugcaucgccuggagcuccagcuccugccacgacgggaaggccuggcuccacgugugcgugaccggcgacgacaagaacgcgaccgccucguucaucuacaacgggcgccugguggacuccaucgugagcugguccaaggacauccugcggacccaggagucggagugcgucugcaucaacggcacgugcaccguggugaugaccgacggguccgccagcggcaaggccgacaccaagauccucuucaucgaggagggcaagaucguccacacgagcacccuguccgggucggcgcagcacguggaggagugcuccugcuacccccgcuaccccggcgugcggugcgucugccgcgacaacuggaaggggagcaaccggccgaucguggacaucaacaucaaggacuacuccaucgugucguccuacgucugcagcggccuggugggcgacacgccccgcaagaacgacuccucguccagcucccacugccucgaccccaacaacgaggagggcgggcacggggugaagggcugggccuucgacgacgggaacgacgucuggaugggccggaccaucagcgagaagcugcgccugggcuacgagaccuucaaggugaucgaggggugguccaaccccaacucgaagcuccagaucaaccggcaggucaucguggagcgcggcaaccgguccggguacagcggcaucuucuccguggagggcaagucgugcaucaaccgcugcuucuacgucgagcugauccgggggcgcaaggaggagaccgaggugcuguggaccagcaacuccaucguggucuucugcggcaccagcgggacguacggcaccggguccuggccggacggcgccgacaucaaccucaugcccaucuga

SEQ ID NO: 16771 - RNA, 1410 nt, Artificial Sequence; identical to SEQ ID NO: 16517
  derived and/or modified CDS sequence (AUadapt) from InfluenzaA__AAZ80010__NA

SEQ ID NO: 16772 - RNA, 1410 nt, Artificial Sequence
  derived and/or modified CDS sequence (AUadapt) from InfluenzaA__AAZ80021__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcggcugguggacuccaucgucagcugguccaaggagauccugcgcacccaggagucggagugcgugugcaucaacggcacgugcgccguggucaugaccgacggguccgccagcggcaaggcggacaccaagauccucuucaucgaggagggcaagaucgugcacaccucgaagcuguccgggagcgcccagcacguggaggagugcuccugcuacccccgguaccccggcauccgcugcgucugccgggacaacuggaaggggucgaaccgcccgaucguggacaucaacaucaaggacuacuccaucgugagcuccuacgucugcucgggccuggugggcgacacgccccggaagaacgacuccagcuccagcucccacugccucgaccccaacaacgaggagggcgggcacggggugaagggcugggccuucgacgacgggaacgacgucuggaugggccgcaccaucucggagaagcugcgguccggcuacgagaccuucaaggugaucgagggguggagcaaccccaacuccaagcugcagaucaaccgccaggucaucguggaccggggcaaccgcucgggguacuccggcaucuucagcguggagggcaagucgugcaucaaccggugcuucuacgucgagcucauccgcgggcggaaggaggagaccgaggugcuguggacguccaacagcaucguggucuucugcggcaccuccgggaccuacggcaccgggagcuggccggacggcgccgacaucaaccugaugcccaucuga

SEQ ID NO: 16773 - RNA, 1410 nt, Artificial Sequence
  derived and/or modified CDS sequence (AUadapt) from InfluenzaA__AAZ83245__NA
augaaccccaaccagaagaucaucaccaucggcucggugucccugaccaucagcacgaucugcuucuucaugcagaucgccauccucaucaccaccgucacccugcacuucaagcaguacgaguucaacccgccgcccaacaaccaggugaugcugugcgagcccacgaucaucgagcgcaacaucaccgagaucguguaccucaccaacaccacgaucgagaaggagaucugccccaagcuggccgaguaccggaacugguccaagccccagugcaacaucaccggguucgcgcccuucucgaaggacaacuccauccgccugagcgccggcggggacaucugggucacccgggagcccuacguguccugcgacccggacaagugcuaccaguucgcccucggccaggggaccacgcugaacaacgugcacucgaacgacaccguccacgaccgcacccccuaccggacccugcucaugaacgagcugggcgugcccuuccaccugggcacgaagcaggucugcaucgccugguccagcuccucgugccacgacgggaaggccuggcuccacgugugcgugaccggcgacgacgagaacgcgaccgccuccuucaucuacaacgggcgccugguggacagcaucgucuccuggucgaagaagauccugcggacccaggaguccgagugcgugugcaucaacggcacgugcaccguggucaugaccgacgggagcgccuccggcaaggccgacaccaagauccucuucaucgaggagggcaagaucgugcacacgucgacccugagcggguccgcgcagcacguggaggagugcagcugcuacccccgcuacccgggcguccggugcgugugccgcgacaacuggaagggguccaaccggcccaucguggacaucaacaucaaggacuacucgaucgucuccagcuacgugugcuccggccuggugggcgacacgccccgcaagaacgacucguccagcuccucgcacugccucgaccccaacaacgaggagggcgggcacggggucaagggcugggccuucgacgacgggaacgacguguggaugggccggaccaucuccgagaagcugcgcagcggcuacgagaccuucaaggucaucgaggggugguccaacccgaacucgaagcugcagaucaaccgccaggugaucguggaccgggacaaccgguccggcuacagcgggaucuucuccgucgagggcaagucgugcaucaaccgcugcuucuacguggagcucauccgggggcgcaaccaggagaccgaggugcuguggaccagcaacuccaucgucguguucugcggcaccagcggcacguacgggaccggcuccuggcccgacggggccgacaucaaccugaugcccaucuga

SEQ ID NO: 16774 - RNA, 1413 nt, Artificial Sequence
  derived and/or modified CDS sequence (AUadapt) from InfluenzaA__AAZ83256__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagucggagugcgugugcgugaacggcuccugcuucaccaucaugacggacgggcccagcaacggcgccgccuccuacaagaucuucaagaucgagaaggggaaggucaccaagucgaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcucgggcguguucggggacaacccccgccccaaggacggcaagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccgacaccgacagcgacuucuccgucaagcaggacgugguggccaucacggacuggucgggguacagcggcuccuucguccagcaccccgagcucaccggccuggacugcauccgccccugcuucuggguggagcugguccgggggcucccgcgcgagaacaccaccaucuggacgucgggcuccagcaucuccuucugcgggaucgacagcgacaccgccaacugguccuggcccgacggcgccgagcugcccuucaccaucgacaaguga

SEQ ID NO: 16775 - RNA, 1410 nt, Artificial Sequence; identical to SEQ ID NO: 16681
  derived and/or modified CDS sequence (AUadapt) from InfluenzaA__AAZ83269__NA

SEQ ID NO: 16776 - RNA, 1410 nt, Artificial Sequence; identical to SEQ ID NO: 16681
  derived and/or modified CDS sequence (AUadapt) from InfluenzaA__AAZ83280__NA

SEQ ID NO: 16777 - RNA, 1410 nt, Artificial Sequence; identical to SEQ ID NO: 16655
  derived and/or modified CDS sequence (AUadapt) from InfluenzaA__AAZ83291__NA

SEQ ID NO: 16778 - RNA, 1413 nt, Artificial Sequence
  derived and/or modified CDS sequence (AUadapt) from InfluenzaA__AAZ83302__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcgugugcaaccagcgcaucaucaccuacgagaacuccaccugggucaaccacaccuacgugaacaucaacaacacgaacgugaucgcggggaaggacaaggccucggucacccuggccggcaacuccagccugugcuccaucucgggcugggccaucuacaccaaggacaacuccauccggaucgggagcaagggcgacguguucgugauccgcgagccguucaucuccugcagccacuccgagugccggaccuucuuccucacgcagggggcccugcugaacgacaagcacucgaacggcaccgucaaggaccgcucccccuaccgggcgcucaugagcugcccccugggggaggcccccucgccguacaacuccaaguucgagagcguggccugguccgccucggcgugccacgacggcaugggcuggcugaccaucgggaucuccggccccgacaacggggccguggccguccucaaguacaacggcaucaucaccgagacgaucaagagcuggaagaagcagauccugcgcacccaggaguccgagugcgugugcgugaacggcucgugcuucaccaucaugaccgacgggcccuccaacggcgccgccagcuacaagaucuucaagaucgagaaggggaaggucacgaaguccaucgagcugaacgcgcccaacuuccacuacgaggagugcagcugcuacccggacaccggcaccgugaugugcgugugccgggacaacuggcacggguccaaccgccccugggucucguucaaccagaaccucgacuaccagaucggcuacaucugcuccggcguguucggggacaacccccggcccaaggacggcgaggggagcugcaacccggugaccgucgacggcgccaacggggugaagggcuucuccuacaaguacggcaacgggguguggaucggccgcaccaagucgaaccggcugcgcaagggguucgagaugaucugggaccccaacggcuggacggacaccgacuccgacuucagcgucaagcaggacgugguggccaucaccgacuggucgggguacuccggcagcuucguccagcaccccgagcugacgggccucgacugcauccggcccugcuucuggguggagcugguccgcgggcugccgaaggagaacaccaccaucuggaccuccggcucguccaucagcuucugcggggugaacuccgacacggccaacuggagcuggcccgacggcgccgagcuccccuucaccaucgacaaguga

SEQ ID NO: 16779 - RNA, 1410 nt, Artificial Sequence
  derived and/or modified CDS sequence (AUadapt) from InfluenzaA__AAZ83315__NA
augaaccccaaccagaagaucaucaccaucggcucggugucccugaccaucgccacgaucugcuuccucaugcagaucgccauccuggucaccaccgugacccugcacuucaagcaguacgagugcaacucgcucccgaacaaccaggugaugcugugcgagcccacgaucaucgagcgcaacaucaccgagaucgucuaccugaccaacaccacgaucgagaaggagaucugccccaagcucgcggaguaccggaacugguccaagccccagugcaagaucaccggguucgccccguucagcaaggacaacuccauccgccugucggccggcggggacaucugggugacccgggagcccuacguguccugcgaccccgacaagugcuaccaguucgcccugggccaggggaccacgcucaacaaccgccacagcaacgacaccguccacgaccggacccccuaccgcacccugcugaugaacgagcucggcgugccguuccaccugggcacgaagcaggucugcaucgccugguccucguccagcugccacgacgggaaggcguggcugcacgugugcgugaccggccacgacgagaacgccaccgccuccuucaucuacgacgggcggcucguggacucgaucggcuccuggagcaagaagauccugcgcacccaggaguccgagugcgucugcaucaacgggacgugcaccguggugaugaccgacggcucggccuccggccgggcgaacaccaagauccuguucaucgaggaggggaagaucauccacaucagccagcucucgggcuccgcccagcacgucgaggagugcucgugcuacccccgcuaccccggggugcggugcgugugccgcgacaacuggaagggcuccaaccggcccaucgucgacaucaacgugaaggacuacagcaucgccuccucguacgugugcuccggccuggucggggacacgccgcgcaagaacgacagcuccucguccagccacugccugaaccccaacaacgaggagggcgggcacggcgugaaggggugggccuucgacgacggcaacgacguguggaugggccggaccaucuccgagaaguuccgcucgggguacgagaccuucaaggucaucgagggcugguccaagcccaacagcaagcuccagaucaaccgccaggugaucgucgaccgggacaaccgguccggguacucgggcaucuucuccguggagggcaagagcugcaucaaccgcugcuucuacguggagcugauccgggggcgcaagcaggagaccgaggucugguggacgucgaacuccaucgugguguucugcggcaccagcgggaccuacggcaccggguccuggcccgacggcgccgacaucaaccugaugccgaucuga

SEQ ID NO: 16780 - RNA, 1410 nt, Artificial Sequence
  derived and/or modified CDS sequence (AUadapt) from InfluenzaA__AAZ83326__NA
augaaccccaaccagaagaucaucaccaucggcucggugucccugaccaucgccacgaucugcuuccucaugcagaucgccauccuggucaccaccgugacccugcacuucaagcaguacgagugcgacagccucccgaacaaccaggugaugcugugcgagcccacgaucaucgagcgcaacaucaccgagaucgucuaccugaccaacaccacgaucgagaaggagaucugccccaagcucgcggaguaccggaacugguccaagccccagugcaagaucaccggguucgccccguucucgaaggacaacuccauccgccugagcgccggcggggacaucugggugacccgggagcccuacguguccugcgaccccgacaagugcuaccaguucgcccugggccaggggaccacgcucaacaaccgccacucgaacgacaccguccacgaccggacccccuaccgcacccugcugaugaacgagcucggcgugccguuccaccugggcacgaagcaggucugcaucgccugguccagcuccucgugccacgacgggaaggcguggcugcacgugugcgugaccggccacgacgagaacgccaccgccuccuucaucuacgacgggcggcucguggacagcaucggcuccuggucgaagaagauccugcgcacccaggaguccgagugcgucugcaucaacgggacgugcaccguggugaugaccgacggcagcgccuccggccgggcggacaccaagauccuguucaucgaggaggggaagaucauccacaucucgcagcucagcggcuccgcccagcacgucgaggagugcucgugcuacccccgcuaccccggggugcggugcgugugccgcgacaacuggaagggcuccaaccggcccaucgucgacaucaacgugaaggacuacagcaucguguccucguacgucugcuccggccuggugggggacacgccgcgcaagaacgacagcuccucguccagccacugccugaaccccaacaacgaggagggcgggcacggcgugaaggggugggccuucgacgacggcaacgacgucuggaugggccggaccaucuccgagaaguuccgcucgggguacgagaccuucaaggugaucgagggcugguccaagcccaacagcaagcuccagaucaaccggcaggucaucguggaccgcgacaaccgguccggguacucgggcaucuucuccguggagggcaagagcugcaucaaccgcugcuucuacgucgagcugauccgggggcgcaagcaggagaccgaggugugguggacgucgaacuccaucguggucuucugcggcaccagcgggaccuacggcaccggguccuggcccgacggcgccgacaucaaccugaugccgaucuga

SEQ ID NO: 16781 - RNA, 1410 nt, Artificial Sequence
  derived and/or modified CDS sequence (AUadapt) from InfluenzaA__AAZ83374__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccucgucccacugccucgaccccaacaacgaggagggcgggcacggggucaagggcugggccuucgacgacgggaacgacguguggaugggccggaccaucagcgagaagcugcgcaccggcuacgagaccuucaaggucaucgaggggugguccaaccccaacucgaagcugcagaucaaccgccaggugaucguggaccggggcaaccgguccggguacagcggcaucuucuccgucgagggcaagucgugcaucaaccgcugcuucuacguggagcucauccgggggcgcaaggaggagaccgaggugcuguggaccagcaacuccaucgucguguucugcggcacgagcgggaccuacggcaccggguccuggccggacggcgccgacaucaaccugaugcccaucuga

SEQ ID NO: 16782 - RNA, 1410 nt, Artificial Sequence; identical to SEQ ID NO: 16748
  derived and/or modified CDS sequence (AUadapt) from InfluenzaA__AAZ83385__NA

SEQ ID NO: 16783 - RNA, 1413 nt, Artificial Sequence
  derived and/or modified CDS sequence (AUadapt) from InfluenzaA__AAZ85129__NA
augaacaccaaccagaagaucaucaccaucggcucgaucuccaucgccaucgggaucaucagccugaugcuccagaucggcaacaucaucuccaucugggccucgcacuccauccagacggggagccagaaccacaccggcgugugcaaccagcgcaucaucaccuacgagaacuccaccugggucaaccacacguacgugaacaucaacaacaccaacgugaucgcggggaaggacaagaccucggucacccuggccggcaacuccagccugugcuccaucagcggcugggccaucuacacgaaggacaacuccauccggaucgggucgaagggcgacguguucgugauccgcgagcccuucaucuccugcagccaccucgagugccggaccuucuuccugacccagggggcccugcucaacgacaagcacuccaacggcaccgucaaggaccgcucgccguaccgggcccugauguccugcccccugggggaggcgcccagccccuacaacucgaaguucgaguccguggccuggagcgccuccgccugccacgacggcaugggcuggcucacgaucgggaucagcggcccggacaacggggcgguggccguccugaaguacaacggcaucaucaccgagaccaucaaguccuggaagaagcagauccugcgcacccaggagucggagugcgugugcgugaacggcuccugcuucacgaucaugaccgacgggcccagcaacggcgccgccuccuacaagaucuucaagaucgagaaggggaaggucaccaagucgaucgagcucaacgcccccaacuuccacuacgaggagugcuccugcuaccccgacaccggcacggugaugugcgugugccgggacaacuggcacgggagcaaccgcccgugggucuccuucaaccagaaccuggacuaccagaucggcuacaucugcucgggcguguucggggacaacccccggcccaaggacggcgagggguccugcaaccccgugaccgucgacggcgcgaacggggugaagggcuucagcuacaaguacggcaacgggguguggaucggccgcaccaaguccaaccggcugcgcaagggguucgagaugaucugggacccgaacggcuggaccgacacggacagcgacuucuccgucaagcaggacgugguggccaucaccgacuggucgggguacagcggcuccuucguccagcaccccgagcucaccggccuggacugcauccggcccugcuucuggguggagcugguccgcgggcuccccaaggagaacaccacgaucuggaccucgggcuccagcaucuccuucugcggggugaacagcgacaccgccaacugguccuggccggacggcgccgagcugcccuucaccaucgacaaguga

SEQ ID NO: 16784 - RNA, 1410 nt, Artificial Sequence
  derived and/or modified CDS sequence (AUadapt) from InfluenzaA__ABA06513__NA
augaaccccaaccagaagaucaucaccaucggcucggugucccugaccaucgccacgaucugcuuccucacccagaucgccauccuggucaccaccgugacgcugcacuucaagcaguacgagugcaacucgccgcccaacaaccaggugaugcucugcgagcccaccaucaucgagcgcaacaucaccgagaucgucuaccugaccaacacgaccaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggacgacccugaacaacggccacucgaacgacaccguccacgaccgcaccccguaccggacgcuccugaugaacgagcugggcgugcccuuccaccucgggaccaagcaggucugcaucgccugguccagcuccucgugccacgacggcaaggcguggcugcacgugugcgugaccggggacgacaagaacgccaccgccuccuucaucuacaacggccgccugguggacagcaucggguccuggucgaagaagauccuccggacgcaggaguccgagugcgucugcaucaacgggaccugcaccguggugaugaccgacggcucggccuccgggaaggcggacacgaagauccuguucaucgaggagggcaagaucguccacaccagccugcucucgggguccgcccagcacguggaggagugcucgugcuacccccgcuaccccggcgugcggugcgucugccgcgacaacuggaagggcuccaaccggccgaucguggacaucaacgugaaggacuacagcaucgucuccucguacgugugcuccgggcuggugggcgacacgccccgcaagaacgacagcuccucguccucgcacugccuggaccccaacaacgaggagggcggccacggggucaagggcugggccuucgacgacggcaacgacguguggauggggcggaccaucuccgagaagcuccgcagcggcuacgagaccuucaaggucaucgaggggugguccaagcccaacucgaagcugcagaucaaccgccaggugaucguggaccgggacaaccgguccggcuacucggggaucuucuccgucgagggcaagagcugcaucaaccgcugcuucuacguggagcugauccggggccgcaaccaggagaccgaggugcucuggaccucgaacuccaucgucguguucugcgggaccagcggcacguacgggaccggcuccuggccggacggggccgacaucaaccugaugcccaucuga

SEQ ID NO: 16785 - RNA, 1410 nt, Artificial Sequence; identical to SEQ ID NO: 16784
  derived and/or modified CDS sequence (AUadapt) from InfluenzaA__ABA06545__NA

SEQ ID NO: 16786 - RNA, 1413 nt, Artificial Sequence
  derived and/or modified CDS sequence (AUadapt) from InfluenzaA__ABA08478__NA
augaacaccaaccagaagaucaucaccaucggcucgaucuccaucgccaucgggaucaucagccugaugcuccagaucggcaacaucaucuccaucugggccucgcacuccauccagacggggagccagaaccacaccggcaucugcaaccagcgcaucaucaccuacgagaacuccaccugggugaaccacacguacgucaacaucaacaacaccaacgugguggcggggaaggacaagaccucggucacccuggccggcaacuccagccugugcuccaucagcggcugggccaucuacacgaaggacaacuccauccggaucgggucgaagggcgacguguucgugauccgcgagcccuucaucuccugcagccaccucgagugccggaccuucuuccugacccagggggcccugcucaacgacaagcacuccaacggcaccgucaaggaccgcucgccguaccgggcccugauguccugcccccugggggaggcgcccagccccuacaacucgaaguucgaguccguggccuggagcgccuccgccugccacgacggcaugggcuggcucacgaucgggaucagcggcccggacaacggggcgguggccguccugaaguacaacggcaucaucaccgagaccaucaaguccuggaagaagcgcauccugcggacccaggagucggagugcgugugcgugaacggcuccugcuucacgaucaugaccgacgggcccagcaacggcgccgccuccuacaagaucuucaagaucgagaaggggaaggucaccaagucgaucgagcucaacgcccccaacuuccacuacgaggagugcuccugcuaccccgacaccggcacggugaugugcgugugccgcgacaacuggcacgggagcaaccggccgugggucuccuucaaccagaaccuggacuaccagaucggcuacaucugcucgggcguguucggggacaacccccgccccaaggacggcaagggguccugcaaccccgugaccgucgacggcgcggacggggugaagggcuucagcuacaaguacggcaacgggguguggaucggccggaccaaguccaaccgccugcggaagggguucgagaugaucugggacccgaacggcuggaccgacacggacagcgacuucuccgucaagcaggacgugguggccaucaccgacuggucgggguacagcggcuccuucguccagcaccccgagcucaccggccuggacugcauccgccccugcuucuggguggagcugguccgggggcucccccgcgagaacaccacgaucuggaccucgggcuccagcaucuccuucugcgggguggacagcgacaccgccaacugguccuggccggacggcgccgagcugcccuucaccaucgacaaguga

SEQ ID NO: 16787 - RNA, 1410 nt, Artificial Sequence; identical to SEQ ID NO: 16784
  derived and/or modified CDS sequence (AUadapt) from InfluenzaA__ABA08511__NA

SEQ ID NO: 16788 - RNA, 1413 nt, Artificial Sequence
  derived and/or modified CDS sequence (AUadapt) from InfluenzaA__ABA12699__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagucggagugcgugugcgugaacggcuccugcuucaccaucaugacggacgggcccagcaacggcgccgccuccuacaagaucuucaagaucgagaaggggaaggucaccaagucgaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcucgggcguguucggggacaacccccgccccaaggacggcaagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccgacaccgacagcgacuucuccgucaagcaggacgugguggccaucacggacuggucgggguacagcggcuccuucguccagcaccccgagcucaccggccuggacugcauccgccccugcuucuggguggagcugguccgggggcucccgcgcgagaacaccaccaucuggacgucgggcuccagcaucuccuucugcgggguggacagcgacaccgccaacugguccuggcccgacggcgccgagcugcccuucaccaucgacaaguga

SEQ ID NO: 16789 - RNA, 1413 nt, Artificial Sequence; identical to SEQ ID NO: 16788
  derived and/or modified CDS sequence (AUadapt) from InfluenzaA__ABA12710__NA

SEQ ID NO: 16790 - RNA, 1413 nt, Artificial Sequence
  derived and/or modified CDS sequence (AUadapt) from InfluenzaA__ABA12721__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcgugugcaaccagcgcaucaucaccuacgagaacuccaccugggucaaccacaccuacgugaacaucaacaacacgaacgugaucgcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcagauccugcgcacccaggagucggagugcgugugcgugaacggcuccugcuucaccaucaugacggacgggcccagcaacggcgccgccuccuacaagaucuucaagaucgggaagggcaaggucaccaagucgaucgagcucaacgcccccaacuuccacuacgaggagugcuccugcuacccggacaccgggaccgugaugugcgugugccgggacaacuggcacggcagcaaccgccccugggucuccuucaaccagaaccuggacuaccagaucggcuacaucugcucggggguguucggcgacaacccccggccccgcgacggggagggcuccugcaacccggugacggucgacggggcgaacggcgugaagggcuucagcuacaaguacgggaacggcguguggaucgggcggaccaaguccaaccgccugcggaagggcuucgagaugaucugggaccccaacggguggaccgacaccgacagcgacuucuccgucaagcaggacgugguggccaucacggacuggucgggcuacagcggcuccuucguccagcaccccgagcucaccgggcuggacugcauccgccccugcuucuggguggagcugguccggggccucccgcgcgagaacaccaccaucuggacgucgggguccagcaucuccuucugcggcgugaacagcgacaccgccaacugguccuggcccgacggcgccgagcugcccuucaccaucgacaaguga

SEQ ID NO: 16791 - RNA, 1413 nt, Artificial Sequence; identical to SEQ ID NO: 16788
  derived and/or modified CDS sequence (AUadapt) from InfluenzaA__ABA12732__NA

SEQ ID NO: 16792 - RNA, 1410 nt, Artificial Sequence; identical to SEQ ID NO: 16729
  derived and/or modified CDS sequence (AUadapt) from InfluenzaA__ABA12743__NA

SEQ ID NO: 16793 - RNA, 1410 nt, Artificial Sequence; identical to SEQ ID NO: 16745
  derived and/or modified CDS sequence (AUadapt) from InfluenzaA__ABA12754__NA

SEQ ID NO: 16794 - RNA, 1410 nt, Artificial Sequence; identical to SEQ ID NO: 16748
  derived and/or modified CDS sequence (AUadapt) from InfluenzaA__ABA12765__NA

SEQ ID NO: 16795 - RNA, 1410 nt, Artificial Sequence; identical to SEQ ID NO: 16520
  derived and/or modified CDS sequence (AUadapt) from InfluenzaA__ABA12776__NA

SEQ ID NO: 16796 - RNA, 1410 nt, Artificial Sequence; identical to SEQ ID NO: 16729
  derived and/or modified CDS sequence (AUadapt) from InfluenzaA__ABA12786__NA

SEQ ID NO: 16797 - RNA, 1410 nt, Artificial Sequence; identical to SEQ ID NO: 16748
  derived and/or modified CDS sequence (AUadapt) from InfluenzaA__ABA18029__NA

SEQ ID NO: 16798 - RNA, 1413 nt, Artificial Sequence
  derived and/or modified CDS sequence (AUadapt) from InfluenzaA__ABA18040__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcgugugcaaccagcgcaucaucaccuacgagaacuccaccugggucaaccacaccuacgugaacaucaacaacacgaacgugaucgcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcagauccugcgcacccaggagucggagugcgugugcgugaacggcuccugcuucaccaucaugacggacgggcccagcaacggcgccgccuccuacaagaucuucaagaucgagaaggggaaggucaccaagucgaucgagcucaacgcccccaacuuccacuacgaggagugcuccugcuacccggacaccggcaccgugaugugcgugugccgggacaacuggcacgggagcaaccgccccugggucuccuucaaccagaaccuggacuaccagaucggcuacaucugcucgggcguguucggggacaacccccggcccaaggacggcgagggguccugcaacccggugacggucgacggcgcgaacggggugaagggcuucagcuacaaguacggcaacgggguguggaucggccgcaccaaguccaaccggcugcgcaagggguucgagaugaucugggaccccaacggcuggaccgacaccgacagcgacuucuccgucaagcaggacgugguggccaucacggacuggucgggguacagcggcuccuucguccagcaccccgagcucaccggccuggacugcauccggcccugcuucuggguggagcugguccgcgggcucccgaaggagaacaccaccaucuggacgucgggcuccagcaucuccuucugcggggugaacagcgacaccgccaacugguccuggcccgacggcgccgagcugcccuucaccaucgacaaguga

SEQ ID NO: 16799 - RNA, 1410 nt, Artificial Sequence
  derived and/or modified CDS sequence (AUadapt) from InfluenzaA__ABA18126__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccucguccagcugccacgacggcaaggcguggcugcacgugugcgugaccggggacgacgagaacgccaccgccuccuucaucuacaacggccgccugguggacucgaucggguccuggagcaagaagauccuccggacccaggaguccgagugcgucugcaucaacggcacgugcaccguggugaugaccgacggcucggccuccgggaaggcggacaccaagauccuguucaucgaggagggcaagaucguccacaucagcacgcugucgggguccgcccagcacguggaggagugcucgugcuacccccgcuaccccggcgugcggugcgucugccgcgacaacuggaagggcuccaaccggccgaucguggacaucaacgugaaggacuacagcaucgucuccucguacgugugcuccgggcucgugggcgacacgccccgcaagaacgacagcuucuccucgucccacugccuggaccccaacaacgaggagggcgggcacggggucaagggcugggccuucgacgacggcaacgacauguggauggggcggaccaucagcgagaagcugcgcuccggcuacgagaccuucaaggugaucgagggguggucgaagcccaacuccaagcuccagaucaaccggcaggucaucguggagcgcggcaaccggagcggguacuccggcaucuucucgguggagggcaaguccugcaucaaccgcugcuucuacgucgagcugauccgggggcgcaaggaggagaccgaggugugguggaccagcaacucgaucguggucuucugcggcaccuccgggaccuacggcacggggagcuggccggacggcgccgacaucaaccugaugcccaucuga

SEQ ID NO: 16800 - RNA, 1413 nt, Artificial Sequence; identical to SEQ ID NO: 16788
  derived and/or modified CDS sequence (AUadapt) from InfluenzaA__ABA18148__NA

SEQ ID NO: 16801 - RNA, 1410 nt, Artificial Sequence
  derived and/or modified CDS sequence (AUadapt) from InfluenzaA__ABA18159__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaaggagauccugcggacccaggagucggagugcgugugcaucaacggcacgugcgccguggucaugaccgacggguccgccagcggcaaggcggacaccaagauccucuucaucgaggagggcaagaucgugcacaccucgaagcuguccgggagcgcccagcacguggaggagugcuccugcuacccccgcuaccccggcauccggugcgucugccgcgacaacuggaaggggucgaaccggccgaucguggacgugaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggacguccaacagcaucgucguguucugcggcaccuccgggaccuacggcaccgggagcuggccggacggcgccgacaucaaccugaugcccaucuga

SEQ ID NO: 16802 - RNA, 1410 nt, Artificial Sequence; identical to SEQ ID NO: 16729
  derived and/or modified CDS sequence (AUadapt) from InfluenzaA__ABA26703__NA

SEQ ID NO: 16803 - RNA, 1410 nt, Artificial Sequence; identical to SEQ ID NO: 16729
  derived and/or modified CDS sequence (AUadapt) from InfluenzaA__ABA26714__NA

SEQ ID NO: 16804 - RNA, 1410 nt, Artificial Sequence; identical to SEQ ID NO: 16729
  derived and/or modified CDS sequence (AUadapt) from InfluenzaA__ABA26736__NA

SEQ ID NO: 16805 - RNA, 1410 nt, Artificial Sequence; identical to SEQ ID NO: 16729
  derived and/or modified CDS sequence (AUadapt) from InfluenzaA__ABA26747__NA

SEQ ID NO: 16806 - RNA, 1410 nt, Artificial Sequence; identical to SEQ ID NO: 16729
  derived and/or modified CDS sequence (AUadapt) from InfluenzaA__ABA26758__NA

SEQ ID NO: 16807 - RNA, 1410 nt, Artificial Sequence; identical to SEQ ID NO: 16729
  derived and/or modified CDS sequence (AUadapt) from InfluenzaA__ABA26769__NA

SEQ ID NO: 16808 - RNA, 1410 nt, Artificial Sequence; identical to SEQ ID NO: 16729
  derived and/or modified CDS sequence (AUadapt) from InfluenzaA__ABA26780__NA

SEQ ID NO: 16809 - RNA, 1410 nt, Artificial Sequence; identical to SEQ ID NO: 16729
  derived and/or modified CDS sequence (AUadapt) from InfluenzaA__ABA26791__NA

SEQ ID NO: 16810 - RNA, 1410 nt, Artificial Sequence; identical to SEQ ID NO: 16729
  derived and/or modified CDS sequence (AUadapt) from InfluenzaA__ABA26802__NA

SEQ ID NO: 16811 - RNA, 1413 nt, Artificial Sequence
  derived and/or modified CDS sequence (AUadapt) from InfluenzaA__ABA42250__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagucggagugcgugugcgugaacggcuccugcuucaccaucaugacggacgggcccagcaacggcgccgccuccuacaagaucuucaagaucgagaaggggaaggucaccaagucgaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcucgggcguguucggggacaacccccgccccaaggacggcaagggguccugcaacccggugacggucgacggcgcggacggggugaagggcuucagcuacaaguacggcgacgggguguggaucggccggaccaaguccaaccgccugcggaagggguucgagaugaucugggaccccaacggcuggaccgacaccgacagcgacuucuccgucaagcaggacgugguggccaucacggacuggucgggguacagcggcuccuucguccagcaccccgagcucaccggccuggacugcauccgccccugcuucuggguggagcugguccgggggcucccgcgcgagaacaccaccaucuggacgucgggcuccagcaucuccuucugcgggguggacagcgacaccgccaacugguccuggcccgacggcgccgagcugcccuucaccaucgacaaguga

SEQ ID NO: 16812 - RNA, 1413 nt, Artificial Sequence; identical to SEQ ID NO: 16798
  derived and/or modified CDS sequence (AUadapt) from InfluenzaA__ABA42261__NA

SEQ ID NO: 16813 - RNA, 1410 nt, Artificial Sequence
  derived and/or modified CDS sequence (AUadapt) from InfluenzaA__ABA42272__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucucgugguccaaggacauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccucgucccacugccucgaccccaacaacgaggagggcgggcacggggucaagggcugggccuucgacgacgggaacgacguguggaugggccggaccaucaacgagaagcugcgccugggcuacgagaccuucaaggucaucgagggguggagcaaccccaacuccaagcuccagaucaaccgccaggugaucguggagcggggcaaccggucgggguacuccggcaucuucagcgucgaggggaaguccugcaucaaccgcugcuucuacguggagcugauccggggccgcaaggaggagaccgaggugcuguggaccucgaacagcaucgucguguucugcggcaccuccgggacguacggcaccgggagcuggccggacggcgccgacaucaaccucaugcccaucuga

SEQ ID NO: 16814 - RNA, 1410 nt, Artificial Sequence; identical to SEQ ID NO: 16729
  derived and/or modified CDS sequence (AUadapt) from InfluenzaA__ABA42294__NA

SEQ ID NO: 16815 - RNA, 1410 nt, Artificial Sequence; identical to SEQ ID NO: 16556
  derived and/or modified CDS sequence (AUadapt) from InfluenzaA__ABA42305__NA

SEQ ID NO: 16816 - RNA, 1410 nt, Artificial Sequence; identical to SEQ ID NO: 16566
  derived and/or modified CDS sequence (AUadapt) from InfluenzaA__ABA42316__NA

SEQ ID NO: 16817 - RNA, 1413 nt, Artificial Sequence
  derived and/or modified CDS sequence (AUadapt) from InfluenzaA__ABA42327__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagucggagugcgugugcgugaacggcuccugcuucaccaucaugacggacgggcccagcaacggcgccgccuccuacaagaucuucaagaucgagaaggggaaggucaccaagucgaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcucgggcguguucggggacaacccccgccccaaggacggcgagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccgacaccgacagcgacuucuccgucaagcaggacgugguggccaucacggacuggucgggguacagcggcuccuucguccagcaccccgagcucaccggccuggacugcauccgccccugcuucuggguggagcugguccgggggcucccgcgcgagaacaccaccaucuggacgucgggcuccagcaucuccuucugcggggugaacagcgacaccgccaacugguccuggcccgacggcgccgagcugcccuucaccaucgacaaguga

SEQ ID NO: 16818 - RNA, 1410 nt, Artificial Sequence; identical to SEQ ID NO: 16551
  derived and/or modified CDS sequence (AUadapt) from InfluenzaA__ABA42338__NA

SEQ ID NO: 16819 - RNA, 1410 nt, Artificial Sequence
  derived and/or modified CDS sequence (AUadapt) from InfluenzaA__ABA42349__NA
augaaccccaaccagaagaucaucaccaucggcucggugucccugaccaucgccacgaucugcuuccucaugcagaucgccauccuggucaccaccgugacccugcacuucaagcaguacgagugcgacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccagcugccacgacggcaaggcguggcugcacgucugcgugaccggggacgacgagaacgccaccgccuccuucaucuacaacggcaagcugguggacucgaucggguccuggagcaagaagauccuccggacccaggaguccgagugcgucugcaucaacggcacgugcaccguggugaugaccgacggcucggccuccgggaaggcggacaccaagauccuguucaucgaggagggcaagaucguccacaucagcacgcugucgggguccgcccagcacguggaggagugcucgugcuacccccgcuaccccggcgugcggugcgucugccgcgacaacuggaagggcuccaaccggccgaucguggacaucaacgugaaggacuacagcaucgucuccucguacgugugcuccgggcucgugggcgacacgccccgcaagaacgacagcuucuccucgucccacugccuggaccccaacaacgaggagggcgggcacggggucaagggcugggccuucgacgacggcaacgacguguggauggggcggaccaucagcgagaagcugcgcuccggcuacgagaccuucaaggucaucgagggguggucgaagcccaacuccaagcuccagaucaaccgccaggugaucguggagcggggcaaccggagcggguacuccggcaucuucucggucgagggcaaguccugcaucaaccgcugcuucuacguggagcugauccgggggcgcaaggaggagaccgaggugugguggaccagcaacucgaucgucguguucugcggcaccuccgggaccuacggcacggggagcuggccggacggcgccgacaucaaccugaugcccaucuga

SEQ ID NO: 16820 - RNA, 1410 nt, Artificial Sequence; identical to SEQ ID NO: 16556
  derived and/or modified CDS sequence (AUadapt) from InfluenzaA__ABA42360__NA

SEQ ID NO: 16821 - RNA, 1410 nt, Artificial Sequence; identical to SEQ ID NO: 16551
  derived and/or modified CDS sequence (AUadapt) from InfluenzaA__ABA42371__NA

SEQ ID NO: 16822 - RNA, 1410 nt, Artificial Sequence; identical to SEQ ID NO: 16566
  derived and/or modified CDS sequence (AUadapt) from InfluenzaA__ABA42382__NA

SEQ ID NO: 16823 - RNA, 1410 nt, Artificial Sequence; identical to SEQ ID NO: 16551
  derived and/or modified CDS sequence (AUadapt) from InfluenzaA__ABA42393__NA

SEQ ID NO: 16824 - RNA, 1410 nt, Artificial Sequence
  derived and/or modified CDS sequence (AUadapt) from InfluenzaA__ABA42404__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccgcgaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucucggccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccucguccagcugccacgacggcaaggccuggcugcacgucugcgugacgggggacgacgagaacgccaccgccuccuucaucuacaacggccggcugguggacucgaucggguccuggucgaagaagauccuccgcacccaggaguccgagugcgucugcaucaacgggaccugcacgguggugaugaccgacggcagcgcguccgggaaggccgacaccaagauccuguucaucgaggagggcaagaucgucaacaucucgacccugcccgggagcgcccagcacguggaggagugcuccugcuacccccgguacccgggcgugcgcugcgucugccgggacaacuggaagggcucgaaccgccccaucguggacaucaacgugaaggacuacuccaucgucagcuccuacgugugcucggggcucgugggcgacacgccccggaagaacgacuccuucucguccagccacugccuggaccccaacaacgaggagggcggccacggggucaagggcugggccuucgacgacggcaacgacguguggauggggcgcaccaucuccgagaagcugcggucgggcuacgagaccuucaaggucaucgaggggugguccaagccgaacagcaagcuccagaucaaccgccaggugaucguggagcggggcaaccgcuccggguacucgggcaucuucuccgucgagggcaagagcugcaucaaccggugcuucuacguggagcugauccgcgggcggaaggaggagaccgaggugugguggacguccaacucgaucgucguguucugcggcaccagcgggaccuacggcaccggguccuggcccgacggcgccgacaucaaccugaugcccaucuga

SEQ ID NO: 16825 - RNA, 1410 nt, Artificial Sequence; identical to SEQ ID NO: 16566
  derived and/or modified CDS sequence (AUadapt) from InfluenzaA__ABA42415__NA

SEQ ID NO: 16826 - RNA, 1410 nt, Artificial Sequence; identical to SEQ ID NO: 16573
  derived and/or modified CDS sequence (AUadapt) from InfluenzaA__ABA42446__NA

SEQ ID NO: 16827 - RNA, 1410 nt, Artificial Sequence
  derived and/or modified CDS sequence (AUadapt) from InfluenzaA__ABA42457__NA
augaaccccaaccagaagaucaucaccaucggcucggugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucucgaaggacaacuccauccgccucagcgccggcggggacaucugggugacccgggagcccuacguguccugcgaccccgacaagugcuaccaguucgcccugggccaggggaccacgcugaacaacggccacucgaacgacaccguccacgaccgcaccccguaccggacccuccugaugaacgagcugggcgugcccuuccaccucgggacgcgccaggugugcaucgccugguccagcuccucgugccacgacggcaaggcguggcugcacgucugcgugaccggggacgacgagaacgccaccgccuccuucaucuacaacggccggcugguggacagcaucggguccuggucgaagaagauccuccgcacccaggaguccgagugcgucugcaucaacggcacgugcaccguggugaugaccgacggcagcgccuccgggaaggcggacaccaagauccuguucaucgaggagggcaagaucguccacaucucgacgcugagcggguccgcccagcacguggaggagugcucgugcuacccccgguaccccggcgugcgcugcgucugccgggacaacuggaagggcuccaaccgcccgaucguggacaucaacgugaaggacuacagcaucgucuccucguacgugugcuccgggcucgugggcgacacgccccggaagaacgacagcuucuccucgucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggucgaagcccaacuccaagcuccagaucaaccgccaggugaucguggagcggggcaaccgcagcggguacuccggcaucuucucggucgaguccaagagcugcaucaaccggugcuucuacguggagcugauccgcggccggaaggaggagaccgaggugugguggaccucgaacuccaucgucguguucugcgggaccagcggcaccuacgggacgggcuccuggccggacggggccgacaucaaccugaugcccaucuga

SEQ ID NO: 16828 - RNA, 1410 nt, Artificial Sequence; identical to SEQ ID NO: 16573
  derived and/or modified CDS sequence (AUadapt) from InfluenzaA__ABA42468__NA

SEQ ID NO: 16829 - RNA, 1410 nt, Artificial Sequence
  derived and/or modified CDS sequence (AUadapt) from InfluenzaA__ABA42479__NA
augaaccccaaccagaagaucaucaccaucggcucggugucccugaccaucgccacgaucugcuuccucaugcagaucgccauccuggucaccaccgugacccugcacuucaagcaguacgagugcgacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccagcugccacgacggcaaggcguggcugcacgucugcgugaccggggacgacgagaacgccaccgccuccuucaucuacaacggccggcugguggacucgaucggguccuggagcaagaagauccuccgcacccaggaguccgagugcgucugcaucaacggcacgugcaccguggugaugaccgacggcucggccuccgggaaggcggacaccaagauccuguucaucgaggagggcaagaucguccacaucagcacgcugucgggguccgcccagcacguggaggagugcucgugcuacccccgguaccccggcgugcgcugcgucugccgggacaacuggaagggcuccaaccgcccgaucguggacaucaacgugaaggacuacagcaucgucuccucguacgugugcuccgggcucgugggcgacacgccccggaagaacgacagcuucuccucgucccacugccuggaccccaacaacgaggacgggggccacggggucaagggcugggccuucgacgacggcaacgacguguggauggggcgcaccaucagcgagaagcugcgguccggcuacgagaccuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaaggaggagaccgaggugugguggaccagcaacucgaucgucguguucugcggcaccuccgggaccuacggcacggggagcuggccggacggcgccgacaucaaccugaugcccaucuga

SEQ ID NO: 16830 - RNA, 1410 nt, Artificial Sequence
  derived and/or modified CDS sequence (AUadapt) from InfluenzaA__ABA42490__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccagcugccacgacggcaaggcguggcugcacgucugcgugaccggggacgacgagaacgccaccgccuccuucaucuacaacggccggcugguggacucgaucggguccuggagcaagaagauccuccgcacccaggaguccgagugcgucugcaucaacggcacgugcaccguggugaugaccgacggcucggccuccgggaaggcggacaccaagauccuguucaucgaggagggcaagaucguccacaucagcaagcugucgggguccgcccagcacguggaggagugcucgugcuacccccgguaccccggcgugcgcugcgucugccgggacaacuggaagggcuccaaccgcccgaucguggacaucaacgugaaggacuacagcaucgucuccucguacgugugcuccgggcucgugggcgacacgccccggaagaacgacagcuucuccucgucccacugccuggaccccaacaacgaggagggcgggcacggggucaagggcugggccuucgacgacggcaacgacguguggauggggcgcaccaucagcgagaagcugcgguccggcuacgagaccuucaaggucaucaagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaaggaggagaccgaggugugguggacgagcaacucgaucgucguguucugcggcaccuccgggaccuacggcaccgggagcuggccggacggcgccgacaucaaccugaugcccaucuga

SEQ ID NO: 16831 - RNA, 1410 nt, Artificial Sequence; identical to SEQ ID NO: 16573
  derived and/or modified CDS sequence (AUadapt) from InfluenzaA__ABA42501__NA

SEQ ID NO: 16832 - RNA, 1410 nt, Artificial Sequence
  derived and/or modified CDS sequence (AUadapt) from InfluenzaA__ABA42512__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccccaccaacaccacgaucgagaaggagaucugcccgaagcuggcggaguaccggaacugguccaagccccagugcaacaucaccggguucgcccccuucagcaaggacaacuccauccgccugucggccggcggggacaucugggugacccgggagcccuacguguccugcgacccggacaagugcuaccaguucgcccucggccaggggaccacgcugaacaacggccacucgaacgacaccguccacgaccgcacccccuaccggacccugcucaugaacgagcugggcgugcccuuccaccuggggacgaagcaggucugcaucgccugguccagcuccucgugccacgacggcaaggcguggcuccacgugugcgugaccggggacgacgagaacgccaccgccuccuucaucuacaacggccgccugguggacucgaucggguccuggagcaagaagauccugcggacccaggaguccgagugcgucugcaucaacggcacgugcaccguggugaugaccgacggcucggccuccgggaaggcggacaccaagauccucuucaucgaggagggcaagaucguccacacgucgagccuguccgggucggcccagcacguggaggagugcuccugcuacccccgcuacccgggcgugcggugcgucugccgcgacaacuggaagggcagcaaccggcccaucguggacaucaacgugaaggacuacuccaucgucucguccuacgugugcucggggcuggugggcgacacgccccgcaagaacgacuccagcuccucgucccacugccucgaccccaacaacgaggagggcgggcacggggucaagggcugggccuucgacgacggcaacgacguguggauggggcggaccaucucggagaagcugcgcuccggcuacgagaccuucaaggucaucgagggguggagcaagccgaacuccaagcugcagaucaaccgccaggugaucguggaccggggcaaccggucgggguacuccggcaucuucucggucgagggcaagagcugcaucaaccgcugcuucuacguggagcucauccgggggcgcaagcaggagaccgaggugcuguggaccuccaacucgaucgucguguucugcggcaccuccgggaccuacggcacggggagcuggcccgacggcgccgacaucaaccugaugcccaucuga

SEQ ID NO: 16833 - RNA, 1410 nt, Artificial Sequence; identical to SEQ ID NO: 16463
  derived and/or modified CDS sequence (AUadapt) from InfluenzaA__ABA42523__NA

SEQ ID NO: 16834 - RNA, 1410 nt, Artificial Sequence; identical to SEQ ID NO: 16463
  derived and/or modified CDS sequence (AUadapt) from InfluenzaA__ABA42534__NA

SEQ ID NO: 16835 - RNA, 1410 nt, Artificial Sequence; identical to SEQ ID NO: 16655
  derived and/or modified CDS sequence (AUadapt) from InfluenzaA__ABA42545__NA

SEQ ID NO: 16836 - RNA, 1410 nt, Artificial Sequence
  derived and/or modified CDS sequence (AUadapt) from InfluenzaA__ABA42556__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccucguccucgugccacgacggcaaggcguggcugcacgugugcgugaccggggacgacgagaacgccaccgccuccuucaucuacaacggccgccugguggacagcaucggguccuggucgaagaagauccuccggacccaggaguccgagugcgucugcaucaacggcacgugcaccguggugaugaccgacggcagcgccuccgggaaggcggacaccaagauccuguucaucgaggagggcaagaucguccacacgucgcugcucagcggguccgcccagcacguggaggagugcucgugcuacccccgcuaccccggcgugcggugcgucugccgcgacaacuggaagggcuccaaccggccgaucguggacaucaacgugaaggacuacucgaucgucuccagcuacgugugcuccgggcuggugggcgacacgccccgcaagaacgacucguccagcuccucgcacugccuggaccccaacaacgaggagggcgggcacggggucaagggcugggccuucgacgacggcaacgacguguggauggggcggaccaucuccgagaagcuccgcucgggcuacgagaccuucaaggucaucgaggggugguccaagcccaacagcaagcugcagaucaaccgccaggugaucguggaccggggcaaccgguccggguacucgggcaucuucuccgucgagggcaagagcugcaucaaccgcugcuucuacguggagcugauccgggggcgcaagcaggaggccgaggugcucuggaccucgaacuccaucgucguguucugcggcaccagcgggaccuacggcaccggguccuggccggacggcgccgacaucaaccugaugcccaucuga

SEQ ID NO: 16837 - RNA, 1410 nt, Artificial Sequence; identical to SEQ ID NO: 16463
  derived and/or modified CDS sequence (AUadapt) from InfluenzaA__ABA42567__NA

SEQ ID NO: 16838 - RNA, 1410 nt, Artificial Sequence
  derived and/or modified CDS sequence (AUadapt) from InfluenzaA__ABA42931__NA
augaaccccaaccagaagaucaucaccaucggcucggugucccugaccaucgccacgaucugcucgcucaugcagaucgccauccuggucaccaccgugacccugcacuucaagcaguacgagugcaacuccccgcccaacaaccaggugaugcucugcgagcccacgaucaucgagcgcaacaucaccgagaucgucuaccugaccaacaccacgaucgagaaggagaucugccccaagcuggcggaguaccggaacuggagcaagccgcagugcaacaucaccggguucgcccccuucuccaaggacaacucgauccgccucuccgccggcggggacaucugggugacccgggagcccuacgugucgugcgaccccgacaagugcuaccaguucgcccugggccaggggaccacgcugaacaacggccacuccaacgacaccguccacgaccgcaccccguaccggacccuccugaugaacgagcugggcgugcccuuccaccucgggacgaagcaggucugcaucgccuggagcuccucguccugccacgacggcaaggcguggcugcacgugugcgugaccggggacgacgagaacgccaccgccucguucaucuacaacggccgccugguggacuccaucgggagcugguccaagaagauccuccggacccaggagucggagugcgucugcaucaacggcacgugcaccguggugaugaccgacggcuccgccucggggaaggcggacaccaagauccuguucaucgaggagggcaagaucguccacacgagccugcucuccgggucggcccagcacguggaggagugcuccugcuacccccgcuaccccggcgugcggugcgucugccgcgacaacuggaagggcagcaaccggccgaucguggacaucaacgugaaggacuacuccaucgucucguccuacgugugcucggggcuggugggcgacacgccccgcaagaacgacuccagcuccucgucccacugccuggaccccaacaacgaggagggcgggcacggggucaagggcugggccuucgacgacggcaacgacguguggauggggcggaccaucucggagaagcuccgcuccggcuacgagaccuucaaggucaucgagggguggagcaagcccaacuccaagcugcagaucaaccgccaggugaucguggaccggggcaaccggucgggguacuccggcaucuucucggucgagggcaagagcugcaucaaccgcugcuucuacguggagcugauccgggggcgcaagcaggagaccgaggugcucuggaccuccaacucgaucgucguguucugcggcaccuccgggaccuacggcacggggagcuggccggacggcgccgacaucaaccugaugcccaucuga

SEQ ID NO: 16839 - RNA, 1410 nt, Artificial Sequence; identical to SEQ ID NO: 16463
  derived and/or modified CDS sequence (AUadapt) from InfluenzaA__ABA42942__NA

SEQ ID NO: 16840 - RNA, 1410 nt, Artificial Sequence; identical to SEQ ID NO: 16463
  derived and/or modified CDS sequence (AUadapt) from InfluenzaA__ABA42981__NA

SEQ ID NO: 16841 - RNA, 1410 nt, Artificial Sequence; identical to SEQ ID NO: 16551
  derived and/or modified CDS sequence (AUadapt) from InfluenzaA__ABA42992__NA

SEQ ID NO: 16842 - RNA, 1413 nt, Artificial Sequence
  derived and/or modified CDS sequence (AUadapt) from InfluenzaA__ABA43192__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcgugugcaaccagcgcaucaucaccuacgagaacuccaccugggucaaccacaccuacgugaacaucaacaacacgaacgugaucgcggggaaggacaagaccagcgucauccuggccggcaacuccucgcugugcuccaucagcggcugggccaucuacaccaaggacaacuccauccggaucgggagcaagggcgacguguucgugauccgcgagccguucaucuccugcucgcaccucgagugccggaccuucuuccugacgcagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcgguggccguccugaaguacaacggcaucaucaccgagacgaucaaguccuggaagaagcagauccugcgcacccaggagagcgagugcgugugcgugaacggcuccugcuucaccaucaugaccgacgggcccagcaacggcgccgccuccuacaagaucuucaagaucgagaaggggaaggucaccaagucgaucgagcucaacgcccccaacuuccacuacgaggagugcuccugcuacccggacacgggcaccgugaugugcgugugccgggacaacuggcacgggagcaaccgccccugggucuccuucaaccagaaccuggacuaccagaucggcuacaucugcucgggcguguucggggacaacccccggcccaaggacggcgagggguccugcaacccggugaccgucgacggcgcgaacggggugaagggcuucagcuacaaguacggcaacgggguguggaucggccgcacgaaguccaaccggcugcgcaagggguucgagaugaucugggaccccaacggcuggaccgacaccgacagcgacuucuccgucaagcaggacguggugucgaucaccgacuggagcggguacuccggcagcuucguccagcaccccgagcucacgggccuggacugcauccggcccugcuucuggguggagcugguccgcgggcucccgaaggagaacaccaccaucuggaccuccggcucguccaucagcuucugcggggugaacuccgacacggccaacuggagcuggcccgacggcgccgagcugcccuucaccaucgacaaguga

SEQ ID NO: 16843 - RNA, 1410 nt, Artificial Sequence; identical to SEQ ID NO: 16748
  derived and/or modified CDS sequence (AUadapt) from InfluenzaA__ABA43203__NA

SEQ ID NO: 16844 - RNA, 1410 nt, Artificial Sequence
  derived and/or modified CDS sequence (AUadapt) from InfluenzaA__ABA43339__NA
augaaccccaaccagaagaucaucaccaucggcucggugucccugucgaucgccaccaucugcuuccucaugcagaucgccauccuggucacgaccgugacccugcacuucaagcaguacgagugcuccagcccgcccaacaaccaggugaugcccugcgagcccaccaucaucgagcgcaacaucacggagaucgucuaccucaccaacaccaccaucgagaaggagaucugcccgaagcugguggaguaccggaacugguccaagccccagugcaagaucacgggguucgcgcccuucucgaaggacaacuccauccgccugagcgccggcggggacaucugggugacccgggagcccuacgucuccugcgacccgggcaagugcuaccaguucgcccucgggcagggcaccacccugaacaaccgccacucgaacgacacggugcacgaccggacccccuaccgcacccugcucaugaacgagcugggcgugcccuuccaccuggggaccaagcaggucugcauggccugguccagcuccucgugccacgacggcaaggccuggcuccacgugugcgugacggggcacgacgagaacgcgaccgccuccuucaucuacgacggccggcuggucgacagcaucggguccuggucgaagaacauccugcgcacccaggaguccgagugcgugugcaucaacgggaccugcacgguggucaugaccgacggcagcgccucggagcgggccgacaccaagauccucuucaucgaggagggcaagaucgugcacaucagcccccuguccggcuccgcgcagcacguggaggagugcucgugcuacccgcgcuaccccgggguccggugcgugugccgcgacaacuggaagggcuccaaccggcccaucguggacaucaacgucaaggacuacagcaucguguccucguacgugugcuccggccuggucggggacacgccccgcaagaacgaccggagcuccucguccuacugccgcaacccgaacaacgagaagggcagccacggggugaagggcugggccuucgacgacgggaacgacgucuggaugggccggaccaucggcgaggagcuccgcuccggguacgagaccuucaaggugaucggcggguggucgacccccaacuccaagcugcagaucaaccgccaggugaucgucgacagcggcaaccgguccggguacucgggcaucuucagcguggagggcaaguccugcaucaaccggugcuucuacguggagcugauccgcgggcgcaagcaggagacccgggucugguggacgucgaacuccaucgugguguucugcggcaccagcgggaccuacggcaccggguccuggcccgacggcgccgacaucaaccucaugcccaucuga

SEQ ID NO: 16845 - RNA, 1410 nt, Artificial Sequence
  derived and/or modified CDS sequence (AUadapt) from InfluenzaA__ABA54916__NA
augaaccccaaccagaagaucaucaccaccggcucgaucugcauggugaucgggauggucucccugaugcuccagaucggcaacaucaucagcaucugggugucccacagcauccagacggggacccagcaccgcgccgagccgugcaaccgguccaucaucaacuacgagaacaacaccugggugaaccagaccuacgucaagaucucgaacacgaacuuccugaccgagaaggccguggcguccgugcgccuggucggcaacagcucccucugccccaucagcgggugggccguguacuccaaggacaacagcauccggaucggcuccaagggcgacguguucgucauccgcgagcccuucaucucgugcucccaccuggagugccggaccuucuuccugacccagggggcccuccugaacgacaagcacagcaacggcacggugaaggaccgcucccccuaccggacccugaugagcugcccggugggggaggcccccucccccuacaacucgcgcuucgagagcgucgccugguccgcgagcgccugccacgacggcaccuccuggcucaccaucgggaucagcggccccgacaacggcgccguggccgugcugaaguacaacgggaucaucacggacaccaucaaguccuggcggaacaacauccugcgcgcgcaggagucggagugcgccugcgucaacggcuccugcuucaccgugaugaccgacgggccgagcaacggccaggccuccuacaagaucuucaagaucgagaagggcaagguggucaagagcguggagcucaacgcccccaacuaccacuacgaggagugcuccugcuaccccgacgccggggagaucacgugcgugugccgggacaacuggcacggcucgaaccgccccugggucuccuucaaccagaaccuggaguaccagaucggguacaucugcagcggcguguucggggacaacccgcggcccaacgacggcaccggcuccugcgggcccgugagccccaacggcgcguacggggucaagggcuucuccuucaaguacgggaacggcguguggaucggccgcaccaagagcaccaacucccggucgggguucgagaugaucugggacccgaacggcuggacggggaccgacagcaacuucuccgucaagcaggacaucguggccaucaccgacuggagcggcuacuccgggucguucgugcagcaccccgagcugaccggccucgacugcauccgccccugcuucugggucgagcugauccggggccgccccaaggaguccacgaucuggaccagcggguccagcaucuccuucugcggcgugaacagcgacaccguggggugguccuggccggacggcgccgagcugcccuucaccaucgacaaguga

SEQ ID NO: 16846 - RNA, 1413 nt, Artificial Sequence
  derived and/or modified CDS sequence (AUadapt) from InfluenzaA__ABA87048__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcgugugcaaccagcgcaucaucaccuacgagaacuccaccugggucaaccacaccuacgugaacaucaacaacacgaacgugaucgcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcagauccugcgcacccaggagucggagugcgugugcgugaacggcuccugcuucaccaucaugacggacgggcccagcaaccgggccgccuccuacaagaucuucaagaucgagaagggcaaggucaccaagucgguggagcucaacgcccccaacuuccacuacgaggagugcuccugcuacccggacaccgggaccgugaugugcgucugccgcgacaacuggcacggcagcaaccggcccuggguguccuucaaccagaaccuggacuaccagaucggguacaucugcucgggcguguucggcgacaacccccgccccaaggacggggagggcuccugcaacccggucacgguggacggggcgaacggcgugaagggguucagcuacaaguacggcaacggcgucuggaucgggcggaccaaguccaaccgccugcggaagggcuucgagaugaucugggaccccaacggguggaccgacaccgacagcgacuucuccgugaagcaggacguggucgccaucacggacuggucgggcuacagcggguccuucgugcagcaccccgagcucaccggccuggacugcauccgccccugcuucugggucgagcuggugcggggccucccgaaggagaacaccaccaucuggacgucgggguccagcaucuccuucugcggcgugaacagcgacaccgccaacugguccuggcccgacggggccgagcugcccuucaccaucgacaaguga

SEQ ID NO: 16847 - RNA, 1413 nt, Artificial Sequence
  derived and/or modified CDS sequence (AUadapt) from InfluenzaA__ABA87060__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacagcaaguucgaguccguggccuggucggccuccgccugccacgacggcaugggcuggcucaccaucgggaucagcggccccgacaacggggcgguggccguccugaaguacaacggcaucaucacggagaccaucaaguccuggaagaagcgcauccugcggacccaggagucggagugcgugugcgugaacggcuccugcuucaccaucaugacggacgggcccagcaacggcaccgccuccuacaagaucuucaagaucgagaaggggaaggucaccaagagcaucgagcucaacgcccccaacuuccacuacgaggagugcuccugcuacccggacaccggcacggugaugugcgugugccgcgacaacuggcacgggucgaaccggcccugggucuccuucaaccagaaccuggacuaccagaucggcuacaucugcagcggcguguucggggacaacccccgccccaaggacggcaagggguccugcucgccggugaccgucgacggcgccgacggggugaagggcuucuccuacaaguacggcaacgggguguggaucggccggaccaagagcaaccgccugcggaagggguucgagaugaucugggaccccaacggcuggaccgacacggacuccgacuucagcgucaagcaggacgugguggcgaucaccgacuggucgggguacuccggcagcuucguccagcaccccgagcucaccggccuggacugcauccgccccugcuucuggguggagcugguccgggggcucccgcgcgagaacaccacgaucuggaccuccggcucguccaucagcuucugcgggguggacuccgacaccgccaacuggagcuggcccgacggcgccgagcugcccuucaccaucgacaaguga

SEQ ID NO: 16848 - RNA, 1413 nt, Artificial Sequence
  derived and/or modified CDS sequence (AUadapt) from InfluenzaA__ABA87083__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagaagaucaucaccuacaagaacuccaccugggugaaccacaccuacgucaacaucaacaacacgaacgugguggcggggaaggacaagaccagcgucacccuggccggcaacuccucgcugugcuccaucagcggcugggccaucuacaccaaggacaacuccauccgcaucgggucgaagggcgacguguucgugauccgggagccguucaucuccugcagccaccucgagugccgcacguucuuccugacccagggggcccugcucaacgacaagcacuccaacggcaccgucaaggaccggagccccuaccgcgcccugauguccugcccccugggggaggcgcccucgccguacaacagcaaguucgaguccguggccuggagcgccuccgccugccacgacggcaugggcuggcucaccaucgggaucucgggccccgacaacggggcgguggccguccugaaguacaacggcaucaucacggagaccaucaaguccuggaagaagcggauccugcgcacccaggagagcgagugcgugugcgugaacggcuccugcuucaccaucaugacggacgggcccucgaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgggacaacuggcacgggagcaaccgccccugggucuccuucaaccagaaccuggacuaccagaucggcuacaucugcucgggcguguucggggacaacccccggcccaaggacggcgagggguccugcaacccggugacggucgacggcgcggacggggugaagggcuucagcuacaaguacggcaacgggguguggaucggccgcaccaaguccaaccggcugcgcaagggguucgagaugaucugggaccccaacggcuggaccgacaccgacucggucuucuccgugaagcaggacguggucgccaucacggacuggagcggguacagcggcuccuucgugcagcaccccgagcucaccggccuggacugcauccggcccugcuucugggucgagcuggugcgcgggcucccgcgggagaacaccaccaucuggacgucgggcuccagcaucuccuucugcggggugaacagcgacaccgccaacugguccuggcccgacggcgccgagcugcccuucaccaucgacaaguga

SEQ ID NO: 16849 - RNA, 1413 nt, Artificial Sequence
  derived and/or modified CDS sequence (AUadapt) from InfluenzaA__ABA87234__NA
augaacucgaaccagaagaucaucaccaucggcuccaucagcaucgccaucgggaucaucucccugaugcuccagaucggcaacaucaucucgaucugggccucccacagcauccagaccgggucccagaaccacacgggcgugugcaaccagcgcaucaucaccuacgagaacagcaccugggucaaccacaccuacgugaacaucaacaacacgaacgugaucgcggggaaggacaagaccuccgucacccuggccggcaacucgucccugugcagcaucuccggcugggccaucuacaccaaggacaacagcauccggaucggguccaagggcgacguguucgugauccgcgagcccuucaucucgugcucccaccucgagugccggacguucuuccugacccagggggcccugcucaacgacaagcacagcaacggcaccgucaaggaccgcuccccguaccgggcccugaugucgugcccccugggggaggcgcccagccccuacaacuccaaguucgagagcguggccugguccgccucggccugccacgacggcaugggcuggcucaccaucgggaucuccggcccggacaacggggcgguggccguccugaaguacaacggcaucaucacggagaccaucaagagcuggaagaagcagauccugcgcacccaggaguccgagugcgugugcgugaacggcagcugcuucaccaucaugacggacgggcccuccaacggcgccgccucguacaagaucuucaagaucgagaaggggaaggucaucaaguccaucgagcucaacgcccccaacuuccacuacgaggagugcagcugcuaccccgacaccggcaccgugaugugcgugugccgggacaacuggcacggguccaaccgcccgugggucucguucaaccagaaccuggacuaccagaucggcuacaucugcuccggcguguucggggacaacccccggcccaaggacggcgaggggagcugcaaccccgugaccgucgacggcgcgaacggggugaagggcuucuccuacaaguacggcaacgggguguggaucggccgcaccaagagcaaccggcugcgcaagggguucgagaugaucugggacccgaacggcuggacggacaccgacuccgacuucucggucaagcaggacgugguggccaucaccgacuggagcggguacuccggcagcuucguccagcaccccgagcucacgggccuggacugcauccggcccugcuucuggguggagcugguccgcgggcuccccaaggagaacaccaccaucuggaccuccggcucguccaucagcuucugcggggugaacuccgacacggccaacuggagcuggccggacggcgccgagcugcccuucaccaucgacaaguga

SEQ ID NO: 16850 - RNA, 1410 nt, Artificial Sequence; identical to SEQ ID NO: 16784
  derived and/or modified CDS sequence (AUadapt) from InfluenzaA__ABB02784__NA

SEQ ID NO: 16851 - RNA, 1413 nt, Artificial Sequence; identical to SEQ ID NO: 16788
  derived and/or modified CDS sequence (AUadapt) from InfluenzaA__ABB02795__NA

SEQ ID NO: 16852 - RNA, 1413 nt, Artificial Sequence; identical to SEQ ID NO: 16788
  derived and/or modified CDS sequence (AUadapt) from InfluenzaA__ABB02806__NA

SEQ ID NO: 16853 - RNA, 1413 nt, Artificial Sequence
  derived and/or modified CDS sequence (AUadapt) from InfluenzaA__ABB02817__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcgugugcaaccagcgcaucaucaccuacgagaacuccaccugggucaaccacaccuacgugaacaucaacaacacgaacgugaucgcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcagauccugcgcacccaggagucggagugcgugugcgugaacggcuccugcuucaccaucaugacggacgggcccagcaacggcgccgccuccuacaagaucuucaagaucgagaaggggaaggucaccaagucgguggagcucaacgcccccaacuuccacuacgaggagugcuccugcuacccggacaccggcaccgugaugugcgucugccgggacaacuggcacgggagcaaccgccccuggguguccuucaaccagaaccuggacuaccagaucggcuacaucugcucgggcguguucggggacaacccccggcccaaggacggcgagggguccugcaacccggucacgguggacggcgcgaacggggugaagggcuucagcuacaaguacggcaacggggucuggaucggccgcaccaaguccaaccggcugcgcaagggguucgagaugaucugggaccccaacggcuggaccgacaccgacagcgacuucuccgugaagcaggacguggucgccaucacggacuggucgggguacagcggcuccuucgugcagcaccccgagcucaccggccuggacugcauccggcccugcuucugggucgagcuggugcgcgggcucccgaaggagaacaccaccaucuggacgucgggcuccagcaucuccuucugcggggugaacagcgacaccgccaacugguccuggcccgacggcgccgagcugcccuucaccaucgacaaguga

SEQ ID NO: 16854 - RNA, 1413 nt, Artificial Sequence; identical to SEQ ID NO: 16853
  derived and/or modified CDS sequence (AUadapt) from InfluenzaA__ABB02828__NA

SEQ ID NO: 16855 - RNA, 1410 nt, Artificial Sequence
  derived and/or modified CDS sequence (AUadapt) from InfluenzaA__ABB02839__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccagguggugcugugcgagcccacgaucaucgagcgcaacaucaccgagaucgucuaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggugacccgggagcccuacgugucgugcgaccccgacaagugcuaccaguucgcccucggccaggggaccacgcugaacaacguccacuccaacgacaccgugcacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccuggucgacuccaucgugagcugguccaaggagauccugcggacccaggagucggagugcgugugcaucaacggcacgugcaccgucgugaugaccgacggguccgccagcggcaaggccgacaccaagauccucuucaucgaggagggcaagaucgugcacacgucgacccuguccgggagcgcgcagcacgucgaggagugcuccugcuacccccgcuaccccggcgugcggugcgugugccgcgacaacuggaaggggucgaaccggccgaucgucgacaucaacaucaaggacuacuccaucgugagcuccuacgugugcucgggccuggucggcgacacgccccgcaagaacgacuccagcuccagcucccacugccucgaccccaacaacgaggagggcgggcacggggugaagggcugggccuucgacgacgggaacgacgucuggaugggccggaccaucucggagaagcugcgcuccggcuacgagaccuucaaggugaucgagggguggagcaaccccaacuccaagcugcagaucaaccgccaggugaucgucgaccggggcaaccggucgggguacuccggcaucuucagcguggagggcaagucgugcaucaaccgcugcuucuacguggagcucauccgggggcgcaaggaggagaccgagguccuguggaccuccaacagcaucgugguguucugcggcaccuccgggacguacggcaccgggagcuggccggacggcgccgacaucaaccugaugcccaucuga

SEQ ID NO: 16856 - RNA, 1410 nt, Artificial Sequence
  derived and/or modified CDS sequence (AUadapt) from InfluenzaA__ABB02850__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggucgaagccccagugcgacaucaccggguucgcgcccuucuccaaggacaacagcauccgccuguccgccggcggggacaucugggucacccgggagcccuacgugucgugcgacccggacaagugcuaccaguucgcccugggccaggggaccacgcucaacaacgugcacuccaacgacaccguccacgaccgcacccccuaccggacccugcugaugaacgagcucggcgugcccuuccaccugggcacgaagcaggucugcaucgccuggagcuccucguccugccacgacgggaaggccuggcugcacgugugcgugaccggcgacgacaagaacgcgaccgccagcuucaucuacaacgggcgccucguggacuccaucgucagcugguccaaggagauccugcggacccaggagucggagugcgugugcaucaacggcacgugcgccguggucaucaccgacggguccgccagcggcaaggcggacaccaagauccuguucaucgaggagggcaagaucgugcacaccucgaagcucuccgggagcgcccagcacguggaggagugcuccugcuacccccgcuacccgggcauccggugcgucugccgcgacaacuggaaggggucgaaccggcccaucguggacaucaacaucaaggacuacuccaucgugagcuccuacgucugcucgggccuggugggcgacacgccccgcaagaacgacuccagcuccagcucccugugccucgaccccaacaacgaggagggcgggcacggggugaagggcugggccuucgacgacgggaacgacgucuggaugggccggaccaucucggagaagcugcgcuccggcuacgagaccuucaaggugaucgagggguggagcaacccgaacuccaagcugcagaucaaccggcaggucaucguggaccgcggcaaccggucgggguacuccggcaucuucagcguggagggcaagucgugcaucaaccgcugcuucuacgucgagcucauccgggggcgcaaggaggagaccgaggugcuguggacguccaacagcaucguggucuucugcggcaccuccgggaccuacggcaccgggagcuggcccgacggcgccgacaucaaccugaugcccaucuga

SEQ ID NO: 16857 - RNA, 1410 nt, Artificial Sequence
  derived and/or modified CDS sequence (AUadapt) from InfluenzaA__ABB02861__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccgcgaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucucggccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccucguccagcugccacgacggcaaggccuggcugcacgucugcgugacgggggacgacgagaacgccaccgccuccuucaucuacgacggccggcugguggacucgaucggguccuggagcaagaagauccuccgcacccaggaguccgagugcgucugcaucaacgggaccugcacgguggugaugaccgacggcucggcguccgggaaggccgacaccaagauccuguucaucgaggagggcaagaucgucaacaucagcacccugucgggguccgcccagcacguggaggagugcucgugcuacccccgguaccccggcgugcgcugcgucugccgggacaacuggaagggcuccaaccgcccgaucguggacaucaacgugaaggacuacagcaucgucuccucguacgugugcuccgggcucgugggcgacacgccccggaagaacgacagcuucuccucgucccacugccuggaccccaacaacgaggagggcggccacggggucaagggcugggccuucgacgacggcaacgacguguggauggggcgcaccaucagcgagaagcugcgguccggcuacgagaccuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaaggaggagaccgaggugugguggacgagcaacucgaucgucguguucugcggcaccuccgggaccuacggcaccgggagcuggccggacggcgccgacaucgaccugaugcccaucuga

SEQ ID NO: 16858 - RNA, 1410 nt, Artificial Sequence; identical to SEQ ID NO: 16655
  derived and/or modified CDS sequence (AUadapt) from InfluenzaA__ABB02872__NA

SEQ ID NO: 16859 - RNA, 1410 nt, Artificial Sequence; identical to SEQ ID NO: 16655
  derived and/or modified CDS sequence (AUadapt) from InfluenzaA__ABB02883__NA

SEQ ID NO: 16860 - RNA, 1410 nt, Artificial Sequence
  derived and/or modified CDS sequence (AUadapt) from InfluenzaA__ABB02894__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagauggucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccucguccucgugccacgacggcaaggcguggcugcacgugugcgugaccggggacgacgagaacgccaccgccuccuucaucuacaacggccgccugguggacagcaucggguccuggucgaagaagauccuccggacccaggaguccgagugcgucugcaucaacggcacgugcaccguggugaugaccgacggcagcgccuccgggaaggcggacaccaagauccuguucaucgaggagggcaagaucguccacacgucgcugcucagcggguccgcccagcacguggaggagugcucgugcuacccccgcuaccccggcgugcggugcgucugccgcgacaacuggaagggcuccaaccggccgaucguggacaucaacgugaaggacuacucgaucgucuccagcuacgugugcuccgggcuggugggcgacacgccccgcaagaacgacucguccagcuccucgcacugccuggaccccaacaacgaggagggcgggcacggggucaagggcugggccuucgacgacggcaacgacguguggauggggcggaccaucuccgagaagcuccgcucgggcuacgagaccuucaaggucaucgaggggugguccaagcccaacagcaagcugcagaucaaccgccaggugaucguggaccggggcaaccgguccggguacucgggcaucuucuccgucgagggcaagagcugcaucaaccgcugcuucuacguggagcugauccgggggcgcaagcaggagaccgaggugcucuggaccucgaacuccaucgucguguucugcggcaccagcgggaccuacggcacgggguccuggccggacggcgccgacaucaaccugaugcccaucuga

SEQ ID NO: 16861 - RNA, 1410 nt, Artificial Sequence; identical to SEQ ID NO: 16463
  derived and/or modified CDS sequence (AUadapt) from InfluenzaA__ABB02905__NA

SEQ ID NO: 16862 - RNA, 1413 nt, Artificial Sequence
  derived and/or modified CDS sequence (AUadapt) from InfluenzaA__ABB02916__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcgugugcaaccagcgcaucaucaccuacgagaacuccaccugggucaaccacaccuacgugaacaucaacaacacgaacgugaucgcggagaaggacaagaccucggucacccuggccgggaacuccagccugugcuccaucagcggcugggccaucuacaccaaggacaacuccauccggaucggcucgaagggggacguguucgugauccgcgagccguucaucuccugcagccaccucgagugccggacguucuuccugacccagggcgcccugcucaacgacaagcacuccaacgggaccgucaaggaccgcucgcccuaccgggcccugauguccugcccccugggcgaggcgcccagcccguacaacucgaaguucgaguccguggccuggagcgccuccgccugccacgacgggaugggcuggcucaccaucggcaucagcgggcccgacaacggcgcgguggccguccugaaguacaacgggaucaucacggagaccaucaaguccuggaagaagcagauccugcgcacccaggagucggagugcgugugcgugaacggcuccugcuucaccaucaugacggacggccccagcaacggggccgccuccuacaagaucuucaagaucgagaagggcaaggucaccaagucgaucgagcucaacgcccccaacuuccacuacgaggagugcuccugcuacccggacaccgggaccgugaugugcgugugccgggacaacuggcacggcagcaaccgccccugggucuccuucaaccagaaccuggacuaccagaucggguacaucugcucgggcguguucggcgacaacccccggccccgcgacggggagggcuccugcaacccggugacggucgacggggcgaacggcgugaagggguucagcuacaaguacggcaacggcguguggaucgggcggaccaaguccaaccgccugcggaagggcuucgagaugaucugggaccccaacggguggaccgacaccgacagcgacuucuccgucaagcaggacgugguggccaucacggacuggucgggcuacagcggguccuucguccagcaccccgagcucaccggccuggacugcauccgccccugcuucuggguggagcugguccggggccucccgcgcgagaacaccaccaucuggacgucgggguccagcaucuccuucugcggcgugaacagcgacaccgccaacugguccuggcccgacggggccgagcugcccuucaccaucgacaaguga

SEQ ID NO: 16863 - RNA, 1413 nt, Artificial Sequence
  derived and/or modified CDS sequence (AUadapt) from InfluenzaA__ABB02927__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagucggagugcgugugcgugaacggcuccugcuucaccaucaugacggacgggcccagcaacggcgccgccuccuacaagaucuucaagaucgagaaggggaaggucaccaagucgaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcucgggcguguucggggacaacccccgccccaaggacggcgagggguccugcaacccggugacggucgacggcgcggacggggugaagggcuucagcuacaaguacggcaacgggguguggaucggccggaccaaguccaacaagcugcgcaagggguucgagaugaucugggaccccaacggcuggaccgacaccgacagcgacuucuccgucaagcaggacgugguggccaucacggacuggucgggguacagcggcuccuucguccagcaccccgagcucaccggccuggacugcauccggcccugcuucuggguggagcugguccgcgggcucccgcgggagaacaccaccaucuggacgucgggcuccagcaucuccuucugcggggugaacagcgacaccgccaacugguccuggcccgacggcgccgagcugcccuucaccaucgacaaguga

SEQ ID NO: 16864 - RNA, 1413 nt, Artificial Sequence
  derived and/or modified CDS sequence (AUadapt) from InfluenzaA__ABB02939__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcgugugcaaccagcgcaucaucaccuacgagaacuccaccuggaugaaccacaccuacgucaacaucaacaacacgaacgugaucgcggggaaggacaagaccucggugacccuggccggcaacuccagccugugcuccaucagcggcugggccaucuacaccaaggacaacuccauccggaucgggucgaagggcgacgucuucgugauccgcgagccguucaucuccugcagccaccucgagugccggacguucuuccugacccagggggcccugcucaacgacaagcacuccaacggcaccgugaaggaccgcucgcccuaccgggcccugauguccugcccccugggggaggcgcccagcccguacaacucgaaguucgaguccgucgccuggagcgccuccgccugccacgacggcaugggcuggcucaccaucgggaucagcggccccgacaacggggcgguggccgugcugaaguacaacggcaucaucacggagaccaucaaguccuggaagaagcagauccugcgcacccaggagucggagugcgucugcgugaacggcuccugcuucaccaucaugacggacgggcccagcaacggcgccgccuccuacaagaucuucaagaucgagaaggggaaggugaccaagucgauggagcucaacgcccccaacuuccacuacgaggagugcuccugcuacccggacaccggcaccgucaugugcgugugccgggacaacuggcacgggagcaaccgccccuggguguccuucaaccagaaccuggacuaccagaucggcuacaucugcucgggcgucuucggggacaacccccggcccaaggacggcgagggguccugcaacccggugacgguggacggcgcgaacggggucaagggcuucagcuacaaguacggcaacgggguguggaucggccgcaccaaguccaaccggcugcgcaagggguucgagaugaucugggaccccaacggcuggaccgacaccgacagcgacuucuccgugaagcaggacgucguggccaucacggacuggucgggguacagcggcuccuucgugcagcaccccgagcucaccggccuggacugcauccggcccugcuucugggucgagcuggugcgcgggcucccgaaggagaacaccaccaucuggacgucgggcuccagcaucuccuucugcggggucaacagcgacaccgccaacugguccuggcccgacggcgccgagcugcccuucaccaucgacaaguga

SEQ ID NO: 16865 - RNA, 1410 nt, Artificial Sequence; identical to SEQ ID NO: 16780
  derived and/or modified CDS sequence (AUadapt) from InfluenzaA__ABB02950__NA

SEQ ID NO: 16866 - RNA, 1410 nt, Artificial Sequence; identical to SEQ ID NO: 16681
  derived and/or modified CDS sequence (AUadapt) from InfluenzaA__ABB02961__NA

SEQ ID NO: 16867 - RNA, 1410 nt, Artificial Sequence; identical to SEQ ID NO: 16681
  derived and/or modified CDS sequence (AUadapt) from InfluenzaA__ABB02972__NA

SEQ ID NO: 16868 - RNA, 1410 nt, Artificial Sequence; identical to SEQ ID NO: 16681
  derived and/or modified CDS sequence (AUadapt) from InfluenzaA__ABB02983__NA

SEQ ID NO: 16869 - RNA, 1410 nt, Artificial Sequence; identical to SEQ ID NO: 16681
  derived and/or modified CDS sequence (AUadapt) from InfluenzaA__ABB02994__NA

SEQ ID NO: 16870 - RNA, 1410 nt, Artificial Sequence; identical to SEQ ID NO: 16681
  derived and/or modified CDS sequence (AUadapt) from InfluenzaA__ABB03005__NA

SEQ ID NO: 16871 - RNA, 1410 nt, Artificial Sequence; identical to SEQ ID NO: 16686
  derived and/or modified CDS sequence (AUadapt) from InfluenzaA__ABB03016__NA

SEQ ID NO: 16872 - RNA, 1410 nt, Artificial Sequence; identical to SEQ ID NO: 16681
  derived and/or modified CDS sequence (AUadapt) from InfluenzaA__ABB03027__NA

SEQ ID NO: 16873 - RNA, 1410 nt, Artificial Sequence; identical to SEQ ID NO: 16686
  derived and/or modified CDS sequence (AUadapt) from InfluenzaA__ABB03038__NA

SEQ ID NO: 16874 - RNA, 1410 nt, Artificial Sequence; identical to SEQ ID NO: 16681
  derived and/or modified CDS sequence (AUadapt) from InfluenzaA__ABB03049__NA

SEQ ID NO: 16875 - RNA, 1410 nt, Artificial Sequence
  derived and/or modified CDS sequence (AUadapt) from InfluenzaA__ABB03060__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaaggagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcauccggugcgucugccgcgacaacuggaaggggucgaaccggccgaucguggacaucaacaucaaggacuacuccaucgugagcuccuacgucugcucgggccuggugggcgacacgccccgcaagaacgacuccagcuccagcucccacugccucgaccccaacaacgaggagggcgggcacggggugaagggcugggccuucgacgacgggaacgacgucuggaugggccggaccaucucggagaagcugcgcuccggcuacgagaccuucaaggugaucgagggguggagcaaccccaacuccaagcugcagaucaaccggcaggucaucguggaccgcggcaaccggucgggguacuccggcaucuucagcguggagggcaagucgugcaucaaccgcugcuucuacgucgagcucauccgggggcgcaaggaggagaccgaggugcuguggaccuccaacagcaucguggucuucugcggcaccuccgggacguacggcaccgggagcuggccggacggcgccgacaucaaccugaugcccaucuga

SEQ ID NO: 16876 - RNA, 1410 nt, Artificial Sequence
  derived and/or modified CDS sequence (AUadapt) from InfluenzaA__ABB03071__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgggaucaccggcuucgcgcccuucuccaaggacaacagcauccgccuguccgccgggggcgacaucugggucacccgggagcccuacgugucgugcgaccccgacaagugcuaccaguucgcccucgggcagggcaccacgcugaacaacgugcacuccaacgacaccguccacgaccgcaccccguaccggacccugcucaugaacgagcugggcgugcccuuccaccuggggacgaagcaggucugcaucgccuggagcuccucguccugccacgacggcaaggccuggcuccacgugugcgugaccggggacgacaagaacgcgaccgccagcuucaucuacaacggccgccugguggacuccaucgucagcugguccaaggagauccugcggacccaggagucggagugcgugugcaucaacgggacgugcaccguggucaugaccgacggcuccgccagcggcaaggccgacaccaagauccucuucaucgaggaggggaagaucgugcacacgucgacccuguccggcagcgcgcagcacguggaggagugcuccugcuacccccgcuaccccgggguccggugcgugugccgcgacaacuggaagggcucgaaccggccgaucguggacaucaacaucaaggacuacuccaucgucagcuccuacgugugcucgggccuggugggggacacgccccgcaagaacgacuccagcuccagcucccacugccucgaccccaacaacgaggagggcgggcacggcgucaaggggugggccuucgacgacggcaacgacguguggaugggccggaccaucucggagaagcugcgcuccggguacgagaccuucaaggucaucgagggcuggagcaaccccaacuccaagcugcagaucaaccgccaggugaucguggacaaggggaaccggucgggcuacuccgggaucuucagcgucgagggcaagucgugcaucaaccggugcuucuacguggagcucauccgcggccggaaggaggagaccgaggugcuguggaccuccaacagcaucgucguguucugcgggaccuccggcacguacgggaccggcagcuggccggacggggccgacaucaaccugaugcccaucuga

SEQ ID NO: 16877 - RNA, 1410 nt, Artificial Sequence
  derived and/or modified CDS sequence (AUadapt) from InfluenzaA__ABB03093__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaaggagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacaucgaggagugcuccugcuacccccgcuaccccggcgugcggugcgucugccgcgacaacuggaaggggucgaaccggccgaucguggacaucaacaucaaggacuacuccaucgugagcuccuacgucugcucgggccuggugggcgacacgccccgcaagaacgacuccagcuccagcucccacugccucgaccccaacaacgaggagggcgggcacggggugaagggcugggccuucgacgacgggaacgacgucuggaugggccggaccaucucggagaagcugcgcuccggcuacgagaccuucaaggugaucgagggguggagcaaccccaacuccaagcugcagaucaaccggcaggucaucguggaccgcggcaaccggucgggguacuccggcaucuucagcguggagggcaagucgugcaucaaccgcugcuucuacgucgagcucauccgggggcgcaaggaggagaccgaggugcuguggaccuccaacagcaucguggucuucugcggcaccuccgggacguacggcaccgggagcuggccggacggcgccgacaucaaccugaugcccaucuga

SEQ ID NO: 16878 - RNA, 1410 nt, Artificial Sequence; identical to SEQ ID NO: 16784
  derived and/or modified CDS sequence (AUadapt) from InfluenzaA__ABB03104__NA

SEQ ID NO: 16879 - RNA, 1410 nt, Artificial Sequence
  derived and/or modified CDS sequence (AUadapt) from InfluenzaA__ABB03115__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacgagaacgcgaccgccagcuucaucuacaacgggcgccugguggacuccaucgucagcugguccaagaagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaagcaggagaacgaggugcuguggaccuccaacagcaucgucguguucugcggcaccuccgggaccuacggcacggggagcuggccggacggcgccgacaucaaccugaugcccaucuga

SEQ ID NO: 16880 - RNA, 1413 nt, Artificial Sequence; identical to SEQ ID NO: 16788
  derived and/or modified CDS sequence (AUadapt) from InfluenzaA__ABB03126__NA

SEQ ID NO: 16881 - RNA, 1413 nt, Artificial Sequence
  derived and/or modified CDS sequence (AUadapt) from InfluenzaA__ABB03148__NA
augaaccccaaccagaagaucaucaccaucggcucgaucuccaucgccaucgggaccaucagccugaugcuccagaucggcaacaucaucuccaucugggccucgcacuccauccagacggggagccagaaccacaccggcaucugcaaccagcgcaucaucaccuacgagaacuccaccugggugaaccacacguacgucaacaucaacaacaccaacgugguggcggggaaggacaagaccucggucacccuggccggcaacuccagccugugcuccaucucgggcugggccaucuacacgaaggacaacuccauccggaucgggagcaagggcgacguguucgugauccgcgagccguucaucuccugcucgcaccucgagugccggaccuucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucacgaucgggaucucgggccccgacaacggggcgguggccguccugaaguacaacggcaucaucaccgagaccaucaaguccuggaagaagcgcauccugcggacccaggagagcgagugcgugugcgugaacggcuccugcuucacgaucaugaccgacgggcccucgaacggcgccgccuccuacaagaucuucaagaucgagaaggggaaggucaccaagagcaucgagcucaacgcccccaacuuccacuacgaggagugcuccugcuacccggacaccggcacggugaugugcgugugccgcgacaacuggcacgggucgaaccggcccugggucuccuucaaccagaaccuggacuaccagaucggcuacaucugcagcggcguguucggggacaacccccgccccaaggacggcaagggguccugcaacccggugaccgucgacggcgcggacggggugaagggcuucucguacaaguacggcaacgggguguggaucggccggaccaaguccaaccgccugcggaagggguucgagaugaucugggaccccaacggcuggaccgacacggacagcgacuucuccgucaagcaggacgugguggccaucaccgacuggucgggguacagcggcuccuucguccagcaccccgagcucaccggccuggacugcauccgccccugcuucuggguggagcugguccgggggcucccgcgcgagaacaccacgaucuggaccucgggcuccagcaucuccuucugcgggguggacagcgacaccgccaacugguccuggcccgacggcgccgagcugcccuucaccaucgacaaguga

SEQ ID NO: 16882 - RNA, 1410 nt, Artificial Sequence
  derived and/or modified CDS sequence (AUadapt) from InfluenzaA__ABB04286__NA
augaaccccaaccagaagaucaucaccaucggcucggugucccugaccaucgccacgaucugcuuccucaugcagaucgccauccuggucaccaccgugacccugcacuucaagcaguacgagugcucguccccgcccaacaaccaggugaugcccugcgagcccaucaucaucgagcgcaacaucacggagaucgucuaccucaccaacaccaccaucgagaaggagaucugcccgaagcugguggaguaccggaacuggagcaagccccagugcaagaucacgggguucgcgcccuucuccaaggacaacucgauccgccuguccgccggcggggacaucugggugacccgggagcccuacgucagcugcgacccgggcaagugcuaccaguucgcccucgggcagggcaccacccuggacaacaagcacuccaacgacacgauccacgaccgcacgccccaccggacccugcucaugaacgagcugggcgugcccuuccaccuggggacccgccaggugugcaucgccuggucguccagcuccugccacgacggcaaggccuggcuccacgucugcgugaccggguacgacaagaacgcgaccgccucguucaucuacgacggccggcugguggacuccaucgggagcugguccaagaacauccugcgcacccaggagucggagugcgucugcaucaacgggaccugcacgguggugaugaccgacggcuccgccagcgagcgggccgacaccaagauccucuucaucgaggagggcaagaucguccacaucucgccccuguccggcagcgcgcagcacguggaggagugcuccugcuacccgcgcuaccccggggugcggugcgucugccgcgacaacuggaagggcucgaaccggcccgugguggacaucaacgucaaggacuacuccaucgugucguccuacgugugcagcggccuggucggggacacgccccgcaagaacgaccgguccucguccagcuacugccgcaacccgaacaacgagaagggcaaccacggggugaagggcugggccuucgacgacgggaacgacgucuggaugggccggaccaucuccgaggagucgcgcuccggcuacgagaccuucaaggugaucgggggcuggagcacccccaacuccaagucgcagaucaaccgccaggugaucgucgacuccgggaaccggagcggcuacucggggaucuucuccguggagggcaagagcugcaucaaccggugcuucuacguggagcucauccgcggccgcgagcaggagacccgggucugguggacguccaacucgaucgugguguucugcgggaccuccggcaccuacgggaccggcagcuggcccgacggggccgacaucaaccugaugcccaucuga

SEQ ID NO: 16883 - RNA, 1410 nt, Artificial Sequence
  derived and/or modified CDS sequence (AUadapt) from InfluenzaA__ABB04297__NA
augaaccccaaccagaagaucaucaccaucggcucggugucccugaccaucgccacgaucugcuuccucaugcagaucgccauccuggucaccaccgugacccugcacuucaagcaguacgagugcgacucgccggcgaacaaccaggugauccccugcgagcccaucacgaucgagcgcaacaucaccgagaucgucuaccucaccaacaccacgaucgagaaggagaucugccccaagcugguggaguaccggaacugguccaagccgcagugcaagaucaccggguucgcccccuucagcaaggacaacuccauccgccugucggccggcggggacaucugggugacccgggagcccuacgucuccugcgaccccggcaagugcuaccaguucgcccucgggcagggcaccacgcuggacaacaagcacucgaacgacaccauccacgaccgcaccccgcaccggacccugcucaugaacgagcugggcgugcccuuccaccuggggacgcgccaggugugcaucgccugguccagcuccucgugccacgacggcaaggcguggcuccacgucugcgugaccggguacgacaagaacgccaccgccuccuucaucuacgacggccggcugguggacucgaucggguccuggagccagaacauccugcgcacccaggaguccgagugcgucugcaucaacggcacgugcaccguggugaugaccgacggcucggccuccgggcgggcggacaccaagauccucuucaucgaggagggcaagaucguccacaucucgccccugagcggguccgcccagcacguggaggagugcucgugcuacccccgcuacccgggcgugcggugcaucugccgcgacaacuggaagggcuccaaccggcccgucguggacaucaacgugaaggacuacucgaucgacuccagcuacgucugcuccgggcuggugggcgacacgccccgcaacaacgaccggucguccaacucguacugccgcaaccccaacaacgagaaggggaaccacggcgugaaggggugggccuucgacgacggcaacgacgucuggaugggccggaccaucuccgaggacagccgcuccggguacgagaccuucaaggugaucggcggguggucgaccccgaacuccaagcuccagaucaaccggcaggucaucguggacucggacaaccgcuccggcuacagcgggaucuucuccguggagggcaagucgugcaucaaccggugcuucuacgucgagcugauccgcggccgcgagcaggagacgcgggugugguggaccucgaacuccaucguggucuucugcgggaccagcggcaccuacgggacgggcuccuggcccgacggggccgacaucaaccugaugcccaucuga

SEQ ID NO: 16884 - RNA, 1410 nt, Artificial Sequence
  derived and/or modified CDS sequence (AUadapt) from InfluenzaA__ABB04319__NA
augaaccccaaccagaagaucaucaccaucggcucggugucccugaccaucgccacgaucugcuuccucaugcagaucgccauccuggucaccaccgugacccugcacuucaagcaguacgagugcucguccccgcccaacaaccaggugaugcccugcgagcccacgaucaucgagcgcaacaucaccgagaucgucuaccucaccaacaccacgaucgagaaggagaucugcccgaagcugguggaguaccggaacuggagcaagccccagugcaagaucaccggguucgcgcccuucuccaaggacaacucgauccgccuguccgccggcggggacaucugggugacccgggagcccuacgucagcugcgacccgggcaagugcuaccaguucgcccucgggcagggcaccacgcugaacaaccgccacuccaacgacaccgugcacgaccggacccccuaccgcacccugcucaugaacgagcugggcgugcccuuccaccuggggacgaagcaggucugcaucgccuggucguccagcuccugccacgacggcaaggccuggcuccacgugugcgugaccgggcacgacaagaacgcgaccgccucguucaucuacaacggccggcuggucgacuccaucgggucgugguccaagaacauccugcgcacccaggagagcgagugcgugugcaucaacggcacgugcaccguggucaugaccgacggcuccgccucggagcgggccgacaccaagauccucuucaucgaggaggggaagaucgugcacaucagcccccuguccggcucggcgcagcacguggaggagugcuccugcuacccgcgcuaccccgggguccggugcgugugccgcgacaacuggaagggcagcaaccggcccaucguggacaucaacgucaaggacuacuccaucgugucguccuacgugugcagcggccuggucggggacacgccccgcaagaacgaccgguccucguccucguacugccagaacccgaacaacgagaagggcucccacggggugaagggcugggccuucgacgacgggaacgacgucuggaugggccgcaccaucggcgaggagcuccggagcggguacgagaccuucaaggugaucggcgggugguccacccccaacucgaagcugcagaucaaccgccaggugaucgucgacuccggcaaccggagcggguacuccggcaucuucucgguggagggcaagagcugcaucaaccgcugcuucuacguggagcugauccgggggcgcaagcaggagacgcgcgucugguggaccuccaacucgaucgugguguucugcggcaccuccgggaccuacggcacggggagcuggcccgacggcgccgacaucaaccucaugcccaucuga

SEQ ID NO: 16885 - RNA, 1410 nt, Artificial Sequence
  derived and/or modified CDS sequence (AUadapt) from InfluenzaA__ABB04341__NA
augaaccccaaccagaagaucaucaccaucggcucggugucccugaccaucgccacgaucugcuuccucaugcagaucgccauccuggucaccaccgugacccugcacuucaagcaguacgagugcgacucgccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccgugcgccugucggccggcggggacaucugggucacccgggagcccuacguguccugcgaccccggcaagugcuaccaguucgcccucgggcagggcaccacccuggacaacaagcacucgaacgacacgauccacgaccgcaccccgcaccggacccugcucaugaacgagcugggcgugcccuuccaccuggggacccgccaggucugcaucgccugguccagcuccucgugccacgacggcaaggcguggcuccacgugugcgugacgggguacgacaagaacgccaccgccuccuucaucuacgacggccggcuggucgacagcaucggguccuggucgcagaacauccugcgcacccaggaguccgagugcgugugcaucaacgggaccugcacgguggucaugaccgacggcucggccuccggccgggcggacaccaagauccucuucaucgaggagggcaagaucgugcacaucagcccccugucgggguccgcccagcacguggaggagugcucgugcuacccccgcuacccgggcguccggugcaucugccgcgacaacuggaagggcuccaaccggcccgugguggacaucaacgucaaggacuacagcaucgacuccucguacgugugcuccgggcuggugggcgacacgccccgcaagaacgaccggagcuccaacucguacugccgcaaccccaacaacgagaaggggaaccacggcgucaaggggugggccuucgacgacggcaacgacguguggaugggccggaccaucuccgaggacucgcgcuccggguacgagaccuucaaggucaucggcggguggagcaccccgaacuccaagcuccagaucaaccgccaggugaucguggacucggacaaccgguccggcuacucggggaucuucuccgucgagggcaagagcugcaucaaccggugcuucuacguggagcugauccgcggccgcgagcaggagacccgggugugguggacgucgaacuccaucgucguguucugcgggaccagcggcaccuacgggaccggcuccuggcccgacggggccgacaucaaccugaugcccaucuga

SEQ ID NO: 16886 - RNA, 1410 nt, Artificial Sequence
  derived and/or modified CDS sequence (AUadapt) from InfluenzaA__ABB04352__NA
augaaccccaaccagaagaucaucaccaucggcucggugucccugaccaucgccacgaucugcuuccucaugcagaucgccauccuggucaccaccgugacccugcacuucaagcaguacgagugcucguccccgcccaacaaccaggugaugcccugcgagcccaucaucaucgagcgcaacaucacggagaucgucuaccucaccaacaccaccaucgagaaggagaucugcccgaagcugguggaguaccggaacuggagcaagccccagugcaagaucacgggguucgcgcccuucuccaaggacaacucgauccgccuguccgccggcggggacaucugggugacccgggagcccuacgucagcugcgacccgggcaagugcuaccaguucgcccucgggcagggcaccacccugaacaacaagcacuccaacgacacggugcacgaccgcacccccuaccggacccugcucaugaacgagcugggcgugcccuuccaccuggggaccaagcaggucugcaucgccuggucguccagcuccugccacgacggcaaggccuggcuccacgugugcgugacggggcacgacaagaacgcgaccgccucguucaucuacgacggccgccuggucgacuccaucgggagcugguccaagaacauccugcggacccaggagucggagugcgugugcaucaacgggaccugcacgguggucaugaccgacggcuccgccagcgagcgcgccgacaccaagauccucuucaucgaggagggcaagaucgugcacaucucgccccuguccggcagcgcgcagcacguggaggagugcuccugcuacccgcgguaccccgggguccgcugcgugugccgggacaacuggaagggcucgaaccgccccaucguggacaucaacgucaaggacuacuccaucgugagcuccuacgugugcucgggccuggucggggacacgccccggaagaacgaccgcuccagcuccucguacugccggaacccgaacaacgagaagggcucccacggggugaagggcugggccuucgacgacgggaacgacgucuggaugggccgcaccaucggcgaggagcuccggagcggguacgagaccuucaaggugaucggcgggugguccacccccaacucgaagcugcagaucaaccgccaggugaucgucgacuccggcaaccggagcggguacuccggcaucuucucgguggagggcaagagcugcaucaaccgcugcuucuacguggagcugauccgggggcgcgagcaggagacccgcgucugguggacguccaacucgaucgugguguucugcggcaccuccgggaccuacggcaccgggagcuggcccgacggcgccgacaucaaccucaugcccaucuga

SEQ ID NO: 16887 - RNA, 1410 nt, Artificial Sequence
  derived and/or modified CDS sequence (AUadapt) from InfluenzaA__ABB04374__NA
augaaccccaaccagaagaucaucaccaucggcucggugucccugaccaucgccacggucugcuuccucaugcagaucgccauccuggugaccaccgugacccugcacuucaagcaguacgagugcgacucgccggcgaacaaccaggucaugcccugcgagcccaucaucaucgagcgcaacaucacggagaucguguaccucaccaacaccaccaucgagaaggagaucugccccaagcugguggaguaccggaacugguccaagccgcagugcaagaucacgggguucgcccccuucucgaaggacaacuccauccgccugagcgccggcggggacaucugggucacccgggagcccuacguguccugcgaccccggcaagugcuaccaguucgcccucgggcagggcaccacccuggacaacaagcacucgaacgacacgauccacgaccgcaucccgcaccggacccugcucaugaacgagcugggcgugcccuuccaccuggggacccgccaggucugcaucgccugguccucguccagcugccacgacggcaaggcguggcuccacgugugcgugaccggggacgacgagaacgccacggccuccuucaucuacgacggccggcuggucgacucgaucggguccuggucgcagaacauccugcgcacccaggaguccgagugcgugugcaucaacgggaccugcaccguggucaugacggacggcucggccuccggccgggcggacacccgcauccucuucaucgaggagggcaagaucgugcacaucagcccccugucgggguccgcccagcacguggaggagugcucgugcuacccccgguacccgggcguccgcugcaucugccgggacaacuggaagggcuccaaccgccccgugguggacaucaacgucaaggacuacagcaucgacucccgguacgugugcucggggcuggugggcgacacgccccgcaacaacgacaaguccucgaacuccaacugccggaaccccaacaacgacaaggggaaccacggcgucaaggggugggccuucgacgacggcaacgacguguggaugggccgcaccaucucgaaggacucccggagcggguacgagaccuucaaggucaucggcgggugguccaccccgaacucgaagucccagaucaaccgccaggugaucguggacucggacaaccgguccggcuacagcgggaucuucuccgucgagggcaagucgugcaucaaccgcugcuucuacguggagcucauccgcggccgggagcaggagaccaaggugugguggaccucgaacuccaucgucguguucugcgggacgagcggcaccuacgggaccggcuccuggcccgacggggccgacaucaaccugaugcccaucuga

SEQ ID NO: 16888 - RNA, 1410 nt, Artificial Sequence
  derived and/or modified CDS sequence (AUadapt) from InfluenzaA__ABB04931__NA
augaaccccaaccagaagaucaucaccaucggcucggugucccugaccaucgccacgaucugcuuccucaugcagaucgccauccuggucaccaccgugacccugcacuucaagcaguacgagugcgacucgccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccauccgccugucggccggcggggacaucugggugacccgggagcccuacgucuccugcgaccccggcaagugcuaccaguucgcccucgggcagggcaccacccuggacaacaagcacagcaacgacacgauccacgaccgcaccccgcaccggacccugcucaugaacgagcugggcgugcccuuccaccuggggacccgccaggugugcaucgccugguccucguccucgugccacgacggcaaggcguggcuccacgucugcgugacgggguacgacaagaacgccaccgccuccuucaucuacgacggccggcugguggacagcaucggguccuggucgcagaacauccugcgcacccaggaguccgagugcgucugcaucaacgggaccugcacgguggugaugaccgacggcagcgccuccggccgggcggacaccaagauccucuucaucgaggagggcaagaucguccacaucucgccccugucgggguccgcccagcacguggaggagugcagcugcuacccccgcuacccgggcgugcggugcaucugccgcgacaacuggaagggcuccaaccggcccgucguggacaucaacgugaaggacuacucgaucgacuccagcuacgucugcuccgggcuggugggcgacacgccccgcaacaacgaccggucguccucguccuacugccgcaaccccaacaacgagaaggggaagcacggcgugaaggggugggccuucgacgacggcaacgacgucuggaugggccggaccaucagcgaggacucccgcucgggguacgagaccuucaaggugaucggcgggugguccaccccgaacagcaagcuccagaucaaccggcaggucaucguggacuccgacaaccgcucgggcuacuccgggaucuucucgguggagggcaagagcugcaucaaccggugcuucuacgucgagcugauccgcggccgcgagcaggagacccgggugugguggacguccaacucgaucguggucuucugcgggaccuccggcaccuacgggaccggcagcuggcccgacggggccgacaucaaccugaugcccaucuga

SEQ ID NO: 16889 - RNA, 1410 nt, Artificial Sequence
  derived and/or modified CDS sequence (AUadapt) from InfluenzaA__ABB04942__NA
augaaccccaaccagaagaucaucaccaucggcucggugucccugaccaucgccacgaucugcuuccucaugcagaucgccauccuggucaccaccgugacccugcacuucaagcaguacgagugcucguccccgcccaacaaccaggugaugcccugcgagcccaucaucaucgagcgcaacaucacggagaucgucuaccucaccaacaccaccaucgagaaggagaucugcccgaagcugguggaguaccggaacuggagcaagccccagugcaagaucacgggguucgcgcccuucuccaaggacaacucgauccgccuguccgccggcggggacaucugggugacccgggagcccuacgucagcugcgacccgggcaagugcuaccaguucgcccucgggcagggcaccacccugaacaacaagcacuccaacgacacgauccacgaccgcacccccuaccggacccugcucaugaacgagcugggcgugcccuuccaccuggggaccaagcaggucugcaucgccuggucguccagcuccugccacgacggcaaggccuggcuccacgugugcgugacggggcacgacaagaacgcgaccgccucguucaucuacgacggccgccugguggacuccaucgggagcugguccaagaacauccugcggacccaggagucggagugcgucugcaucaacgggaccugcacgguggugaugaccgacggcuccgccagcgagcgcgccgacaccaagauccucuucaucgaggagggcaagaucguccacaucucgccccuguccggcucggcgcagcacguggaggagugcuccugcuacccgcgguaccccggggugcgcugcgucugccgggacaacuggaagggcagcaaccgccccaucguggacaucaacgugaaggacuacuccaucgucucguccuacgugugcagcggccuggugggggacacgccccggaagaacgaccgcuccucguccagcuacugccggaacccgaacaacgagaagggcaaccacggggucaagggcugggccuucgacgacgggaacgacguguggaugggccgcaccaucggcgaggagcuccgguccggguacgagaccuucaaggucaucggcggguggucgacccccaacuccaagcugcagaucaaccgccaggugaucguggacagcgacaaccgguccggcuacucggggaucuucuccgucgagggcaagagcugcaucaaccgcugcuucuacguggagcugauccggggccgcgagcaggagacccgcgugugguggacgucgaacuccaucgucguguucugcgggaccagcggcaccuacgggaccggcuccuggcccgacggggccgacaucaaccucaugcccaucuga

SEQ ID NO: 16890 - RNA, 1410 nt, Artificial Sequence; identical to SEQ ID NO: 16886
  derived and/or modified CDS sequence (AUadapt) from InfluenzaA__ABB04953__NA

SEQ ID NO: 16891 - RNA, 1410 nt, Artificial Sequence; identical to SEQ ID NO: 16784
  derived and/or modified CDS sequence (AUadapt) from InfluenzaA__ABB04975__NA

SEQ ID NO: 16892 - RNA, 1410 nt, Artificial Sequence; identical to SEQ ID NO: 16582
  derived and/or modified CDS sequence (AUadapt) from InfluenzaA__ABB04986__NA

SEQ ID NO: 16893 - RNA, 1410 nt, Artificial Sequence
  derived and/or modified CDS sequence (AUadapt) from InfluenzaA__ABB04997__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucguccaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacucgaacgacaccguccacgaccgcaccccguaccggacccuccugaugaacgagcugggcgugcccuuccaccucgggacgaagcaggucugcaucgccugguccagcuccucgugccacgacggcaaggcguggcugcacgugugcgugaccggggacgacgagaacgccaccgccuccuucaucuacaacggccgccugguggacucgaucggguccuggagcaagaagauccuccggacccaggaguccgagugcgucugcaucaacggcacgugcaccguggugaugaccgacggcucggccuccgggaaggcggacaccaagauccuguucaucgaggagggcaagaucguccacacgucgcugcucagcggguccgcccagcacguggaggagugcucgugcuacccccgcuaccccggcgugcggugcgucugccgcgacaacuggaagggcuccaaccggccgaucguggacaucaacgugaaggacuacucgaucgucuccagcuacgugugcuccgggcuggugggcgacacgccccgcaagaacgacucguccucguccagccacugccuggaccccaacaacgaggagggcgggcacggggucaagggcugggccuucgacgacggcaacgacguguggauggggcggaccaucuccgagaagcuccgcucgggcuacgagaccuucaaggucaucgaggggugguccaagcccaacucgaagcugcagaucaaccgccaggugaucguggaccggggcaaccgguccggguacagcggcaucuucuccgucgagggcaagucgugcaucaaccgcugcuucuacguggagcugauccgggggcgcaagcaggagaccgaggugcucuggaccucgaacuccaucgucguguucugcggcaccagcgggaccuacggcacgggguccuggccggacggcgccgacaucaaccugaagcccaucuga

SEQ ID NO: 16894 - RNA, 1410 nt, Artificial Sequence; identical to SEQ ID NO: 16655
  derived and/or modified CDS sequence (AUadapt) from InfluenzaA__ABB05008__NA

SEQ ID NO: 16895 - RNA, 1410 nt, Artificial Sequence; identical to SEQ ID NO: 16463
  derived and/or modified CDS sequence (AUadapt) from InfluenzaA__ABB05186__NA

SEQ ID NO: 16896 - RNA, 1410 nt, Artificial Sequence; identical to SEQ ID NO: 16655
  derived and/or modified CDS sequence (AUadapt) from InfluenzaA__ABB05219__NA

SEQ ID NO: 16897 - RNA, 1410 nt, Artificial Sequence
  derived and/or modified CDS sequence (AUadapt) from InfluenzaA__ABB46395__NA
augaaccccaaccagaagaucaucaccaucggcucggugucccugaccaucgccacgaucugcuuccucaugcagaucgccauccuggucaccaccgugacccugcacuucaagcaguacgagugcgacucgccggcgaacaagcaggucaugcccugcgagcccaucaucaucgagcgcaacaucacggagaucguguaccucaccaacaccaccaucgagaaggagaucugccccaagcugguggaguaccggaacugguccaagccgcagugcaagaucacgggguucgcccccuucagcaaggacaacuccauccgccugucggccggcggggacaucugggugacccgggagcccuacgucuccugcgaccccggcaagugcuaccaguucgcccucgggcagggcaccacccuggacaacaagcacagcaacgacacgauccacgaccgcaccccgcaccggacccugcucaugaacgagcugggcgugcccuuccaccuggggacccgccaggugugcaucgccugguccucguccucgugccacgacggcaaggcguggcuccacgucugcgugacgggguacgacaagaacgccaccgccuccuucaucuacgacggccggcugguggacagcaucggguccuggucgcagaacauccugcgcacccaggaguccgagugcgucugcaucaacgggaccugcacgguggugaugaccgacggcagcgccuccggccgggcggacaccaagauccucuucaucgaggagggcaagaucguccacaucucgccccugucgggguccgcccagcacguggaggagugcagcugcuacccccgcuacccgggcgugcggugcaucugccgcgacaacuggaagggcuccaaccggcccgucguggacaucaacgugaaggacuacucgaucgacuccagcuacgucugcuccgggcuggugggcgacacgccccgcaacaacgaccggucguccucguccuacugccgcaaccccaacaacgagaaggggacccacggcgugaaggggugggccuucgacgacggcaacgacgucuggaugggccggaccaucagcgaggacucccgcucgggguacgagaccuucaaggugaucggcgggugguccaccccgaacagcaagcuccagaucaaccggcaggucaucguggacuccgacaaccgcucgggcuacuccgggaucuucucgguggagggcaagagcugcaucaaccggugcuucuacgucgagcugauccgcggccgcgagcaggagacgcgggugugguggaccuccaacucgaucguggucuucugcgggaccuccggcaccuacgggacgggcagcuggcccgacggggccgacaucaaccugaugcccaucuga

SEQ ID NO: 16898 - RNA, 1410 nt, Artificial Sequence; identical to SEQ ID NO: 16442
  derived and/or modified CDS sequence (AUadapt) from InfluenzaA__ABB46417__NA

SEQ ID NO: 16899 - RNA, 1410 nt, Artificial Sequence
  derived and/or modified CDS sequence (AUadapt) from InfluenzaA__ABB46428__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccucguccagcugccacgacggcaaggcguggcugcacgugugcgugaccggggacgacgagaacgccaccgccuccuucaucuacaacggccgccugguggacucgaucggguccuggagcaagaagauccuccggacccaggaguccgagugcgucugcaucaacggcacgugcaccguggugaugaccgacggcucggccuccgggaaggcggacaccaagauccuguucaucgaggagggcaagaucguccacaucagcccccugucgggguccgcccagcacguggaggagugcucgugcuacccccgcuacccgggcgugcggugcgucugccgcgacaacuggaagggcuccaaccggcccaucguggacaucaacgugaaggacuacagcaucgucuccucguacgugugcuccgggcucgugggcgacacgccccgcaagaacgacagcuucuccucgucccacugccuggaccccaacaacgaggagggcgggcacggggucaagggcugggccuucgacgacggcaacgacguguggauggggcggaccaucagcgagaagcugcgcuccggcuacgagaccuucaaggucaucgagggguggucgaagccgaacuccaagcuccagaucaaccgccaggugaucguggaccggggcaaccggagcggguacuccggcaucuucucggucgagggcaaguccugcaucaaccgcugcuucuacguggagcugauccgggggcgcaaggaggagaccgaggugugguggacgagcaacucgaucgucguguucugcggcaccuccgggaccuacggcaccgggagcuggcccgacggcgccgacaucaaccugaugcccaucuga

SEQ ID NO: 16900 - RNA, 1410 nt, Artificial Sequence
  derived and/or modified CDS sequence (AUadapt) from InfluenzaA__ABB46439__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaaggagauccugcggacccaggagucggagugcgugugcaucaacggcgccugcacgguggucaugaccgacggguccgccagcggcaaggcggacaccaagauccucuucaucgaggagcgccggaucgugcacaccucgacgcuguccggcagcgcccagcacguggaggagugcuccugcuacccccgcuaccccgggguccggugcgugugccgcgacaacuggaagggcucgaaccggccgaucguggacaucaacaucaaggacuacuccaucgucagcuccuacgugugcucggggcuggugggcgacacgccccgcaagaacgacuccagcuccagcuccaacugccucgaccccaacaacgaggagggcgggcacggcgucaaggggugggccuucgacgacggcaacgacguguggauggggcggaccaucucggagaagcugcgcuccggcuacgagaccuucaaggucaucgagggcuggagcaaccccaacuccaagcugcagaucaaccgccaggugaucguggaccgggggaaccggucgggcuacuccgggaucuucagcgucgagggcaagucgugcaucaaccgcugcuucuacguggagcucauccgggggcgcaaggaggagaccgaggugcuguggaccuccaacagcaucgucguguucugcggcaccuccggcgccuacgggaccggcagcuggccggacggggccgacaucaaccugaugcccaucuga

SEQ ID NO: 16901 - RNA, 1410 nt, Artificial Sequence; identical to SEQ ID NO: 16748
  derived and/or modified CDS sequence (AUadapt) from InfluenzaA__ABB46450__NA

SEQ ID NO: 16902 - RNA, 1410 nt, Artificial Sequence; identical to SEQ ID NO: 16729
  derived and/or modified CDS sequence (AUadapt) from InfluenzaA__ABB46461__NA

SEQ ID NO: 16903 - RNA, 1410 nt, Artificial Sequence
  derived and/or modified CDS sequence (AUadapt) from InfluenzaA__ABB46550__NA
augaaccccaaccagaagaucaucaccaucggcucggugucccugaccaucgccacgaucugcuuccucaugcagaucgccauccuggucaccaccgugacccugcacuucaagcaguacgagugcucguccccgcccaacaaccaggugaugcccugcgagcccaucaucaucgagcgcaacaucacggagaucgucuaccucaccaacaccaccaucgagaaggagaucugcccgaagcugguggaguaccggaacuggagcaagccccagugcaagaucacgggguucgcgcccuucuccaaggacaacucgauccgccuguccgccggcggggacaucugggugacccgggagcccuacgucagcugcgacccgggcaagugcuaccaguucgcccucgggcagggcaccacccuggacaacaagcacuccaacgacacgauccacgaccgcacgccccaccggacccugcucaugaacgagcugggcgugcccuuccaccuggggacccgccaggugugcaucgccuggucguccagcuccugccacgacggcaaggccuggcuccacgucugcgugaccggguacgacaagaacgcgaccgccucguucaucuacgacggccggcugguggacuccaucgggagcugguccaagaacauccugcgcacccaggagucggagugcgucugcgugaacgggaccugcacgguggucaugaccgacggcuccgccagcgagcgggccgacaccaagauccucuucaucgaggagggcaagaucgugcacaucucgccccuguccggcagcgcgcagcacguggaggagugcuccugcuacccgcgcuaccccgggguccggugcgugugccgcgacaacuggaagggcucgaaccggcccguggucgacaucaacgugaaggacuacuccaucgugucguccuacgucugcagcggccuggugggggacacgccccgcaagaacgaccgguccucguccagcuacugccgcaacccgaacaacgagaagggcaaccacggggucaagggcugggccuucgacgacgggaacgacguguggaugggccggaccaucuccgaggagucgcgcuccggcuacgagaccuucaaggugaucgggggcuggagcacccccaacuccaagucgcagaucaaccggcaggucaucguggacuccgggaaccgcagcggcuacucggggaucuucuccguggagggcaagagcugcaucaaccggugcuucuacgucgagcucauccgcggccgcgagcaggagacccgggugugguggacguccaacucgaucguggucuucugcgggaccuccggcaccuacgggaccggcagcuggcccgacggggccgacaucaaccugaugcccaucuga

SEQ ID NO: 16904 - RNA, 1410 nt, Artificial Sequence
  derived and/or modified CDS sequence (AUadapt) from InfluenzaA__ABB51955__NA
augaaccccaaccagaagaucaucaccaucggcucggugucccugaccaucagcacgaucugcuucuucaugcagaucgccauccucgucaccaccgugacccugcacuucaagcaguacgagugcaacuccccgcccaacaaccaggugaugcugugcgagcccacgaucaucgagcgcaacaucaccgagaucgucuaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggugacccgggagcccuacgugucgugcgaccccgacaagugcuaccaguucgcccucggccaggggaccacgcugaacaacggccacuccaacgacaucguccacgaccgcaccccguaccggacccugcucaugaacgagcugggcgugcccuuccaccuggggaccaagcaggucugcaucgccuggagcuccucguccugccacgacggcaaggccuggcuccacgugugcgugacgggggacgacgagaacgcgaccgccagcuucaucuacaacggccgccugguggacuccaucgggagcugguccaagaaguucuuccggacccaggagucggagugcgucugcauccacgggaccugcacgguggugaugaccgacggcuccgccagccgcaaggccgacaccaagauccuguucaucgaggagggcaagaucguccacaccucgacgcucuccggcagcgcgcagcacguggaggagugcuccugcuacccccgguaccccggggugcgcugcgucugccgggacaacuggaagggcucgaaccgcccgaucguggacaucaacaucaaggacuacuccaucgugagcuccuacgucugcucgggccuggugggggacacgccccggaagaacgacuccagcuccagcucccacugccuggaccccaacaacgaggagggcgggcacggcgugaaggggugggccuucgacgacggcaacgacgucuggaugggccgcaccaucucggagaagcuccgguccggguacgagaccuucaaggugaucgagggcuggagcaagcccaacuccaagcugcagaucaaccgccaggucaucguggaccgggggaaccgcucgggcuacuccgggaucuucagcguggagggcaagucgugcaucaaccggugcuucuacgucgagcugauccgcggccggaagcaggagaccgaggugcucuggaccuccaacagcaucguggucuucugcgggaccuccggcaccuacgggacgggcagcuggccggacggggccgacaucaaccugaugcccaucuga

SEQ ID NO: 16905 - RNA, 1413 nt, Artificial Sequence
  derived and/or modified CDS sequence (AUadapt) from InfluenzaA__ABB51956__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcgugugcaaccagcgcaucaucaccuacgagaacuccaccugggucaaccacaccuacgugaacaucaacaacacgaacgugaucgcggggaaggacaagaccagcgucaccguggccggcaacuccucgcugugcuccaucagcggcugggccaucuacaccaaggacaacuccauccggaucgggucgaagggcgacguguucgucauccgcgagccguucaucuccugcagccaccuggagugccggacguucuuccucacccagggggcccugcugaacgacaagcacuccaacggcaccgugaaggaccgcagccccuaccgggcccucauguccugcccccugggggaggcgcccucgccguacaacagcaaguucgaguccguggccuggagcgccuccgccugccacgacggcaugggcuggcugaccaucgggaucucgggccccgacaacggggcggucgccgugcucaaguacaacggcaucaucacggagaccaucaaguccuggaagaagcccauccugggcacccaggagagcgagugggugugcgucaacggguccugcuucaccaucaugacggacgaccccucguacgaggccgccuccuacaagaucuucaagaucgagcgcgagcgggugaccaagagcaucgagcugaacgccccgaacuuccacuacgaggagugcuccugcuaccccgacaccggcaccgugaugugcgucugccgcgacaacuggcacgggagcaaccggcccuggguguccuucaaccagaaccucgacuaccagaucggcuacaucugcucggggguguucggcgacaacccccgcccgaaggacggcgagggguccugcaaccccgucacgguggacggcgcgaacggggugaagggcuucagcuacaaguacgggaacggcgucuggaucggccggaccaaguccaaccgccugcggaagggguucgagaugaucugggaccccaacggcuggaccgacaccgacucggacuucuccgugaagcaggacguggucgccaucacggacuggagcggguacagcggcuccuucgugcagcaccccgagcugaccgggcucgacugcauccgcccgugcuucugggucgagcuggugcggggccugcccaaggagaacaccaccaucuggacgucgggcuccagcaucuccuucugcggggugaacagcgacaccgccaacugguccuggcccgacggcgccgagcuccccuucaccaucgacaaguga

SEQ ID NO: 16906 - RNA, 1410 nt, Artificial Sequence
  derived and/or modified CDS sequence (AUadapt) from InfluenzaA__ABB51957__NA
augaaccccaaccagaagaucaucaccaucggcucggugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucucgaaggacaacuccauccgccucagcgccggcggggacaucugggugacccgggagcccuacguguccugcgaccccgacaagugcuaccaguucgcccugggccaggggaccacgcugaacaacggccacucgaacgacaccguccgcgaccggaccccguaccgcacccuccugaugaacgagcugggcgugcccuuccaccucgggacgcgccaggugugcaucgccugguccagcuccucgugccacgacggcaaggcguggcugcacgucugcgugaccggggacgacaagaacgccaccgccuccuucaucuacaacggccggcugguggacagcaucggguccuggagcaagaagaucuuccggacccagaaguucgagugcgucugcauccacuggacgugcaccguggugaugaccgacggcuccgccucgggcaaggcggacaccaagauccucuucaucgaggaggggaagaucguccacaucuccacgcugagcggcucggcccagcacguggaggagugcuccugcuacccccgcuaccccggggugcggugcgucugccgcgacaacuggaagggcagcaaccggccgaucguggacaucaacgugaaggacuacuccaucgucucguccuacgugugcagcggccuggugggggacacgccccgcaagaacgacuccuucagcuccucgcacugccucgaccccaacaacgaggagggcgggcacggcgucaaggggugggccuucgacgacggcaacgacguguggaugggccggaccaucuccgagaagcugcgcagcggguacgagaccuucaaggucaucgagggcugguccaagcccaacucgaagcugcagaucaaccgccaggugaucguggagcgggggaaccgguccggcuacagcgggaucuucuccgucgagggcaagucgugcaucaaccgcugcuucuacguggagcucauccggggccgcaaggaggagaccgaggugugguggaccuccaacagcaucgucguguucugcgggaccagcggcaccuacgggacgggcuccuggccggacggggccgacaucaaccugaugcccaucuga

SEQ ID NO: 16907 - RNA, 1413 nt, Artificial Sequence
  derived and/or modified CDS sequence (AUadapt) from InfluenzaA__ABB51958__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcgugugcaaccagcgcaucaucaccuacgagaacuccaccugggucaaccacaccuacgugucgaucaacaacacgaacgugaucgcggggaaggacaagaccuccgucacccuggccggcaacagcucccugugcccgauccggggcugggccaucuacaccaaggggaacucgauccgcaucggcuccaagggggacguguucgugauccgggagcccuucaucagcugcucccaccucgagugccgcacguucuuccugacccagggcgcccugcucaacgacaagcacucgaacgggaccgucaaggaccggucccccuaccgcgcccugaugagcugcccccugggcgaggcgccgucccccuacaacucgaaguucgagagcguggccugguccgccucggccugccacgacggcaugggguggcucaccaucggcaucuccgggcccgacaacggcgcgguggccguccugaaguacaacggcaucaucacggagaccaucaagagcuggaagaagcagauccugcggacccaggaguccgagugcgugugcgugaacgggucgugcuucaccaucaugacggacggccccuccaacggggccgccagcuacaagaucuucaagaucgagaagggcaaggucaccaaguccaucgagcucaacgccccgaacuuccacuacgaggagugcucgcgcuaccccgacaccgggaccgugaugugcgugugccgggacaacuggcacggcuccaaccgccccugggucagcuucaaccagaaccuggacuaccagaucggcuacaucugcuccgggguguucggcgacaacccccggccgaaggacggggagggcucgugcaaccccgugacggucgacggggcgaacggcgugaagggcuucuccuacaaguacgggaacggcguggggaucggccgcaccaucagcaaccggcugcgcaagggguucgagaugaucugggaccccaacggcuggaccgacaccgacuccgacuucucggucaagcaggacgugguggccaucacggacugguccggcuacagcgggucguucguccagcaccccgagcucaccggccuggacugcauccggccgugcuucuggguggagcugguccgcgggcuccccaaggagaacaccaccaucuggacguccggcagcuccaucucguucugcggcgugaacuccgacaccgccaacuggagcuggcccgacggggccgagcugcccuucaccaucgacaaguga

SEQ ID NO: 16908 - RNA, 1410 nt, Artificial Sequence
  derived and/or modified CDS sequence (AUadapt) from InfluenzaA__ABB51959__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacggccgcaccccguaccggacccugcucaugaacgagcugggcgugcccuuccaccuggggacgaagcaggucugcaucgccuggagcuccucguccugccacgacggcaaggccuggcuccacgugugcgugaccggggacgacaagaacgcgaccgccagcuucaucuacaacggccgccugguggacuccaucgucucgugguccaaggagauccugcggacccaggagagcgagugcgugugcaucaacgggacgugcaccguggucaugaccgacggcuccgccucgggcaaggccgacaccaagauccucuucaacgaggaggggaagaucgugcacacgagcacgugcuccggcucggcgcagcacguggaggagugcuccugcuacagccgcuaccccgggguccggugcgugugccgcgacaacuggaagggcuccaaccggcccaucguggacaucaacaucaaggacuacucgaucgucuccagcuacgugugcuccggccuggugggggacaccccgcgcaagaacgacucguccagcuccucgcacugccuggaccccaacaacgaggagggcgggcacggcgucaaggggcgggccuucgacgacggcaacgacguguggaugggccgcaccaucuccgagaagcuccggagcggguacgagaccuucaaggucaucgagggcugguccaaccccaacucgaagcugcagaucaaccgccaggugaucguggaccgggggaaccgcuccggcuacagcgggaucuucucggucgagggcaaguccugcaucaaccggugcuucuacguggagcugauccgcggccggaaggaggagaccgaggugcucuggaccagcaacuccaucgucguguucugcgggaccagcggcacguacgggaccggcuccuggcccgacggggccgacaucaaccugaugccgaucuga

SEQ ID NO: 16909 - RNA, 1413 nt, Artificial Sequence
  derived and/or modified CDS sequence (AUadapt) from InfluenzaA__ABB51960__NA
augaaccccaaccagaagaucaucaccaucggcucgaucuccaucgccaucgggaucaucagccugaugcuccagaucggcaacaucaucccgaucugggccucccacucgauccagaccgggucccagaaccacacgggcgugugcaaccagcgcaucaucaccuacgagaacagcaccugggucaaccacaccuacgugaacaucaacaacacgaacgugaucgcggggaaggacaagaccuccgucacccuggccggcaacucgucccugugcagcaucuccggcugggccaucuacaccaaggacaacucgauccggaucggguccaagggcgacguguucgugauccgcgagcccuucaucagcugcucccaccucgagugccggacguucuuccugacccagggggcccugcucaacgacaagcacucgaacggcaccgucaaggaccgcucccccuaccgggcccugaugagcugcccccugggggaggcgccgucccccuacaacucggaguucgagagcguggccugguccgccucggccugccacgacggcaugggcuggcucaccaucgggaucuccggccccgacaacggggcgguggccguccugaaguacaacggcaucaucacggagaccaucaagagcuggaagaagcagauccugcgcacccaggaguccgagugcgugugcgugaacggcucgugcuucaccaucaugacggacgggcccuccaacggcgccgccagcuacaagaucuucaagaucgagaaggggaagaucaccaaguccaucgagcucaacgccccgaacucgcacuacgaggagugcuccugcuaccccgacaccggcaccgucaugugcgugugccgggacagcuggcacggguccaaccgccccugggugucguucaaccagaaccuggacuaccagaucggcuacaucugcuccggcgucuucggggacaacccccggccgaaggacggcgaggggagcugcaaccccgugacgguggacggcgcgaacggggucaagggcuucuccuacgaguacggcaacggggacuggaucggccgcaccaagucgaaccggcugcgcaagggguucgagaugaucugggaccccgacggcuggaccgacaccaacuccgacuucagcgugaagcaggacguggucgccaucacggacuggucgggguacuccggcagcuucgugcagcaccccgagcucaccggccuggugugcauccggccgugcuucugggucgagcuggugcgcgggcuccccaaggagaacaccaccaucuggacguccggcucguccaucagcuucugcggggucaacuccgacaccgccaacuggagcuggcccgacggcgccgagcugcccuucaccaucgacaaguga

SEQ ID NO: 16910 - RNA, 1410 nt, Artificial Sequence; identical to SEQ ID NO: 16745
  derived and/or modified CDS sequence (AUadapt) from InfluenzaA__ABB53617__NA

SEQ ID NO: 16911 - RNA, 1410 nt, Artificial Sequence
  derived and/or modified CDS sequence (AUadapt) from InfluenzaA__ABB53721__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccagcggcggggacaucugggucacccgggagcccuacguguccugcgaccccgacaagugcuaccaguucgcccucggccaggggaccacgcugaacaacgugcacucgaacgacaccguccacgaccgcaccccguaccggacccugcucaugaacgagcugggcgugcccuuccaccugggcacgaagcaggucugcaucgccugguccagcuccucgugccacgacgggaaggccuggcuccacgugugcgugaccggcgacgacaagaacgccaccgcguccuucaucuacaacgggcgccugguggacagcaucgucuccuggagcaaggagauccugcggacccaggaguccgagugcgugugcaucaacggcacgugcaccguggucaugaccgacgggucggccagcggcaaggccgacaccaagauccucuucaucgaggagggcaagaucgugcacacguccacccugucgggguccgcccagcacguggaggagugcagcugcuacccccgcuaccccggcguccggugcgugugccgcgacaacuggaagggguccaaccggccgaucguggacaucaacaucaaggacuacagcaucgucuccucguacgugugcuccggccuggugggcgacacgccccgcaagaacgacagcuccucguccagccacugccucgaccccaacaacgaggagggcgggcacggggucaagggcugggcguucgacgacgggaacgacguguggaugggccggaccaucuccgagaagcugcgcagcggcuacgagaccuucaaggucaucgaggggugguccaaccccaacucgaagcugcagaucaaccgccaggugaucguggaccggggcaaccgguccggguacagcggcaucuucucggucgaggggaaguccugcaucaaccgcugcuucuacguggagcucauccggggccgcaaggaggagaccgaggugcuguggaccagcaacuccaucgucguguucugcggcaccagcgggacguacggcaccggguccuggccggacggcgccgacaucaaccugaugcccaucuga

SEQ ID NO: 16912 - RNA, 1410 nt, Artificial Sequence
  derived and/or modified CDS sequence (AUadapt) from InfluenzaA__ABB53754__NA
augaaccccaaccagaagaucaucaccaucggcucggugucccugaccaucgccacgaucugcuuccucaugcagaucgccauccuggucaccaccgugacccugcacuucaagcaguacgagugcucguccccgcccaacaaccaggugaugcccugcgagcccaucaucaucgagcgcaacaucacggagaucgucuaccucaccaacaccaccaucgagaaggagaucugcccgaagcugguggaguaccggaacuggagcaagccccagugcaagaucacgggguucgcgcccuucuccaaggacaacucgauccgccuguccgccggcggggacaucugggugacccgggagcccuacgucagcugcgacccgggcaagugcuaccaguucgcccucgggcagggcaccacccuggacaacaagcacuccaacgacacgauccacgaccgcacgccccaccggacccugcucaugaacgagcugggcgugcccuuccaccuggggacccgccaggugugcaucgccuggucguccagcuccugccacgacggcaaggccuggcuccacgucugcgugaccggguacgacaagaacgcgaccgccucguucaucuacgacggccggcugguggacuccaucgggagcugguccaagaacauccugcgcacccaggagucggagugcgucugcaucaacgggaccugcacgguggugaugaccgacggcuccgccagcgagcgggccgacaccaagauccucuucaucgaggagggcaagaucguccacaucucgccccuguccggcagcgcgcagcacguggaggagugcuccugcuacccgcgcuaccccggggugcggugcgucugccgcgacaacuggaagggcucgaaccggcccgugguggacaucaacgucaaggacuacuccaucgugagcuccuacgugugcucgggccuggucggggacacgccccgcaagaacgaccgguccagcuccucguacugccgcaacccgaacaacgagaagggcaaccacggggugaagggcugggccuucgacgacgggaacgacgucuggaugggccggaccaucuccgaggagagccgcuccggcuacgagaccuucaaggugaucgggggcuggucgacccccaacuccaagcuccagaucaaccgccaggugaucgucgacagcgacaaccgguccggguacucgggcaucuucagcguggaggggaaguccugcaucaaccggugcuucuacguggagcugauccgcggccgcgagcaggagacccgggucugguggacgucgaacuccaucgugguguucugcggcaccagcgggaccuacggcaccggguccuggcccgacggcgccgacaucaaccugaugcccaucuga

SEQ ID NO: 16913 - RNA, 1410 nt, Artificial Sequence; identical to SEQ ID NO: 16505
  derived and/or modified CDS sequence (AUadapt) from InfluenzaA__ABB54517__NA

SEQ ID NO: 16914 - RNA, 1410 nt, Artificial Sequence
  derived and/or modified CDS sequence (AUadapt) from InfluenzaA__ABB59999__NA
augaaccccaaccagaagaucaucaccaucggcucggugucccugaccaucgccacgaucugcuuccucaugcagaucgccauccuggucaccaccgugacccugcacuucaagcaguacgagugcucguccccgcccaacaaccaggugaugcucugcgagcccacgaucaucgagcgcaacaucaccgagaucgucuaccugaccaacaccacgaucgagaaggagaucugccccaagcuggcggaguaccggaacuggagcaagccgcagugcaagaucaccggguucgcccccuucuccaaggacaacucgauccgccucuccgccggcggggacaucugggugacccgggagcccuacgugagcugcgaccccgacaagugcuaccaguucgcccugggccaggggaccacgcugaacaaccgccacuccaacgacaccguccacgaccggaccccguaccgcacccuccugaugaacgagcugggcgugcccuuccaccucggcacgaagcaggucugcaucgccuggucguccagcuccugccacgacgggaaggcguggcugcacgugugcgugaccggccacgacgagaacgccaccgccucguucaucuacgacgggcggcugguggacuccaucggcucgugguccaagaagauccuccgcacccaggagagcgagugcgucugcaucaacgggacgugcaccguggugaugaccgacggcuccgccucgggccgggcggacaccaagauccuguucaucgaggaggggaagaucguccacaucagcccccuguccggcucggcccagcacguggaggagugcuccugcuacccccgcuacccgggggugcggugcgucugccgcgacaacuggaagggcagcaaccggcccaucguggacaucaacaucaaggacuacuccaucgugucguccuacgucugcagcggccucgugggggacacgccccgcaagaacgacuccucguccucgucccacugccugaaccccaacaacgaggagggcgggcacggcgugaaggggugggccuucgacgacggcaacgacgucuggaugggccggaccaucagcgagaaguuccgcuccggguacgagaccuucaaggugaucgagggcuggucgaagccgaacuccaagcugcagaucaaccggcaggucaucguggaccgcgggaaccggagcggcuacuccgggaucuucucgguggagggcaagagcugcaucaaccgcugcuucuacgucgagcucauccggggccgcaagcaggagaccgaggugugguggacguccaacucgaucgugaccuucugcgggaccuccggcaccuacgggacgggcagcuggcccgacggggccgacaucaaccugaugcccaucuga

SEQ ID NO: 16915 - RNA, 1410 nt, Artificial Sequence
  derived and/or modified CDS sequence (AUadapt) from InfluenzaA__ABB60010__NA
augaaccccaaccagaagaucaucaccaucggcucggugucccugaccaucgccacgaucugcuuccucaugcagaucgccauccuggucaccaccgugacccugcacuucaagcaguacgaguacucguccccgcccaacaaccaggugaugcucugcgagcccacgaucaucgagcgcaacaucaccgagaucgucuaccugaccaacaccacgaucgagaaggagaucugccccaagcuggcggaguaccggaacuggagcaagccgcagugcaagaucaccggguucgcccccuucuccaaggacaacucgauccgccucuccgccggcggggacaucugggugacccgggagcccuacgugagcugcgaccccgacaagugcuaccaguucgcccugggccaggggaccacgcugaacaaccgccacuccaacgacaccguccacgaccggaccccguaccgcacccuccugaugaacgagcugggcgugcccuuccaccucggcacgaagcaggucugcaucgccuggucguccagcuccugccacgacgggaaggcguggcugcacgugugcgugaccggccacgacgagaacgccaccgccucguucaucuacgacgggcggcugguggacuccaucggcagcugguccaagaagauccuccgcacccaggagucggagugcgucugcaucaacgggacgugcaccguggugaugaccgacggcuccgccagcggccgggcggacaccaagauccuguucaucgaggaggggaagaucguccacaucucgccccuguccggcucggcccagcacguggaggagugcuccugcuacccccgcuacccgggggugcggugcgucugccgcgacaacuggaagggcagcaaccggcccaucguggacaucaacgugaaggacuacuccaucgucucgcgcuacgugugcuccggccucgugggggacacgccccggaagaacgacagcuccucguccagccacugccugaaccccaacaacgaggagggcgggcacggcgucaaggggugggccuucgacgacggcaacgacguguggaugggccgcaccaucuccgagaaguuccggucgggguacgagaccuucaaggucaucgagggcugguccaagccgaacagcaagcugcagaucaaccgccaggugaucguggaccgggggaaccgcuccggcuacucggggaucuucuccgucgagggcaagagcugcaucaaccggugcuucuacguggagcucauccgcggccgcaagcaggagaccgaggugugguggacgucgaacuccaucgucguguucugcgggaccagcggcaccuacgggaccggcuccuggcccgacggggccgacaucaaccugaugcccaucuga

SEQ ID NO: 16916 - RNA, 1410 nt, Artificial Sequence
  derived and/or modified CDS sequence (AUadapt) from InfluenzaA__ABB77867__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacucgaacgacaccguccacgaccgcaccccguaccggacccuccugaugaacgagcugggcgugcccuuccaccucgggacgaagcaggucugcaucgccugguccagcuccucgugccacgacggcaaggcguggcugcacgugugcgugaccgggcacgacgagaacgccaccgccuccuucaucuacgacggccgccugguggacagcaucggguccuggucgaagaagauccuccggacccaggaguccgagugcgucugcaucaacggcacgugcaccguggugaugaccgacggcucggccuccgggcgcgcggacaccaagauccuguucaucgaggagggcaagaucguccacaucagccagcugucgggguccgcccagcacguggaggagugcucgugcuacccccgguaccccggcgugcgcugcgucugccgggacaacuggaagggcuccaaccgcccgaucguggacaucaacgugaaggaccacagcaucgucuccucguacgugugcuccgggcucgugggcgacacgccccggaagaacgacagcuccucguccucgcacugccugaaccccaacaacgaggagggcgggcacggggucaagggcugggccuucgacgacggcaacgacguguggauggggcgcaccaucuccgagaagcugcggagcggcuacgagaccuucaaggucaucgaggggugguccaagcccaacucgaagcuccagaucaaccgccaggugaucguggaccggggcaaccgcuccggguacucgggcaucuucuccgucgagggcaagagcugcaucaaccggugcuucuacguggagcugauccgcgggcggaagcaggagaccgaggugugguggacgucgaacuccaucgucguguucugcggcaccagcgggaccuacggcaccggguccuggccggacggcgccgacaucaaccugaugcccaucuga

SEQ ID NO: 16917 - RNA, 1410 nt, Artificial Sequence; identical to SEQ ID NO: 16916
  derived and/or modified CDS sequence (AUadapt) from InfluenzaA__ABB79719__NA

SEQ ID NO: 16918 - RNA, 1410 nt, Artificial Sequence
  derived and/or modified CDS sequence (AUadapt) from InfluenzaA__ABB79734__NA
augaaccccaaccagaagaucaucaccaucggcucggugucccugacccucagcacgaucugcuucuucaugcagaucgccauccugaucaccaccgucacccugcacuucaagcaguacgaguucaacuccccgcccaacaaccaggugaugcucugcgagcccacgaucaucgagcgcaacaucaccgagaucguguaccugaccaacaccacgaucgagaaggagaucugccccaagcuggccgaguaccggaacuggucgaagccgcagugcgacaucaccggguucgcgcccuucuccaaggacaacagcauccgccucuccgccggcggggacaucugggucacccgggagcccuacgugucgugcgaccccgacaagugcuaccaguucgcccugggccaggggaccacgcugaacaacgugcacuccaacgacaccguccacgaccgcaccccguaccggacccuccugaugaacgagcugggcgugcccuuccaccucggcacgaagcaggucugcaucgccuggagcuccucguccugccacgacgggaaggccuggcugcacgugugcgugaccggcgacgacaagaacgcgaccgccagcuucaucuacaacgggcgccugguggacuccaucgucagcugguccaagaagauccuccggacccaggagucggagugcgugugcaucaacggcacgugcaccguggucaugaccgacggguccgccagcggcaaggccgacaccaagauccuguucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccucgugggcgacacgccccgcaagaacgacuccagcuccagcucccacugccuggaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcuccagaucaaccgccaggugaucguggaccggggcaaccggucgggguacuccggcaucuucagcgucgagggcaagucgugcaucaaccgcugcuucuacguggagcugauccgggggcgcaaggaggagaccgaggugcuguggaccuccaacagcaucgucguguucugcggcaccuccgggacguacggcaccgggagcuggccggacggcgccgacaucaaccucaugcccaucuga

SEQ ID NO: 16919 - RNA, 1410 nt, Artificial Sequence; identical to SEQ ID NO: 16889
  derived and/or modified CDS sequence (AUadapt) from InfluenzaA__ABB79791__NA

SEQ ID NO: 16920 - RNA, 1410 nt, Artificial Sequence
  derived and/or modified CDS sequence (AUadapt) from InfluenzaA__ABB79802__NA
augaaccccaaccagaagaucaucaccaucggcucggugucccugaccaucgccacgaucugcuuccucaugcagaucgccauccuggucaccaccgugacccugcacuucaagcaguacgagugcucguccccgcccaacaaccaggugaugcccugcgagcccaucaucaucgagcgcaacaucacggagaucgucuaccucaccaacaccaccaucgagaaggagaucugcccgaagcugguggaguaccggaacuggagcaagccccagugcaagaucacgggguucgcgcccuucuccaaggacaacucgauccgccuguccgccggcggggacaucugggugacccgggagcccuacgucagcugcgacccgggcaagugcuaccaguucgcccucgggcagggcaccacccugaacaacaagcacuccaacgacacgauccacgaccgcacccccuaccggacccugcucaugaacgagcugggcgugcccuuccaccuggggaccaagcaggucugcaucgccuggucguccagcuccugccacgacggcaaggccuggcuccacgugugcgugacggggcacgacgagaacgcgaccgccucguucaucuacgacggccgccugguggacuccaucgggagcugguccaagaacauccugcggacccaggagucggagugcgucugcaucaacgggaccugcacgguggugaugaccgacggcuccgccagcgagcgcgccgacaccaagauccucuucaucgaggagggcaagaucguccacaucucgccccuguccggcagcgcgcagcacguggaggagugcuccugcuacccgcgguaccccggggugcgcugcgucugccgggacaacuggaagggcucgaaccgccccaucguggacaucaacgugaaggacuacuccaucgucagcuccuacgugugcucgggccuggugggggacacgccccggaagaacgaccgcuccagcuccucguacugccggaacccgaacaacgagaagggcucccacggggucaagggcugggccuucgacgacgggaacgacguguggaugggccgcaccaucggcgaggagcuccggagcggguacgagaccuucaaggucaucggcgggugguccacccccaacucgaagcugcagaucaaccgccaggugaucguggacuccggcaaccggagcggguacuccggcaucuucucggucgagggcaagagcugcaucaaccgcugcuucuacguggagcugauccgggggcgcgagcaggagacccgcgugugguggacguccaacucgaucgucguguucugcggcaccuccgggaccuacggcaccgggagcuggcccgacggcgccgacaucaaccucaugcccaucuga

SEQ ID NO: 16921 - RNA, 1410 nt, Artificial Sequence
  derived and/or modified CDS sequence (AUadapt) from InfluenzaA__ABB79813__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggaggugugccccaagcuggcggaguaccggaacugguccaagccgcagugcaagaucaccggguucgcccccuucagcaaggacaacuccauccgccucucggccggcggggacaucugggugacccgggagcccuacgucuccugcgaccccggcaagugcuaccaguucgcccuggggcagggcaccacgcugaacaaccgccacagcaacgacaccgugcacgaccggaccccguaccgcacccuccugaugaacgagcugggcgugcccuuccaccucgggacgaagcaggucugcaucgccugguccucguccagcugccacgacggcaaggcguggcugcacgugugcgugaccgggcacgacgagaacgccaccgccuccuucaucuacgacggccggcuggucgacucgaucggguccuggucgaagaacauccuccgcacccaggaguccgagugcgugugcaucaacggcacgugcaccguggucaugaccgacggcagcgccuccgagcgggcggacaccaagauccuguucaucgaggaggggaagaucgugcacaucucgccccugagcggcuccgcccagcacguggaggagugcucgugcuacccccgcuacccggggguccggugcgugugccgcgacaacuggaagggcuccaaccggcccaucguggacaucaacgucaaggacuacagcaucguguccucguacgugugcuccggccucgucggggacacgccccgcaagaacgacagcuccucguccucguacugccggaaccccaacaacgagaagggcucccacggggugaagggcugggccuucgacgacgggaacgacgucuggaugggccgcaccaucagcgaggagcugcgguccggcuacgagaccuucaaggugaucgggggcuggucgaagccgaacuccaagcugcagaucaaccgccaggugaucgucgaccgggggaaccgcagcggcuacuccgggaucuucucgguggagggcaagagcugcaucaaccggugcuucuacguggagcucauccgcggccgcaagcaggagaccgaggucugguggacguccaacucgaucgugguguucugcgggaccuccggcaccuacgggaccggcagcuggcccgacggggccgacaucaaccugaugcccaucuga

SEQ ID NO: 16922 - RNA, 1410 nt, Artificial Sequence; identical to SEQ ID NO: 16921
  derived and/or modified CDS sequence (AUadapt) from InfluenzaA__ABB79960__NA

SEQ ID NO: 16923 - RNA, 1410 nt, Artificial Sequence; identical to SEQ ID NO: 16921
  derived and/or modified CDS sequence (AUadapt) from InfluenzaA__ABB79971__NA

SEQ ID NO: 16924 - RNA, 1413 nt, Artificial Sequence
  derived and/or modified CDS sequence (AUadapt) from InfluenzaA__ABB79982__NA
augaacgccaaccagaagaucaucaccaucggcucgaucuccaucgccaucgggaucaucagccugaugcuccagaucggcaacaucaucuccaucugggcgucgcacuccauccagaccgggagccagaaccacacgggcgugugcaaccagcgcaucaucaccuacgagaacuccaccugggucaaccacaccuacgugaacaucaacaacacgaacgugaucgccgggaaggacaagaccucggucacccuggccggcaacuccagccugugcuccaucagcggcugggccaucuacaccaaggacaacuccauccggaucgggucgaagggcgacguguucgugauccgcgagcccuucaucuccugcagccaccucgagugccggacguucuuccugacccagggggcccugcucaacgacaagcacuccaacggcaccgucaaggaccgcucgccguaccgggcgcugauguccugcccccugggggaggcccccagccccuacaacucgaaguucgaguccguggccuggagcgccuccgcgugccacgacggcaugggcuggcucaccaucgggaucagcggcccggacaacggggccguggccguccugaaguacaacggcaucaucacggagaccaucaaguccuggaagaagcagauccugcgcacccaggagucggagugcgugugcgugaacggcuccugcuucaccaucaugacggacgggcccagcaacggcgccgccuccuacaagaucuucaagaucgagaaggggaaggucaccaagucgaucgagcucaacgcgcccaacuuccacuacgaggagugcuccugcuaccccgacaccggcaccgugaugugcgugugccgggacaacuggcacgggagcaaccgcccgugggucuccuucaaccagaaccuggacuaccagaucggcuacaucugcucgggcguguucggggacaacccccggcccaaggacggcgagggguccugcaaccccgugacggucgacggcgccaacggggugaagggcuucagcuacaaguacggcaacgggguguggaucggccgcaccaaguccaaccggcugcgcaagggguucgagaugaucugggacccgaacggcuggaccgacaccgacagcgacuucuccgucaagcaggacgugguggccaucacggacuggucgggguacagcggcuccuucguccagcaccccgagcucaccggccuggacugcauccggcccugcuucuggguggagcugguccgcgggcuccccaaggagaacaccaccaucuggacgucgggcuccagcaucuccuucugcggggugaacagcgacaccgccaacugguccuggccggacggcgccgagcugcccuucaccaucgacaaguga

SEQ ID NO: 16925 - RNA, 1413 nt, Artificial Sequence; identical to SEQ ID NO: 16853
  derived and/or modified CDS sequence (AUadapt) from InfluenzaA__ABB79993__NA

SEQ ID NO: 16926 - RNA, 1410 nt, Artificial Sequence
  derived and/or modified CDS sequence (AUadapt) from InfluenzaA__ABB80004__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggacuacuccaccgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcacguccgggaccuacggcaccgggagcuggccggacggcgccgacaucaaccugaugcccaucuga

SEQ ID NO: 16927 - RNA, 1410 nt, Artificial Sequence; identical to SEQ ID NO: 16911
  derived and/or modified CDS sequence (AUadapt) from InfluenzaA__ABB80015__NA

SEQ ID NO: 16928 - RNA, 1410 nt, Artificial Sequence
  derived and/or modified CDS sequence (AUadapt) from InfluenzaA__ABB80037__NA
augaaccccaaccagaagaucaucaccaucggcucggugucccugaccaucgccacggucugcuuccucaugcagaucgccauccuggugaccaccgugacccugcacuucaagcaguacgagugcgacucgccggcgaacaaccaggucaugcccugcgagcccaucaucaucgagcgcaacaucacggagaucguguaccucaacaacaccaccaucgagaaggagaucugccccaagcugguggaguaccggaacugguccaagccgcagugcaagaucaccggguucgcccccuucagcaaggacaacuccauccgccugucggccggcggggacaucugggucacgcgggagcccuacguguccugcgaccccggcaagugcuaccaguucgcccucgggcagggcaccacccuggacaacaagcacucgaacgacaccauccacgaccgcaucccgcaccggacgcugcucaugaacgagcugggcgugcccuuccaccuggggacccgccaggucugcaucgccugguccagcuccucgugccacgacggcaaggcguggcuccacgugugcgugaccggggacgacaagaacgccaccgccuccuucaucuacgacggccggcuggucgacucgaucggguccuggagccagaacauccugcgcacgcaggaguccgagugcgugugcaucaacgggaccugcaccguggucaugaccgacggcucggccuccggccgggcggacacgcgcauccucuucaucgaggagggcaagaucgugcacaucucgccccugagcggguccgcccagcacguggaggagugcucgugcuacccccgguacccgggcguccgcugcaucugccgggacaacuggaagggcuccaaccgccccgugguggacaucaacgucgaggacuacucgaucgacuccagcuacgugugcuccgggcuggugggcgacacgccccggaacaacgaccgcucguccaacucgaacugccggaaccccaacaacgagcgcgggaaccacggcgucaaggggugggccuucgacgacggcaacgacguguggaugggccggaccaucuccaaggaccuccgcagcggguacgagaccuucaaggucaucggcgggugguccaccccgaacucgaagucccagaucaaccgccaggugaucguggacucggacaaccgguccggcuacagcgggaucuucuccgucgagggcaagucgugcaucaaccgcugcuucuacguggagcugauccggggccgcgagcaggagacccgggugugguggaccucgaacuccaucgucguguucugcgggaccagcggcacguacgggaccggcuccuggcccgacggggccgacaucaaccugaugcccaucuga

SEQ ID NO: 16929 - RNA, 1413 nt, Artificial Sequence
  derived and/or modified CDS sequence (AUadapt) from InfluenzaA__ABB80048__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcgugugcaaccagcgcaucaucaccuacgagaacuccaccugggucaaccacaccuacgugaacaucaacaacacgaacgugaucgcggggaaggacaagaccucggucacccuggccggcaacuccagccugugcuccaucucgggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcgguggccguccugaaguacaacggcaucaucacggagaccaucaaguccuggaagaagcagauccugcgcacccaggagagcgagugcgugugcgugaacggcuccugcuucaccaucaugacggacgggcccucgaacggcgccgccuccuacaagaucuucaagaucgagaaggggaaggucaccaagagcguggagcucaacgcccccaacuuccacuacgaggagugcuccugcuacccggacaccggcaccgugaugugcgucugccgggacaacuggcacgggucgaaccgccccuggguguccuucaaccagaaccuggacuaccagaucggcuacaucugcagcggcguguucggggacaacccccggcccaaggacggcgagggguccugcaacccggucacgguggacggcgcgaacggggugaagggcuucucguacaaguacggcaacggggucuggaucggccgcaccaaguccaaccggcugcgcaagggguucgagaugaucugggaccccaacggcuggaccgacaccgacagcgacuucuccgugaagcaggacguggucgccaucacggacuggucgggguacagcggcuccuucgugcagcaccccgagcucaccggccuggacugcauccggcccugcuucugggucgagcuggugcgcgggcucccgaaggagaacaccaccaucuggacgucgggcuccagcaucuccuucugcggggugaacggcgacaccgccaacuggagcuggcccgacggcgccgagcugcccuucaccaucgacaaguga

SEQ ID NO: 16930 - RNA, 1410 nt, Artificial Sequence
  derived and/or modified CDS sequence (AUadapt) from InfluenzaA__ABB80084__NA
augaaccccaaccagaagaucaucaccaucggcucggugucccugaccaucgccacgaucugcuuccucaugcagaucgccauccuggucaccaccgugacccugcacuucaagcaguacgagugcaacucgccguccaacaaccaggugaugcucugcgagcccacgaucaucgagcgcaacaucaccgagaucgucuaccugaccaacaccacgaucgagaaggagaucugccccaagcuggcggaguaccggaacuggagcaagccccagugcaagaucaccggguucgccccguucuccaaggacaacucgauccgccucuccgccggcggggacaucugggugacccgggagcccuacgugagcugcgaccccgacaagugcuaccaguucgcccugggccaggggaccacgcugaacaacggccacuccaacgacaccguccacgaccgcacccccuaccggacccuccugaugaacgagcugggcgugccguuccaccucgggacgaagcaggucugcaucgccuggucguccucguccugccacgacggcaaggcguggcugcacgugugcgugaccgggcacgacgagaacgccaccgccagcuucaucuacgacggccgccugguggacuccaucgggucgugguccaagaagauccuccggacccaggagagcgagugcgucugcaucaacggcacgugcaccguggugaugaccgacggcuccgccucggggcgcgcggacaccaagauccuguucaucgaggagggcaagaucguccacaucucgcagcuguccgggagcgcccagcacguggaggagugcuccugcuacccccgguaccccggcgugcgcugcgucugccgggacaacuggaagggcucgaaccgccccaucguggacaucaacgugaaggaccacuccaucgucagcuccuacgugugcucggggcucgugggcgacacgccgcggaagaacgacuccucguccagcucccacugccugaaccccaacaacgaggagggcgggcacggggucaagggcugggccuucgacgacggcaacgacguguggauggggcgcaccaucucggagaagcugcgguccggcuacgagaccuucaaggucaucgagggguggagcaagcccaacuccaagcuccagaucaaccgccaggugaucguggaccggggcaaccgcucgggguacuccggcaucuucucggucgagggcaagagcugcaucaaccggugcuucuacguggagcugauccgcgggcggaagcaggagaccgaggugugguggacguccaacucgaucgucguguucugcggcaccuccgggaccuacggcaccgggagcuggcccgacggcgccgacaucaaccugaugccgaucuga

SEQ ID NO: 16931 - RNA, 1410 nt, Artificial Sequence; identical to SEQ ID NO: 16916
  derived and/or modified CDS sequence (AUadapt) from InfluenzaA__ABB80095__NA

SEQ ID NO: 16932 - RNA, 1410 nt, Artificial Sequence; identical to SEQ ID NO: 16916
  derived and/or modified CDS sequence (AUadapt) from InfluenzaA__ABB80162__NA

SEQ ID NO: 16933 - RNA, 1410 nt, Artificial Sequence; identical to SEQ ID NO: 16916
  derived and/or modified CDS sequence (AUadapt) from InfluenzaA__ABB80199__NA

SEQ ID NO: 16934 - RNA, 1410 nt, Artificial Sequence
  derived and/or modified CDS sequence (AUadapt) from InfluenzaA__ABB80210__NA
augaaccccaaccagaagaucaucaccaucggcucggugucccugaccaucgccacgaucugcuuccucaugcagaucgccauccuggucaccaccgugacccugcacuucaagcaguacgagugcucguccccgcccaacaaccaggugaugcucugcgagcccacgaucaucgagcgcaacaucaccgagaucgucuaccugaccaacaccacgaucgagaaggagaucugccccaagcuggcggaguaccggaacuggagcaagccgcagugcaagaucaccggguucgcccccuucuccaaggacaacucgauccgccucuccgccggcggggacaucugggugacccgggagcccuacgugagcugcgaccccgacaagugcuaccaguucgcccugggccaggggaccacgcugaacaaccgccacuccaacgacaccguccacgaccggaccccguaccgcacccuccugaugaacgagcugggcgugcccuuccaccucggcacgaagcaggucugcaucgccuggucguccagcuccugccacgacgggaaggcguggcugcacgugugcgugaccggccacgacgagaacgccaccgccucguucaucuacgacgggcggcugguggacuccaucggcagcugguccaagaagauccuccgcacccaggagucggagugcgucugcaucaacgggacgugcaccguggugaugaccgacggcuccgccagcggccgggcggacaccaagauccuguucaucgaggaggggaagaucguccacaucucgccccuguccggcagcgcccagcacguggaggagugcuccugcuacccccgcuacccgggggugcggugcgucugccgcgacaacuggaagggcucgaaccggcccaucguggacaucaacgugaaggacuacuccaucgucagcuccuacgugugcucgggccucgugggggacacgccccgcaagaacgacuccagcuccucgucccacugccugaaccccaacaacgaggagggcgggcacggcgucaaggggugggccuucgacgacggcaacgacguguggaugggccggaccaucagcgagaaguuccgcuccggguacgagaccuucaaggucaucgagggcuggucgaagccgaacuccaagcugcagaucaaccgccaggugaucguggaccgggggaaccggagcggcuacuccgggaucuucucggucgagggcaagagcugcaucaaccgcugcuucuacguggagcucauccggggccgcaagcaggagaccgaggugugguggacguccaacucgaucgucguguucugcgggaccuccggcaccuacgggaccggcagcuggcccgacggggccgacaucggccugaugcccaucuga

SEQ ID NO: 16935 - RNA, 1410 nt, Artificial Sequence
  derived and/or modified CDS sequence (AUadapt) from InfluenzaA__ABB80232__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucgccgccggcggggacaucugggugacccgggagcccuacgugucgugcgaccccgacaagugcuaccaguucgcccugggccaggggaccacgcugaacaaccgccacuccaacgacaccguccacgaccggaccccguaccgcacccuccugaugaacgagcugggcgugcccuuccaccucggcacgaagcaggucugcaucgcguggucguccagcuccugccacgacgggaaggccuggcugcacgugugcgugaccggccacgacgagaacgccaccgccucguucaucuacgacgggcggcugguggacuccaucggcagcugguccaagaagauccuccgcacccaggagucggagugcgucugcaucaacgggacgugcaccguggugaugaccgacggcuccgcgucgggccgggccgacaccaagauccuguucaucgaggaggggaagaucguccacaucucccagcugagcggcucggcccagcacguggaggagugcuccugcuacccccgcuaccccggggugcggugcgucugccgcgacaacuggaagggcucgaaccggccgaucguggacaucaacgugaaggacuacuccaucgucagcuccuacgugugcucgggccucgugggggacacgccccgcaagaacgacuccagcuccucgucccacugccugaaccccaacaacgaggagggcgggcacggcgucaaggggugggccuucgacgacggcgacgacguguggaugggccggaccaucucggagaagcugcgcuccggguacgagaccuucaaggucaucgagggcuggagcaagcccaacuccaagcuccagaucaaccgccaggugaucguggaccgggggaaccggucgggcuacuccgggaucuucucggucgagggcaaguccugcaucaaccgcugcuucuacguggagcugauccggggccgcaagcaggagaccgaggugugguggacgagcaacucgaucgucguguucugcgggaccuccggcaccuacgggaccggcagcuggccggacggggccgacaucaaccugaugcccaucuga

SEQ ID NO: 16936 - RNA, 1410 nt, Artificial Sequence
  derived and/or modified CDS sequence (AUadapt) from InfluenzaA__ABB80243__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacucgaacgacaccguccacgaccgcaccccguaccggacccuccugaugaacgagcugggcgugcccuuccaccucgggacgaagcaggucugcaucgccugguccagcuccucgugccacgacggcaaggcguggcugcacgugugcgugaccgggcacgacgagaacgccaccgccuccuucaucuacgacggccgccugguggacagcaucggguccuggucgaagaagauccuccggacccaggaguccgagugcgucugcaucaacggcacgugcaccguggugaugaccgacggcucggccuccgggcgcgcggacaccaagauccuguucaucgaggagggcaagaucguccacaucagccagcugucgggguccgcccagcacguggaggagugcucgugcuacccccgguaccccggcgugcgcugcgucugccgggacaacuggaagggcuccaaccgcccgaucguggacaucaacgugaaggaccacagcaucgucuccucguacgugugcuccgggcucgugggcgacacgccccggaagaacgacagcuccucguccucgcacugccugaaccccaacaacgaggagggcgggcacggggucaagggcugggccuucgacgacggcaacgacguguggauggggcgcaccaucuccgagaagcugcggagcggcuacgagaccuucaaggucaucgaggggugguccaagcccaacucgaagcuccagaucaaccgccaggugaucguggaccggggcaaccgcuccggguacucgggcaucuucuccgucgagggcaagagcugcaucaaccggugcuucuacguggagcugauccgcgggcggaagaaggagaacgaggugugguggaccucgaacuccaucgucguguucugcggcacgagcgggaccuacggcaccggguccuggccggacggcgccgacaucaaccugaugcccaucuga

SEQ ID NO: 16937 - RNA, 1410 nt, Artificial Sequence
  derived and/or modified CDS sequence (AUadapt) from InfluenzaA__ABB80254__NA
augaaccccaaccagaagaucaucaccaucggcucggugucccugaccaucgccacgaucugcuuccucaugcagaucgccauccuggucaccaccgugacccugcacuucaagcaguacgagugcagcuccccgcccaacaaccaggugaugcucugcgagcccacgaucaucgagcgcaacaucaccgagaucgucuaccugaccaacaccacgaucgagaaggagaucugccccaagcuggcggaguaccggaacuggucgaagccgcagugcaagaucaccggguucgcccccuucuccaaggacaacagcauccgccucuccgccggcggggacaucugggugacccgggagcccuacgugucgugcggccccgacaagugcuaccaguucgcccuggggcagggcaccacgcugaacaaccgccacuccaacgacaccguccacgaccggaccccguaccgcacccuccugaugaacgagcugggcgugcccuuccaccucgggacgaagcaggucugcaucgccuggagcuccucguccugccacgacggcaaggcguggcugcacgugugcgugaccgggcacgacgagaacgccaccgccagcuucaucuacgacggccggcugguggacuccaucgggucgugguccaagaagauccuccgcacccaggagagcgagugcgucugcaucaacggcaucugcacgguggugaugaccgacggcuccgccucggggcgggcggacaccaagauccuguucaucgaggagggcaagaucguccacaucagcccccuguccgggucggcccagcacguggaggagugcuccugcuacccccgcuacccgggcgugcggugcgucugccgcgacaacuggaagggcagcaaccggcccaucguggacaucaacgugaaggacuacuccaucgucucguccuacgugugcagcgggcucgugggcgacacgccccgcaagaacgacuccucguccagcucccacugccugaaccccaacaacgaggagggcgggcacggggucaagggcugggccuucgacgacggcaacgacguguggauggggcggaccaucucggagaaguuccgcuccggcuacgagaccuucaaggucaucgagggguggagcaagccgaacuccaagcugcagaucaaccgccaggugaucguggaccggggcaaccggucgggguacuccggcaucuucagcgucgagggcaagucgugcaucaaccgcugcuucuacguggagcucauccgggggcgcaagcaggagaccgaggugugguggaccuccaacagcaucgucguguucugcggcacguccgggaccuacggcaccgggagcuggcccgacggcgccgacaucaaccugaugcccaucuga

SEQ ID NO: 16938 - RNA, 1410 nt, Artificial Sequence; identical to SEQ ID NO: 16529
  derived and/or modified CDS sequence (AUadapt) from InfluenzaA__ABB80495__NA

SEQ ID NO: 16939 - RNA, 1410 nt, Artificial Sequence; identical to SEQ ID NO: 16916
  derived and/or modified CDS sequence (AUadapt) from InfluenzaA__ABB80506__NA

SEQ ID NO: 16940 - RNA, 1410 nt, Artificial Sequence; identical to SEQ ID NO: 16916
  derived and/or modified CDS sequence (AUadapt) from InfluenzaA__ABB80517__NA

SEQ ID NO: 16941 - RNA, 1410 nt, Artificial Sequence; identical to SEQ ID NO: 16916
  derived and/or modified CDS sequence (AUadapt) from InfluenzaA__ABB80532__NA

SEQ ID NO: 16942 - RNA, 1410 nt, Artificial Sequence
  derived and/or modified CDS sequence (AUadapt) from InfluenzaA__ABB80644__NA
augaaccccaaccagaagaucaucaccaucggcucggugucccugaccaucgccacgaucugcuuccucaugcagaucgccauccuggucaccaccgugacccugcacuucaagcaguacgagugcucguccccgcccaacaaccaggugaugcucugcgagcccacgaucaucgagcgcaacaucaccgagaucgucuaccugaccaacaccacgaucgagaaggagaucugccccaagcuggcggaguaccggaacuggagcaagccgcagugcaagaucaccggguucgcccccuucuccaaggacaacucgauccgccucuccgccggcggggacaucugggugacccgggagcccuacgugagcugcgaccccgacaagugcuaccaguucgcccugggccaggggaccacgcugaacaaccgccacuccaacgacaccguccacgaccggaccccguaccgcacccuccugaugaacgagcugggcgugcccuuccaccucggcacgaagcaggucugcaucgccuggucguccagcuccugccacgacgggaaggcguggcugcacgugugcgugaccggccacgacgagaacgccaccgccucguucaucuacgacgggcggcugguggacuccaucggcagcugguccaacaagauccuccgcacccaggagucggagugcgucugcaucaacgggacgugcaccguggugaugaccgacggcuccgccagcggccgggcggacaccaagauccuguucaucgaggaggggaagaucguccacaucucgccccuguccggcagcgcccagcacguggaggagugcuccugcuacccccgcuacccgggggugcggugcgucugccgcgacaacuggaagggcucgaaccggcccaucguggacaucaacgugaaggacuacuccaucgucagcuccuacgugugcucgggccucgugggggacacgccccgcaagaacgacuccagcuccucgucccacugccugaaccccaacaacgaggagggcgggcacggcgucaaggggugggccuucgacgacggcaacgacguguggaugggccggaccaucagcgagaaguuccgcuccggguacgagaccuucaaggucaucgagggcuggucgaagccgaacuccaagcugcagaucaaccgccaggugaucguggaccgggggaaccggagcggcuacuccgggaucuucucggucgagggcaagagcugcaucaaccgcugcuucuacguggagcucauccggggccgcaagcaggagaccgaggugugguggacguccaacucgaucgucguguucugcgggaccuccggcaccuacgggaccggcagcuggcccgacggggccgacaucaaccugaugcccaucuga

SEQ ID NO: 16943 - RNA, 1410 nt, Artificial Sequence
  derived and/or modified CDS sequence (AUadapt) from InfluenzaA__ABB80664__NA
augaaccccaaccagaagaucaucaccaucggcucggugucccugaccaucgccacgaucugcuuccucaugcagaucgccauccuggucaccaccgugacccugcacuucaagcaguacgagugcucguccccgcccaacaaccaggugaugcucugcgagcccacgaucaucgagcgcaacaucaccgagaucgucuaccugaccaacaccacgaucgagaaggagaucugccccaagcuggcggaguaccggaacuggagcaagccgcagugcaagaucaccggguucgcccccuucuccaaggacaacucgauccgccucuccgccggcggggacaucugggugacccgggagcccuacgugagcugcgaccccgacaagugcuaccaguucgcccugggccaggggaccacgcugaacaaccgccacuccaacgacaccguccacgaccggaccccguaccgcacccuccugaugaacgagcugggcgugcccuuccaccucggcacgaagcaggucugcaucgccuggucguccagcuccugccacgacgggaaggcguggcugcacgugugcgugaccggccacgacgagaacgccaccgccucguucaucuacgacgggcggcugguggacuccaucggcagcugguccaagaagauccuccgcacccaggagucggagugcgucugcaucaacgggacgugcaccguggugaugaccgacggcuccgccagcggccgggcggacaccaagguccuguucaucgaggaggggaagaucgugcacaucucgccccuguccggcagcgcccagcacguggaggagugcuccugcuacccccgcuacccggggguccggugcgugugccgcgacaacuggaagggcucgaaccggcccaucguggacaucaacgucaaggacuacuccaucgugagcuccuacgugugcucgggccucgucggggacacgccccgcaagaacgacuccagcuccucgucccacugccugaaccccaacaacgaggagggcgggcacggcgugaaggggugggccuucgacgacggcaacgacgucuggaugggccggaccaucagcgagaaguuccgcuccggguacgagaccuucaaggugaucgagggcuggucgaagccgaacuccaagcugcagaucaaccgccaggugaucgucgaccgggggaaccggagcggcuacuccgggaucuucucgguggagggcaagagcugcaucaaccgcugcuucuacguggagcucauccggggccgcaagcaggagaccgaggucugguggacguccaacucgaucgugguguucugcgggaccuccggcaccuacgggaccggcagcuggcccgacggggccgacaucaaccugaugcccaucuga

SEQ ID NO: 16944 - RNA, 1410 nt, Artificial Sequence
  derived and/or modified CDS sequence (AUadapt) from InfluenzaA__ABB80675__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucgccgccggcggggacaucugggugacccgggagcccuacgugucgugcgaccccgacaagugcuaccaguucgcccugggccaggggaccacgcugaacaaccgccacuccaacgacaccguccacgaccggaccccguaccgcacccuccugaugaacgagcugggcgugcccuuccaccucggcacgaagcaggucugcaucgcguggagcuccucguccugccacgacgggaaggccuggcugcacgugugcgugaccggccacgacgagaacgccaccgccucguucaucuacgacgggcggcugguggacuccaucggcagcugguccaagaagauccuccgcacccaggagucggagugcgucugcaucaacgggacgugcaccguggugaugaccgacggcuccgcgagcggccgggccgacaccaagauccuguucaucgaggaggggaagaucguccacaucucccagcugucgggcagcgcccagcacguggaggagugcuccugcuacccccgcuaccccggggugcggugcgucugccgcgacaacuggaagggcucgaaccggccgaucguggacaucaacgugaaggacuacuccaucgucucguccuacgugugcagcggccucgugggggacacgccccgcaagaacgacuccucguccagcuccuacugccugaaccccaacaacgaggagggcgggcacggcgucaaggggugggccuucgacgacggcgacgacguguggaugggccggaccaucucggagaagcugcgcuccggguacgagaccuucaaggucaucgagggcuggucgaagcccaacuccaagcuccagaucaaccgccaggugaucguggaccgggggaaccggagcggcuacuccgggaucuucucggucgagggcaaguccugcaucaaccgcugcuucuacguggagcugauccggggccgcaagcaggagaccgaggugugguggacgagcaacucgaucgucguguucugcgggaccuccggcaccuacgggaccggcagcuggccggacggggccgacaucaaccugaugcccaucuga

SEQ ID NO: 16945 - RNA, 1410 nt, Artificial Sequence
  derived and/or modified CDS sequence (AUadapt) from InfluenzaA__ABB80685__NA
augaaccccaaccagaagaucaucaccaucggcucggugucccugaccaucgccacgaucugcuuccucaugcagaucgccauccuggucaucaccgugacccugcacuucaagcaguacgagugcaacucgccgcccaacaaccaggugaugcucugcgagcccaccaucaucgagcgcaacaucacggagaucgucuaccugaccaacaccaccaucgagaaggagaucugccccaagcuggcggaguaccggaacugguccaagccgcagugcaagaucacgggguucgcccccuucagcaaggacaacuccauccgccucucggccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggaccaagcaggucugcaucgccugguccucguccucgugccacgacggcaaggcguggcugcacgugugcgugacggggcacgacgagaacgccaccgccuccuucaucuacgacggccgccugguggacagcaucggguccuggucgaagaagauccuccggacccaggaguccgagugcgucugcaucaacgggaccugcacgguggugaugaccgacggcagcgccuccgggcgcgcggacaccaagauccuguucaucgaggagggcaagaucguccacaucucgcagcugagcggguccgcccagcacguggaggagugcucgugcuacccccgguaccccggcgugcgcugcgucugccgggacaacuggaagggcuccaaccgcccgaucguggacaucaacgugaaggaccacucgaucgucuccagcuacgugugcuccgggcucgugggcgacacgccccggaagaacgacucguccagcuccucgcacugccugaaccccaacaacgaggagggcggccacggggucaagggcugggccuucgacgacggcaacgacguguggauggggcgcaccaucuccgagaagcugcggucgggcuacgagaccuucaaggucaucgaggggugguccaagcccaacagcaagcuccagaucaaccgccaggugaucguggaccggggcaaccgcuccggguacucgggcaucuucuccgucgagggcaagagcugcaucaaccggugcuucuacguggagcugauccgcgggcggaagcaggagaccgaggugugguggaccucgaacuccaucgucguguucugcggcacgagcgggaccuacggcaccggguccuggccggacggcgccgacaucaaccugaugcccaucuga

SEQ ID NO: 16946 - RNA, 1410 nt, Artificial Sequence; identical to SEQ ID NO: 16916
  derived and/or modified CDS sequence (AUadapt) from InfluenzaA__ABB80696__NA

SEQ ID NO: 16947 - RNA, 1410 nt, Artificial Sequence
  derived and/or modified CDS sequence (AUadapt) from InfluenzaA__ABB80707__NA
augaaccccaaccagaagaucaucaccaucggcucggugucccugaccaucgccacgaucugcuuccucaugcagaucgccauccuggucaccaccgugacccugcacuucaagcaguacgagugcucguccccgcccaacaaccaggugaugcucugcgagcccacgaucaucgagcgcaacaucaccgagaucgucuaccugaccaacaccacgaucgagaaggagaucugccccaagcuggcggaguaccggaacuggagcaagccgcagugcaagaucaccggguucgcccccuucuccaaggacaacucgauccgccucuccgccggcggggacaucugggugacccgggagcccuacgugagcugcggccccgacaagugcuaccaguucgcccuggggcagggcaccacgcugaacaaccgccacuccaacgacaccguccacgaccggaccccguaccgcacccuccugaugaacgagcugggcgugcccuuccaccucgggacgaagcaggucugcaucgccuggucguccagcuccugccacgacggcaaggcguggcugcacgugugcgugaccgggcacgacgagaacgccaccgccucguucaucuacgacggccggcugguggacuccaucgggagcugguccaagaagauccuccgcacccaggagucggagugcgucugcaucaacggcacgugcaccguggugaugaccgacggcuccgccagcgggcgggcggacaccaagauccuguucaucgaggagggcaagaucguccacaucucgccccuguccgggagcgcccagcacguggaggagugcuccugcuacccccgcuacccgggcgugcggugcgucugccgcgacaacuggaagggcucgaaccggcccaucguggacaucaacgugaaggacuacuccaucgucagcuccuacgugugcucggggcucgugggcgacacgccccgcaagaacgacuccagcuccucgucccacugccugaaccccaacaacgaggagggcgggcacggggucaagggcugggccuucgacgacggcaacgacguguggauggggcggaccaucagcgagaaguuccgcuccggcuacgagaccuucaaggucaucgagggguggucgaagccgaacuccaagcugcagaucaaccgccaggugaucguggaccggggcaaccggagcggguacuccggcaucuucucggucgagggcaagagcugcaucaaccgcugcuucuacguggagcucauccgggggcgcaagcaggagaccgaggugugguggacguccaacucgaucgucguguucugcggcaccuccgggaccuacggcaccgggagcuggcccgacggcgccgacaucaaccugaugcccaucuga

SEQ ID NO: 16948 - RNA, 1410 nt, Artificial Sequence; identical to SEQ ID NO: 16916
  derived and/or modified CDS sequence (AUadapt) from InfluenzaA__ABB80716__NA

SEQ ID NO: 16949 - RNA, 1410 nt, Artificial Sequence
  derived and/or modified CDS sequence (AUadapt) from InfluenzaA__ABB80725__NA
augaaccccaaccagaagaucaucaccaucggcucggugucccugaccaucgccacgaucugcuuccucaugcagaucgccauccuggucaccaccgugacccugcacuucaagcaguacgagugcucguccccgcccaacaaccaggugaugcucugcgagcccacggucaucgagcgcaacaucaccgagaucguguaccugaccaacaccacgaucgagaaggagaucugccccaagcuggcggaguaccggaacuggagcaagccgcagugcaagaucaccggguucgcccccuucuccaaggacaacucgauccgccucuccgccggcggggacaucugggugacccgggagcccuacgucagcugcgaccccgacaagugcuaccaguucgcccugggccaggggaccacgcugaacaaccgccacuccaacgacaccgugcacgaccggaccccguaccgcacccuccugaugaacgagcugggcgugcccuuccaccucggcacgaagcaggucugcaucgccuggucguccagcuccugccacgacgggaaggcguggcugcacgugugcgugaccggccacgacgagaacgccaccgccucguucaucuacgacgggcggcuggucgacuccaucggcucgugguccaagaagauccuccgcacccaggagagcgagugcgugugcaucaacgggacgugcaccguggucaugaccgacggcuccgccucgggccgggcggacaccaagauccuguucaucgaggaggggaagaucgugcacaucagcccccuguccggcucggcccagcacguggaggagugcuccugcuacccccgcuacccggggguccggugcgugugccgcgacaacuggaagggcagcaaccggcccaucguggacaucaacgucaaggacuacuccaucgugucguccuacgugugcagcggccucgucggggacacgccccgcaagaacgacuccucguccucgucccacugccugaaccccaacaacgaggagggcgggcacggcgugaaggggugggccuucgacgacggcaacgacgucuggaugggccggaccaucagcgagaaguuccgcuccggguacgagaccuucaaggugaucgagggcuggucgaagccgaacuccaagcugcagaucaaccgccaggugaucgucgaccgggggaaccggagcggcuacuccgggaucuucucgguggagggcaagagcugcaucaaccgcugcuucuacguggagcucauccggggccgcaagcaggagaccgaggucugguggacguccaacucgaucguggccuucugcgggaccuccggcaccuacgggaccggcagcuggcccgacggggccgacaucaaccugaugcccaucuga

SEQ ID NO: 16950 - RNA, 1410 nt, Artificial Sequence
  derived and/or modified CDS sequence (AUadapt) from InfluenzaA__ABB80740__NA
augaaccccaaccagaagaucaucaccaucggcucggugucccugaccaucgccacgaucugcuuccucaugcagaucgccauccuggucaccaccgugacccugcacuucaagcaguacgagugcugcucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccgacaagugcuaccaguucgcccugggccaggggaccacgcugaacaaccgccacagcaacgacaccguccacgaccggaccccguaccgcacccuccugaugaacgagcugggcgugcccuuccaccucggcacgaagcaggucugcaucgccugguccucguccagcugccacgacgggaaggcguggcugcacgugugcgugaccggccacgacgagaacgccaccgccuccuucaucuacgacgggcggcugguggacucgaucggcuccuggagcaagaagauccuccgcacccaggaguccgagugcgucugcaucaacgggacgugcaccguggugaugaccgacggcucggccuccggccgggcggacaccaagauccuguucaucgaggaggggaagaucguccacaucagcccccugucgggcuccgcccagcacguggaggagugcucgugcuacccccgcuacccgggggugcggugcgucugccgcgacaacuggaagggcuccaaccggcccaucguggacaucaacgugaaggacuacagcaucgucuccucguacgugugcuccggccucgugggggacacgccccgcaagaacgacagcuccucguccagccacugccugaaccccaacaacgaggagggcgggcacggcgucaaggggugggccuucgacgacggcaacgacguguggaugggccggaccaucuccgagaaguuccgcucgggguacgagaccuucaaggucaucgagggcugguccaagccgaacagcaagcugcagaucaaccgccaggugaucguggaccgggggaaccgguccggcuacucggggaucuucuccgucgagggcaagagcugcaucaaccgcugcuucuacguggagcucauccggggccgcaagcaggagaccgaggugugguggacgucgaacuccaucgucgccuucugcgggaccagcggcaccuacgggaccggcuccuggcccgacggggccgacaucaaccugaugcccaucuga

SEQ ID NO: 16951 - RNA, 1410 nt, Artificial Sequence; identical to SEQ ID NO: 16916
  derived and/or modified CDS sequence (AUadapt) from InfluenzaA__ABB80751__NA

SEQ ID NO: 16952 - RNA, 1410 nt, Artificial Sequence; identical to SEQ ID NO: 16635
  derived and/or modified CDS sequence (AUadapt) from InfluenzaA__ABB82186__NA

SEQ ID NO: 16953 - RNA, 1413 nt, Artificial Sequence; identical to SEQ ID NO: 16798
  derived and/or modified CDS sequence (AUadapt) from InfluenzaA__ABB82197__NA

SEQ ID NO: 16954 - RNA, 1413 nt, Artificial Sequence; identical to SEQ ID NO: 16788
  derived and/or modified CDS sequence (AUadapt) from InfluenzaA__ABB82208__NA

SEQ ID NO: 16955 - RNA, 1413 nt, Artificial Sequence
  derived and/or modified CDS sequence (AUadapt) from InfluenzaA__ABB82219__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugaucgcggagaaggacaagaccucggugacccuggccgggaacuccagccugugcuccaucagcggcugggccaucuacaccaaggacaacuccauccggaucggcucgaagggggacgucuucgugauccgcgagccguucaucuccugcagcaaccucgagugccggacguucuuccugacccagggcgcccugcucaacgacaagcacuccaacgggaccgugaaggaccgcucgcccuaccgggcccugauguccugcccccugggcgaggcgcccagcccguacaacucgaaguucgaguccgucgccuggagcgccuccgccugccacgacgggaugggcuggcucaccaucggcaucagcgggcccgacaacggcgcgguggccgugcugaaguacaacgggaucaucacggagaccaucaaguccuggaagaagcgcauccugcggacccaggagucggagugcgucugcgugaacggcuccugcuucaccaucaugacggacggccccagcaacggggccgccuccuacaagaucuucaagaucgagaagggcaaggugaccaagucgaucgagcucaacgcccccaacuuccacuacgaggagugcuccugcuacccggacaccgggaccgucaugugcgugugccgcgacaacuggcacggcagcaaccggcccuggguguccuucaaccagaaccuggacuaccagaucggguacaucugcucgggcgucuucggcgacaacccccgccccaaggacggggagggcuccugcaacccggugacgguggacggggcggacggcgucaagggguucagcuacaaguacggcaacggcguguggaucgggcggaccaaguccaaccgccugcggaagggcuucgagaugaucugggaccccaacggguggaccgacaccgacagcgacuucuccgugaagcaggacgucguggccaucacggacuggucgggcuacagcggguccuucgugcagcaccccgagcucaccggccuggacugcauccgccccugcuucugggucgagcuggugcggggccucccgcgcgagaacaccaccaucuggacgucgggguccagcaucuccuucugcggcgucaacagcgacgccgccgacugguccuggcccgacggggccgagcugcccuucaccaucgacaaguga

SEQ ID NO: 16956 - RNA, 1410 nt, Artificial Sequence
  derived and/or modified CDS sequence (AUadapt) from InfluenzaA__ABB82230__NA
augaaccccaaccagaagaucaucaccaucggcucggugucccugaccaucgccacggucugcuuccucaugcagaucgccauccuggugaccaccgugacccugcacuucaagcaguacgagugcgacucgccggcgaacaaccaggucaugcccugcgagcccaucaucaucgagcgcaacaucacggagaucguguaccucaccaacaccaccaucgagaaggagaucugccccaagcugguggaguaccggaacugguccaagccgcagugcaagaucacgggguucgcccccuucucgaaggacaacuccauccgccugagcgccggcggggacaucugggucacccgggagcccuacguguccugcgaccccggcaagugcuaccaguucgcccucgggcagggcaccacccuggacaacaagcacucgaacgacacgauccacgaccgcaucccgcaccggacccugcucaugaacgagcugggcgugcccuuccaccuggggacccgccaggucugcaucgccugguccucguccagcugccacgacggcaaggcguggcuccacgugugcgugaccggggacgacaagaacgccacggccuccuucaucuacgacggccggcuggucgacucgaucggguccuggucgcagaacauccugcgcacccaggaguccgagugcgugugcaucaacgggaccugcaccguggucaugacggacggcucggccuccggccgggcggacacccgcauccucuucaucgaggagggcaagaucgugcacaucagcccccugucgggguccgcccagcacguggaggagugcucgugcuacccccgguacccgggcguccgcugcaucugccgggacaacuggaagggcuccaaccgccccaucguggacaucaacgugaaggacuacagcaucgacucccgguacgucugcucggggcuggugggcgacacgccccgcaacaacgaccgguccucgaacuccaacugccgcaaccccaacaacgacaaggggaaccacggcgugaaggggugggccuucgacgacggcaacgacgucuggaugggccggaccaucucgaaggacucccgcagcggguacgagaccuucaaggugaucggcgggugguccaccccgaacucgaagucccagaucaaccggcaggucaucguggacucggacaaccgcuccggcuacagcgggaucuucuccguggagggcaagucgugcaucaaccgcugcuucuacgucgagcucauccggggccgcgagcaggagacccgggugugguggaccucgaacuccaucguggucuucugcgggacgagcggcaccuacgggaccggcuccuggcccgacggggccgacaucaaccugaugcccaucuga

SEQ ID NO: 16957 - RNA, 1410 nt, Artificial Sequence
  derived and/or modified CDS sequence (AUadapt) from InfluenzaA__ABB83018__NA
augaaccccaaccagaagaucaucaccaucggcucggugucccugaccaucgccacgaucugcuuccucacccagaucgccauccuggucaccaccgugacgcugcacuucaagcaguacgggugcaacucgccgcccaacaaccaggugaugcucugcgagcccaccaucaucgagcgcaacaucaccgagaucgucuaccugaccaacacgaccaucgagaaggagaucugccccaagcuggcggaguaccggaacugguccaagccgcagugcaacaucaccggcuucgcccccuucagcaaggacaacuccauccgccucucggccgggggcgacaucugggugacccgggagcccuacguguccugcgaccccgacaagugcuaccaguucgcccuggggcagggcacgacccugaacaacggccacucgaacgacaccguccacgaccgcaccccguaccggacgcuccugaugaacgagcugggggugcccuuccaccucggcaccaagcaggucugcaucgccugguccagcuccucgugccacgacgggaaggcguggcugcacgugugcgugaccggcgacgacaagaacgccaccgccuccuucaucuacaacgggcgccugguggacagcaucggcuccuggucgaagaagauccuccggacgcaggaguccgagugcgucugcaucaacgggaccugcaccguggugaugaccgacgggucggccuccggcaaggcggacacgaagauccuguucaucgaggaggggaagaucguccacaccagccugcucucgggcuccgcccagcacguggaggagugcucgugcuacccccgcuaccccggcgugcggugcgucugccgcgacaacuggaagggguccaaccggccgaucguggacaucaacgugaaggacuacagcaucgucuccucguacgugugcuccggccuggugggggacacgccccgcaagaacgacagcuccucguccucgcacugccuggaccccaacaacgaggagggcgggcacggcgucaagggcugggccuucgacgacgggaacgacguguggaugggccggaccaucuccgagaagcuccgcagcggguacgagaccuucaaggucaucgagggcugguccaagcccaacucgaagcugcagaucaaccgccaggugaucguggaccgggggaaccgguccggcuacucgggcaucuucuccgucgagggcaagagcugcaucaaccgcugcuucuacguggagcugauccggggccgcaaccaggagaccgaggugcucuggaccucgaacuccaucgucguguucugcgggaccagcggcacguacgggaccggcuccuggccggacggcgccgacaucaaccugaugcccaucuga

SEQ ID NO: 16958 - RNA, 1410 nt, Artificial Sequence; identical to SEQ ID NO: 16957
  derived and/or modified CDS sequence (AUadapt) from InfluenzaA__ABB83029__NA

SEQ ID NO: 16959 - RNA, 1410 nt, Artificial Sequence; identical to SEQ ID NO: 16784
  derived and/or modified CDS sequence (AUadapt) from InfluenzaA__ABB83130__NA

SEQ ID NO: 16960 - RNA, 1410 nt, Artificial Sequence
  derived and/or modified CDS sequence (AUadapt) from InfluenzaA__ABB83141__NA
augaaccccaaccagaagaucaucaccaucggcucggugucccugaccaucgccacgaucugcuuccucucgcagaucgccauccuggucaccaccgugacccugcacuucaagcaguacgagugcaacuccccgcccaacaaccaggugaugcucugcgagcccacgaucaucgagcgcaacaucaccgagaucgucuaccugaccaacaccacgaucgagaaggagaucugccccaagcuggcggaguaccggaacuggagcaagccgcagugcaacaucaccggguucgcccccuucuccaaggacaacucgauccgccucuccgccggcggggacaucugggugacccgggagcccuacgugagcugcgaccccgacaagugcuaccaguucgcccugggccaggggaccacgcugaacaacggccacuccaacgacaccguccacgaccgcaccccguaccggacccuccugaugaacgagcugggcgugcccuuccaccucgggacgaagcaggucugcaucgccuggucguccucguccugccacgacggcaaggcguggcugcacgugugcgugaccggggacgacaagaacgccaccgccagcuucaucuacaacggccgccugguggacuccaucgggucgugguccaagaagauccuccggacccaggagagcgagugcgucugcaucaacggcacgugcaccguggugaugaccgacggcuccgccucggggaaggcggacaccaagauccuguucaucgaggagggcaagaucguccacacgucgcugcucuccgggagcgcccagcacguggaggagugcuccugcuacccccgcuaccccggcgugcggugcgucugccgcgacaacuggaagggcucgaaccggccgaucguggacaucaacgugaaggacuacuccaucgucagcuccuacgugugcucggggcuggugggcgacacgccccgcaagaacgacuccucguccagcucccacugccuggaccccaacaacgaggagggcgggcacggggucaagggcugggccuucgacgacggcaacgacguguggauggggcggaccaucucggagaagcuccgcuccggcuacgagaccuucaaggucaucgagggguggagcaagcccaacuccaagcugcagaucaaccgccaggugaucguggaccgggacaaccggucgggcuacuccgggaucuucucggucgagggcaagagcugcaucaaccgcugcuucuacguggagcugauccggggccgcaaccaggagaccgaggugcucuggaccuccaacucgaucgucguguucugcgggaccuccggcaccuacgggacgggcagcuggccggacggggccgacaucaaccugaugcccaucuga

SEQ ID NO: 16961 - RNA, 1410 nt, Artificial Sequence
  derived and/or modified CDS sequence (AUadapt) from InfluenzaA__ABB86876__NA
augaacaccaaccagcgcaucaucaccaucggcacggugugccugaucgucgggaucaucucgcuccugcugcagaucggcaacaucgugucccucuggaucagccacuccauccagaccgggggcaagaaccacagcgagaugugcaaccagaacgugaucaccuacgucaacaacaccugggugaaccggacguacgugaacaucuccaacaccaacaucgccaccguccaggacgugaccagcgugauccuggccgggaacuccagccugugcuccgucagcggcugggcgaucuacuccaaggacaacagcauccgcaucggcuccaagggggacaucuucgugauccgggagcccuucaucagcugcucccaccucgagugccgcacguucuuccugacccagggcgcccugcucaacgacaagcacagcaacgggaccgugaaggaccgguccccguaccgcacccugaugucgugccccaucggcgaggcccccucccccuacaacagccgguucgagagcgucgccugguccgccagcgcgugccacgacgggaugggcuggcugacgaucggcaucuccgggccggacaacggcgccguggccgugcucaaguacaacgggaucaucaccgacaccaucaagagcuggcgcaacaagauccugcggacccaggaguccgagugcgucugcaugaacggcagcugcuucacggugcugaccgacggccccuccaacgggcaggccagcuacaagaucuucaagguggagaagggcaagaucaucaaguccaucgagcucgacgcgcccaacuaccacuacgaggagugcagcugcuaccccgacaccgggaaggucaugugcgugugccgcgacaacuggcacgccuccaaccggccgugggugagcuucgaccagaaccuggacuaccagaucggcuacaucugcuccggggucuucggcgacaacccccgcagcaacgacggcaaggggaacugcggccccgugcuguccaacggggccaacggcgugaagggguucucguuccgguacggcaacggcgucuggaucgggcgcaccaaguccaucaacagccgguccggcuucgagaugaucugggaccccaacggguggacgggcaccgacagcagcuucuccaugaagcaggacaucaucgcccucaccgacuggagcggguacuccggcagcuucgugcagcacccggagcugaccggcaugaacugcauccgccccugcuucugggucgagcugauccgggggcagcccaaggaguccacgaucugggccagcggcuccagcaucuccuucugcgggguggacagcgagaccaccuccuggagcuggcccgacggcgcggaccucccguucaccaucgacaaguga

SEQ ID NO: 16962 - RNA, 1410 nt, Artificial Sequence
  derived and/or modified CDS sequence (AUadapt) from InfluenzaA__ABB86886__NA
augaacaccaaccagcgcaucaucaccaucggcacggccugccuggccaucgggaucgugucgcuccugcugcagaucggcaacaucgucucccucuggaucagccacuccauccagaccgaggagaagaaccacagcgagaccugcucccagaacuucaucacccacgagaacaacacgugggugaaccagaccuacaucaacaucagcaacaccaacaacguggucgggcagggcgugaccuccaucaugcuggcggggaacucgucccugugccccaucagcggcugggccaucuacuccaaggacaacagcauccggaucggcuccaagggggacaucuucgugauccgcgagccguucaucagcugcucccaccucgagugccggacguucuuccugacccagggcgcccugcucaacgacaagcacucgaacgggaccgucaaggaccgcucccccuaccggacccugaugagcugccccaucggcgaggcccccuccccguacaacagccgcuucgagagcguggccugguccgcgucggccugccacgacgggaugggcuggcugacgaucggcaucuccgggcccgacaacggcgccguggccgucuucaaguacaacgggaucaucaccgacaccaucaagagcuggcggaacaagauccuccgcacccaggaguccgagugcgugugcaucaacggcagcugcuucacgaucaugaccgacggccccuccaacgggcaggcgagcuacaagaucuucaagauggagaagggcaagaucaucaaguccguggagcuggacgcccccaacuaccacuacgaggagagcuccugcuacccggacaccgggaaggucgugugcgugugccgggacaacuggcacgccucgaaccgccccugggucuccuucgaccagaaccuggacuaccagaucggcuacaucugcagcgggguguucggcgacaacccccgguccaacgacggcaaggggaacugcggccccgugcucagcaacggggccaacggcgucaaggagguguccuuccgcuacgggaacggcguguggaucggccggaccaagagcaucuccucgcgcagcggguucgagaugaucugggacccgaacggcuggacggagaccgacuccagcuucuccaucaagcaggacaucaucgcccugaccgacuggagcggguacuccggcucguucguccagcaccccgagcugaccgggaugaacugcaucaagcccugcuucuggguggagcucauccggggccagcccaaggaguccacgaucuggaccagcggcuccagcaucuccuucugcgggguggacagcgagaccgcguccuggagcuggccggacggcgccgaccugcccuucaccaucgacaaguga

SEQ ID NO: 16963 - RNA, 1410 nt, Artificial Sequence
  derived and/or modified CDS sequence (AUadapt) from InfluenzaA__ABB86898__NA
augaaccccaaccagaagaucaucaccaucggcucggugucccugacccucgccacgaucugcuuccugaugcagaucgccauccuggucaccaccgugacccuccacuucaagcagcaggagugcaacucgccgcccaacaaccaggugaugcugugcgagcccacgaucaucgagcgcaacaucaccgagaucgucuaccugaccaacaccacgaucgagaaggagaucugccccaagcucgcggaguaccggaacugguccaagccgcagugcaacaucaccggguucgcccccuucagcaaggacaacuccauccgccugucggccggcggggacaucugggugacccgggagcccuacguguccugcgaccccgacaagugcuaccaguucgcccugggccaggggaccacgcucaacaacggccacagcaacaacaccguccacgaccgcaccccguaccggacccugcugaugaacgagcucggcgugcccuuccaccuggggacgcgccaggugugcaucgccugguccucguccagcugccacgacggcaaggcguggcugcacgucugcaucaccggggacgacaagaacgccaccgccuccuucaucuacaacggccggcucguggacucgaucggguccuggagcaagaagauccugcgcacccaggaguccgagugcgugugcaucaacggcacgugcaccgucgugaugaccgacggcucggccuccgggaaggcggacaccaagauccuguucaucgaggagggcaagaucgugcacaucagcacgcucucgggguccgcccagcacgucgaggagugcucgugcuacccccgguaccccggcgugcgcugcgugugccgggacaacuggaagggcuccaaccgcccgaucgucgacaucaacgugaaggacuacagcaucguguccucguacgucugcuccgggcuggugggcgacacgccccggaagaacgacagcuucuccucgucccacugccuggaccccaacaacgaggagggcgggcacggggugaagggcugggccuucgacgacggcaacgacgucuggauggggcgcaccaucagcgagaagcuccgguccggcuacgagaccuucaaggugaucgagggguggucgaagcccaacuccaagcugcagaucaaccgccaggucaucguggagcggggcagccgcuccggguacucgggcaucuucuccguggagggcaagagcugcaucaaccggugcuucuacgucgagcugauccgcgggcggaaggaggagaccaaggugugguggaccucgaacuccaucguggucuucugcggcaccagcgggaccuacggcacgggguccuggccggacggcgccgacaucaaccucaugcccaucuga

SEQ ID NO: 16964 - RNA, 1410 nt, Artificial Sequence
  derived and/or modified CDS sequence (AUadapt) from InfluenzaA__ABB86906__NA
augaacaccaaccagcgcaucaucaccaucggcacggugugccugaucgucgggaucaucucgcuccugcugcagaucggcaacaucgugucccucuggaucagccacuccauccagaccgggggcaagaaccacagcgagaugugcaaccagaacgugaucaccuacgucaacaacaccugggugaaccggacguacgugaacaucuccaacaccaacaucgccaccguccaggacgugaccagcgugauccuggccgggaacuccagccugugcuccgucagcggcugggcgaucuacuccaaggacaacagcauccgcaucggcuccaagggggacaucuucgugauccgggagcccuucaucagcugcucccaccucgagugccgcacguucuuccugacccagggcgcccugcucaacgacaagcacagcaacgggaccgugaaggaccgguccccguaccgcacccugaugucgugccccaucggcgaggcccccucccccuacaacagccgguucgagagcgucgccugguccgccagcgcgugccacgacgggaugggcuggcugacgaucggcaucuccgggccggacaacggcgccguggccgugcucaaguacaacgggaucaucaccgacaccaucaagagcuggcgcaacaagauccugcggacccaggaguccgagugcgucugcaugaacggcagcugcuucacggugcugaccgacggccccuccaacgggcaggccagcuacgagaucuucaagguggagaagggcaagaucaucaaguccaucgagcucgacgcgcccaacuaccacuacgaggagugcagcugcuaccccgacaccgggaaggucaugugcgugugccgcgacaacuggcacgccuccaaccggccgugggugagcuucgaccagaaccugaacuaccagaucggcuacaucugcuccggggucuucggcgacaacccccgcagcaacgacggcaaggggaacugcggccccgugcuguccaacggggccaacggcgugaagggguucucguuccgguacggcaacggcgucuggaucgggcgcaccaaguccaucagcucccggagcggcuucgagauggugugggaccccaacggguggacgggcaccgacagccgcuucuccaugaagcaggacaucaucgcccucaccgacuggagcggguacuccggcagcuucguccagcacccggagcugaccggcaugaacugcauccggcccugcuucuggguggagcugauccgcgggcagcccaaggaguccacgaucugggccagcggcuccagcaucuccuucugcggggugaacagcgagaccgcguccuggagcuggcccgacggcgccgaccucccguucaccaucgacaaguga

SEQ ID NO: 16965 - RNA, 1410 nt, Artificial Sequence
  derived and/or modified CDS sequence (AUadapt) from InfluenzaA__ABB86916__NA
augaaccccaaccagaagaucaucaccaucggcucggugucccugaccaucgccacgaucugcuuccucacccagaucgccauccuggucaccaccgugacgcugcacuucaagcaguacgagugcaacucgccgcccaacaaccaggugaugcucugcgagcccaccaucaucgagcgcaacaucaccgagaucgucuaccugaccaacacgaccaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggacgacccugaacaacggccacagcaacgacaccguccacgaccgcaccccguaccggacgcuccugaugaacgagcugggcgugcccuuccaccucgggaccaagcaggucugcaucgccugguccucguccucgugccacgacggcaaggcguggcugcacgugugcaucaccggggacgacaagaacgccaccgccuccuucaucuacaacggccgccugguggacagcaucuccucgugguccaagaagauccuccggacgcaggagagcgagugcgugugcaucaacgggaccugcaccgucgugaugaccgacggcuccgccucgggcaaggcggacacgaagauccuguucaucgaggaggggaagaucgugcacaccucgcugcucuccggcagcgcccagcacgucgaggagugcuccugcuacccccgcuaccccggggugcggugcgugugccgcgacaacuggaagggcucgaaccggccgaucgucgacaucaacgugaaggacuacuccaucgugagcuccuacgucugcucgggccuggugggggacacgccccgcaagaacgacuccucguccagcucccacugccuggaccccaacaacgaggagggcgggcacggcgugaaggggugggccuucgacgacggcaacgacgucuggaugggccggaccaucucggagaagcuccgcuccggguacgagaccuucaaggugaucgagggcuggagcaagcccaacuccaagcugcagaucaaccggcaggucaucguggaccgcgacaaccggucgggguacuccggcaucuucucgguggagggcaagagcugcaucaaccgcugcuucuacgucgagcugauccgggggcgcaaccaggagaccgaggugcucuggaccuccaacucgaucguggucuucugcggcaccuccgggacguacggcaccgggagcuggccggacggcgccgacaucaaccugaugcccaucuga

SEQ ID NO: 16966 - RNA, 1410 nt, Artificial Sequence
  derived and/or modified CDS sequence (AUadapt) from InfluenzaA__ABB86928__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccagcugccacgacggcaaggcguggcugcacgucugcaucaccggggacgacaagaacgccaccgccuccuucaucuacaacggccggcugguggacucgaucggguccuggagcaagaagauccuccgcacccaggaguccgagugcgugugcaucaacggcacgugcaccgucgugaugaccgacggcucggccuccgggaaggcggacaccaagauccuguucaucgaggagggcaagaucgugcacaucagcacgcugucgggguccgcccagcacgucgaggagugcucgugcuacccccgguaccccggcgugcgcugcgugugccgggacaacuggaagggcuccaaccgcccgaucgucgacaucaacgugaaggacuacagcaucguguccucguacgucugcuccgggcucgugggcgacacgccccggaagaacgacagcuucuccucgucccacugccugaaccccaacaacgaggagggcgggcacggggugaagggcugggccuucgacgacggcaacgacgucuggauggggcgcaccaucagcgagaagcugcgguccggcuacgagaccuucaaggugaucgagggguggucgaagcccaacuccaagcuccagaucaaccgccaggucaucguggagcggggcaaccgcagcggguacuccggcaucuucucgaucgagggcaaguccugcaucaaccggugcuucuacguggagcugauccgcgggcggaaggaggagaccaaggucugguggaccagcaacucgaucgugguguucugcggcaccuccgggaccuacggcacggggagcuggccggacggcgccgacaucaaccugaugcccaucuga

SEQ ID NO: 16967 - RNA, 1410 nt, Artificial Sequence
  derived and/or modified CDS sequence (AUadapt) from InfluenzaA__ABB86936__NA
augaacaccaaccagcgcaucaucaccaucggcacggugugccugaucgucgggaucaucucgcuccugcugcagaucggcaacaucgugucccucuggaucaaccacagcauccagaccgaggggaagaaccacuccgagaugugcaaccagaacgugaucaccuacgucaacaacaccugggugaaccggacguacgugaacaucagcaacaccaacaucgccaccguccaggacgugaccuccgugauccuggccggcaacagcucccugugccccgucucggggugggcgaucuacuccaaggacaacagcauccgcaucggcuccaagggcgacaucuucgugauccgggagccguucaucagcugcucccaccucgagugccgcacguucuuccugacccagggggcccugcucaacgacaagcacagcaacggcaccgugcgggaccgcucccccuaccggacccugaugagcugccccacgggggaggcccccuccccguacaacucgcgcuucgaguccgucgccuggagcgccagcgcgugccacgacggcaugggguggcugaccaucggcaucuccggccccgacaacggggccguggccgugcucaaguacaacggcaucaucaccgacaccaucaagagcuggcggaacaagauccugcgcacgcaggaguccgagugcgucugcaugaacgggucgugcuucaccgugcugaccgacggccccuccaacggccaggccagcuacaagaucuucaagguggagaaggggaagaucaucaaguccaucgagcucgacgcgcccaacuaccacuacgaggagugcagcugcuacccggacaccggcaaggucaugugcgugugccgggacaacuggcacgccuccaaccgccccuggaucuacuucgaccagaaccuggacuaccagaucggguacaucugcagcggcguguucggggacaacccccgguccaacgacggcaagggcaacugcgggcccguccugagcaacggcgccaacggggugaagggcuucuccuuccgcuacgggaacggcguguggaucggccggaccaagucgaucaacucccgcagcggguucgagaugaucugggacccgaacggcuggacggggaccgacuccagcuucuccaugaagcaggacauccucgccaccacggacuggagcggcuacucgggguccuucguccagcaccccgagcugaccggcaugaacugcauccggcccugcuucuggguggagcugauccgcggccagcccaaggagagcaccaucugggccuccgggagcuccaucagcuucugcggcgucaacuccgagaccgcgaacuggagcuggccggacggggccgaccuccccuucacgaucgacaaguga

SEQ ID NO: 16968 - RNA, 1410 nt, Artificial Sequence
  derived and/or modified CDS sequence (AUadapt) from InfluenzaA__ABB86947__NA
augaacaccaaccagcgcaucaucaccaucggcacggugugccugaucgucgggaucaucucgcuccugucccagaucggcaacaucgugagccuguggaucauccacuccauccagaccgggggcaagaaccacagcgagaugugcaaccagaacgugaucaccuacgucaacaacaccugggugaaccggacguacaucaacaucuccaacaccaacaucgccaccgugaaggacgucaccagcgugauccucgccgggaacuccagccugugccccguguccggcugggcgaucuacagcaaggacaacuccauccgcaucggcagcaagggggacaucuucgucauccgggagccguucaucuccugcagccaccuggagugccgcacguucuuccucacccagggcgcccugcugaacgacaagcacuccaacgggaccgugaaggaccggagccccuaccgcacccucauguccugccccaucggcgaggcccccucgccguacaacucccgguucgagagcguggccuggagcgccuccgcgugccacgacgggaugggcuggcugacgaucggcaucagcgggcccgacaacggcgccgucgccgugcugaaguacaacgggaucaucaccgacaccaucaaguccuggcgcaacaagauccuccggacccaggagagcgagugcgugugcaugaacggcuccugcuucacgguccugaccgacggccccagcaacgggcaggccuccuacaagaucuucaagguggagaagggcaagaucaucaagagcaucgagcuggacgcgcccaacuaccacuacgaggagugcuccugcuacccggacgccgggaaggugaugugcgucugccgcgacaacuggcacgccagcaaccggcccuggguguccuucgaccagaaccucgacuaccagaugggcuacaucugcagcgggguguucggcgacaacccccgcuccaacgacggcaaggggaacugcggccccguccugucgaacggggccaacggcgugaagggguucuccuuccgguacggcaacggcguguggaucgggcgcaccaagagcaucaacucccggagcggcuucgagaugaucugggacccgaacggguggaccggcacggacuccagcuucagcaugaagcaggacaucaucgcccugaccgacugguccggguacagcggcuccuucguccagcaccccgagcucaccggcaugaacugcauccgccccugcuucuggguggagcugauccgggggcagcccaaggagagcaccaucugggcguccggcagcuccaucagcuucugcggggucaacuccgagacggccagcugguccuggccggacggcgccgaccugcccuucaccaucgacaaguga

SEQ ID NO: 16969 - RNA, 1410 nt, Artificial Sequence
  derived and/or modified CDS sequence (AUadapt) from InfluenzaA__ABB86957__NA
augaacaccaaccagcgcaucaucaccgugggcacggucugccugaucguggggaucgugucgcuccugcugcagaucggcaacaucgucucccucuggaucagccacuccauccagaccggggagaagaaccacagcgaggugugcaaccagaacaucaucaccuacgagaacaagaccugggugaaccagacguacgucaacaucuccaacaccaacaucgccgagggccagggggugaccagcaucaucauggccggcaacuccagccugugccccguguccggcugggcgaucuacagcaaggacaacuccauccggaucgggagcaagggcgacaucuucgucauccgcgagccguucaucuccugcucgcaccuggagugccggaccuucuuccucacgcagggggcccugcugaacgaccgccacuccaacggcaccgugaaggaccggagccccuaccgcacccucauguccugccccaucggggaggcccccagcccguacaacucccgguucgagagcguggccuggagcgccuccgcgugccacgacggcaugggcuggcugaccaucgggaucagcggcuccgacaacgaggccgucgccgugcugaaguacaacgggaucaucacggacaccaucaagagcuggcgcaacaagauccuccggacccaggaguccgagugcgugugcaucaacggcucgugcuucaccaucaugacggacggccccuccaacgggcaggccagcuacaagaucuucaagauggagaagggcaagaucaucaaguccgucgagcuggaggcgcccaacuaccacuacgaggagugcagcugcuaccccgacaccgggaagguggugugcgucugccgcgacaacuggcacgccuccaaccggccgugggugagcuucaaccagaaccuggacuaccagaucggcuacaucugcuccgggguguucggcgacaacccccgcagcaacgacggcaaggggaacugcggccccguccccuccaacggggccaacggcgugaagggguucagcuuccgguacggcaacggcguguggaucgggcgcaccaaguccaucuucagccgguccggcuucgagaugaucugggacccgaacggguggaccgagacggacucgagcuucuccaucaagcaggacaucaucgcccucaccgacuggagcggcuacuccgggagcuucguccagcaccccgagcugaccggcaugaacugcauccgccccugcuucuggguggagcugauccggggccagcccaaggaguccaccaucuggacgagcggguccagcaucuccuucugcggcgucgacagcgagaccgccuccuggagcuggccggacggggcggaccuccccuucaccaucgacaaguga

SEQ ID NO: 16970 - RNA, 1410 nt, Artificial Sequence
  derived and/or modified CDS sequence (AUadapt) from InfluenzaA__ABB96333__NA
augaaccccaaccagaagaucaucaccaucggcucggugucccugaccaucgccacgaucugcuuccucaugcagaucgccauccuggucaccaccgugacccugcacuucaagcaguacgacugcgacucgccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccauccgccugucggccggcggggacaucugggugacccgggagcccuacgucuccugcgaccccggcaagugcuaccaguucgcccucgggcagggcaccacccuggacaacaagcacagcaacgacacgauccacgaccgcaccccgcaccggacccugcucaugaacgagcugggcgugcccuuccaccuggggacccgccaggugugcaucgccugguccucguccucgugccacgacggcaaggcguggcuccacgucugcgugacgggguacgacaagaacgccaccgccuccuucaucuacgacggccggcugguggacagcaucggguccuggucgaagaacauccugcgcacccaggaguccgagugcgucugcaucaacgggaccugcacgguggugaugaccgacggcagcgccuccgagcgggcggacaccaagauccucuucaucgaggaggggaagaucguccacaucucgccccugagcggcuccgcccagcacguggaggagugcucgugcuacccccgcuacccgggggugcggugcgucugccgcgacaacuggaagggcuccaaccggcccgugguggacaucaacgucaaggacuacucgaucgccuccagcuacgugugcuccggccuggugggggacacgccccgcaagaacgaccgguacucguccagcuacugccgcaaccccaacaacgagaagggcaaccacggggucaagggcugggccuucgacgacgggaacgacguguggaugggccggaccaucuccgacgagucgcgcuccggcuacgagaccuucaaggucaucgggggcuggucgaccccgaacuccaagcuccagaucaaccgccaggugaucguggacagcgacaaccgguccggguacucgggcaucuucuccgucgagggcaagagcugcaucaaccggugcuucuacguggagcugauccgcggccgcgagcaggagacccgggugugguggacgucgaacuccaucgucguguucugcggcaccagcgggaccuacggcaccggguccuggcccgacggcgccgacaucaaccugaugcccaucuga

SEQ ID NO: 16971 - RNA, 1410 nt, Artificial Sequence
  derived and/or modified CDS sequence (AUadapt) from InfluenzaA__ABB96344__NA
augaaccccaaccagaagaucaucaccaucggcucggugucccugaccaucgccacgaucugcuuccucaugcagaucgccauccuggucaccaccgugacccugcacuucaagcaguacgagugcgacucgccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccauccgccugucggccggcggggacaucugggugacccgggagcccuacgucuccugcgaccccggccgcugcuaccaguucgcccucgggcagggcaccacccuggacaacaagcacagcaacgacacgauccacgaccggaccccgcaccgcacccugcucaugaacgagcugggcgugcccuuccaccuggggacccgccaggugugcaucgccugguccucguccucgugccacgacggcaaggcguggcuccacgucugcgugacgggguacgacaagaacgccaccgccuccuucaucuacgacggccggcugguggacagcaucggguccuggucgaagaacauccugcggacccaggaguccgagugcgucugcaucaacgggaccugcacgguggugaugaccgacggcagcgccuccgagcgcgcggacaccaagguccucuucaucgaggaggggaagaucgugcacaucucgccccugagcggcuccgcccagcacguggaggagugcucgugcuacccccgguacccggggguccgcugcgugugccgggacaacuggaagggcuccaaccgccccguggucgacaucaacgugaaggacuacucgaucgccuccagcuacgugugcuccggccuggucggggacacgccccggaagaacgaccgcuacucguccagcuacugccggaaccccaacaacgagaagggcaaccacggggugaagggcugggccuucgacgacgggaacgacgucuggaugggccgcaccaucuccgacgagucgcgguccggcuacgagaccuucaaggugaucgggggcuggucgaccccgaacuccaagcuccagaucaaccgccaggugaucgucgacagcgacaaccgguccggguacucgggcaucuucuccguggagggcaagagcugcaucaaccgcugcuucuacguggagcugauccgcggccgggagcaggagacccgcgucugguggacgucgaacuccaucgugguguucugcggcaccagcgggaccuacggcaccggguccuggcccgacggcgccgacaucaaccugaugcccaucuga

SEQ ID NO: 16972 - RNA, 1410 nt, Artificial Sequence
  derived and/or modified CDS sequence (AUadapt) from InfluenzaA__ABB96398__NA
augaaccccaaccagaagaucaucaccaucggcucggugucccugaccaucgccacgaucugcuuccucaugcagaucgccauccuggucaccaccgugacccugcacuucaagcaguacgagugcgacucgccggcgaacaaccaggugaugcccugcgagcccaucaucaucgagcgcaacaucacggagaucgucuaccucaccaacaccaccaucgagaaggagacgugccccaagcugguggaguaccggaacugguccaagccgcagugcaagaucaccggguucgcccccuucagcaaggacaacuccauccgccugucggccggcggggacaucugggugacccgggagcccuacgucuccugcgaccccggcaagugcuaccaguucgcccucgggcagggcaccacgcuggacaacaagcacagcaacgacaccauccacgaccgcaccccguaccggacccugcucaugaacgagcugggcgugcccuuccaccuggggacgcgccaggugugcaucgccugguccucguccucgugccacgacggcaaggcguggcuccacgucugcgugaccggguacgacaagaacgccaccgccuccuucaucuacgacggccggcugguggacagcaucggguccuggucgaagaacauccugcgcacccaggaguccgagugcgucugcaucaacggcacgugcaccguggugaugaccgacggcagcgccuccgagcgggcggacaccaagauccucuucaucgaggaggggaagaucguccacaucucgccccugucgggcuccgcccagcacguggaggagugcagcugcuacccccgcuacccgggggugcggugcgucugccgcgacaacuggaagggcuccaaccggcccgugguggacaucaacgucaaggacuacucgaucgccuccagcuacgugugcuccggccuggugggggacacgccccgcaagaacgaccggucguccucguccuacugccgcaaccccaacaacgagaagggcaaccacggggucaagggcugggccuucgacgacgggaacgacguguggaugggccggaccaucagcgaggagucccgcucgggcuacgagaccuucaaggucaucgggggcugguccaccccgaacagcaagcuccagaucaaccgccaggugaucguggacuccgacaaccggucgggguacuccggcaucuucucggucgagggcaagagcugcaucaaccggugcuucuacguggagcugauccgcgggcgcgagcaggagacgcgggugugguggaccuccaacucgaucgucguguucugcggcaccuccgggaccuacggcacggggagcuggcccgacggcgccgacaucaaccugaugcccaucuga

SEQ ID NO: 16973 - RNA, 1410 nt, Artificial Sequence; identical to SEQ ID NO: 16784
  derived and/or modified CDS sequence (AUadapt) from InfluenzaA__ABB96490__NA

SEQ ID NO: 16974 - RNA, 1410 nt, Artificial Sequence
  derived and/or modified CDS sequence (AUadapt) from InfluenzaA__ABB96501__NA
augaaccccaaccagaagaucaucaccaucggcucggugucccugaccaucgccacgaucugcuuccucaugcagaucgccauccuggucaccaccgugacccugcacuucaagcaguacgagugcagcuccccgcccaacaaccaggugaugcccugcgagcccaucaucaucgagcgcaacaucacggagaucgucuaccucaccaacaccaccaucgagaaggagaucugcccgaagcugguggaguaccggaacuggucgaagccccagugcaagaucacgggguucgcgcccuucuccaaggacaacagcauccgccuguccgccggcggggacaucugggugacccgggagcccuacgucucgugcgacccguccaagugcuaccaguucgcccucggccaggggaccacccuggacaacaagcacagcaacgacacgauccacgaccgcacgccccaccggacccugcucaugaacgagcugggcgugcccuuccaccugggcacccgccaggugugcaucgccugguccucguccagcugccacgacgggaaggccuggcuccacgucugcgugaccggcuacgacaagaacgcgaccgccuccuucaucuacgacgggcggcugguggacucgaucggcuccuggagcaagaacauccugcgcacccaggaguccgagugcgucugcaucaacgggaccugcacgguggugaugaccgacggcucggccagcgagcgggccgacaccaagauccucuucaucgaggagggcaagaucguccacaucucgccccuguccggguccgcgcagcacguggaggagugcagcugcuacccgcgcuaccccggcgugcggugcgucugccgcgacaacuggaagggguccaaccggcccgugguggacaucaacgucaaggacuacucgaucguguccagcuacgugugcuccggccuggucggcgacacgccccgcaagaacgaccggucguccagcuccuacugccgcaacccgaacaacgagaaggggaaccacggcgugaaggggugggccuucgacgacggcaacgacgucuggauggggcggaccaucucggaggagucccgcagcggcuacgagaccuucaaggugaucggcgggugguccacccccaacucgaagucccagaucaaccgccaggugaucgucgacagcggcaaccggucgggguacuccggcaucuucagcguggaggggaaguccugcaucaaccggugcuucuacguggagcucauccgcggccgcgagcaggagacccgggucugguggacgucgaacuccaucgugguguucugcggcaccagcgggaccuacggcaccggguccuggcccgacggcgccgacaucaaccugaugcccaucuga

SEQ ID NO: 16975 - RNA, 1410 nt, Artificial Sequence
  derived and/or modified CDS sequence (AUadapt) from InfluenzaA__ABB96534__NA
augaaccccaaccagaagaucaucaccaucggcucggugucccugaccaucgccacgaucugcuuccucaugcagaucgccauccuggucaccaccgugacccugcacuucaagcaguacgagugcucguccccgcccaacaaccaggugaugcucugcgagcccacgaucaucgagcgcaacaucaccgagaucgucuaccugaccaacaccacgaucgagaaggagaucugccccaagcuggcggaguaccggaacuggagcaagccgcagugcaagaucaccggguucgcccccuucuccaaggacaacucgauccgccucuccgccggcggggacaucugggugacccgggagcccuacgugagcugcgaccccgacaagugcuaccaguucgcccugggccaggggaccacgcugaacaaccgccacuccaacgacaccguccacgaccggaccccguaccgcacccuccugaugaacgagcugggcgugcccuuccaccucggcacgaagcaggucugcaucgccuggucguccagcuccugccacgacgggaaggcguggcugcacgugugcgugaccggccacgacgagaacgccaccgccucguucaucuacgacgggcggcugguggacuccaucggcagcugguccaagaagauccuccgcacccaggagucggagugcgucugcaucaacgggacgugcaccguggugaugaccgacggcuccgccagcggccgggcggacaccaagauccuguucaucgaggaggggaagaucguccacaucucgccccuguccggcagcgcccagcacguggaggagugcuccugcuacccccgcuacccgggggugcggugcgucugccgcgacaacuggaagggcucgaaccggcccaucguggacaucaacgugaaggacuacuccaucgucagcuccuacgugugcucgggccucgugggggacacgccccgcaagaacgacuccagcuccucgucccacugccugaaccccaacaacgaggagggcgggcacggcgucaaggggugggccuucgacgacggcaacgacguguggaugggccggaccaucagcgagaaguuccgcuccggguacgagaccuucaaggucaucgagggcuggucgaagccgaacuccaagcugcagaucaaccgccaggugaucguggaccgggggaaccggagcggcuacuccgggaucuucucggucgagggcaagagcugcaucaaccgcugcuucuacguggagcucauccggggccgcaagcaggagaccgaggugugguggacguccaacucgaucgucguguucugcgggaccuccggcaccuacgggaccggcagcuggcccgacggggccgacaucaaccugaugcccaucuga

SEQ ID NO: 16976 - RNA, 1410 nt, Artificial Sequence
  derived and/or modified CDS sequence (AUadapt) from InfluenzaA__ABC02237__NA
augaaccccaaccagaagaucaucaccaucggcucggugucccugaccaucgccacgaucugcuuccucaugcagaucgccauccuggucaccaccgugacccugcacuucaagcaguacgagugcucguccccgcccaacaaccaggugaugcucugcgagcccacgaucaucgagcgcaacaucaccgagaucgucuaccugaccaacaccacgaucgagaaggagaucugccccaagcuggcggaguaccggaacuggagcaagccgcagugcaagaucaccggguucgcccccuucuccaaggacaacucgauccgccucuccgccggcggggacaucugggugacccgggagcccuacgugagcugcgaccccgacaagugcuaccaguucgcccugggccaggggaccacgcugaacaaccgccacuccaacgacaccguccacgaccggaccccguaccgcacccuccugaugaacgagcugggcgugcccuuccaccucggcacgaagcaggucugcaucgccuggucguccagcuccugccacgacgggaaggcguggcugcacgugugcgugaccggccacgacgagaacgccaccgccucguucaucuacgacgggcggcugguggacuccaucggcucgugguccaagaagauccuccgcacccaggagagcgagugcgucugcaucaacgggacgugcaccguggugaugaccgacggcuccgccucgggccgggcggacaccaagauccuguucaucgaggaggggaagaucguccacaucagccagcuguccggcucggcccagcacguggaggagugcuccugcuacccccgcuaccccggggugcggugcgucugccgcgacaacuggaagggcagcaaccggccgaucguggacaucaacaucaaggacuacuccaucgugucguccuacgucugcagcggccucgugggggacacgccccgcaagaacgacuccucguccucgucccacugccugaaccccaacaacgaggagggcgggcacggcgugaaggggugggccuucgacgacggcaacgacgucuggaugggccggaccaucagcgagaaguuccgcuccggguacgagaccuucaaggugaucgagggcuggucgaagcccaacuccaagcugcagaucaaccggcaggucaucguggaccgcgggaaccggagcggcuacuccgggaucuucucgguggagggcaagagcugcaucaaccgcugcuucuacgucgagcucauccggggccgcaagcaggagaccgaggugugguggacguccaacucgaucguggccuucugcgggaccuccggcaccuacgggaccggcagcuggccggacggggccgacaucaaccugaugcccaucuga

SEQ ID NO: 16977 - RNA, 1410 nt, Artificial Sequence
  derived and/or modified CDS sequence (AUadapt) from InfluenzaA__ABC02258__NA
augaaccccaaccagaagaucaucaccaucggcucggugucccugaccaucgccacgaucugcuuccucaugcagaucgccauccuggucaccaccgugacccugcacuucaagcaguacgagugcgacucgccggcgaacaaccagaucaugcccugcgagcccacgaucaucgagcgcaacaucaccgagaucguguaccucaccaacaucaccaucgagaaggagaucugccccaagcuggucgaguaccggaacugguccaagccgcagugcaagaucacgggguucgcccccuucagcaaggacaacuccauccgccugucggccggcggggacaucugggugacccgggagcccuacguguccugcgaccccagcaagugcuaccaguucgcccucggccaggggaccacccuggacaacaagcacuccaacgacacgauccacgaccgcaccccgcaccggacccugcucaugaacgagcugggcguccccuuccaccugggcacccgccaggugugcaucgccuggucguccucguccugccacgacgggaaggcguggcuccacgugugcgucacgggcuacgacaagaacgccaccgccagcuucaucuacgacgggcggcugguggacuccaucggcucguggucccagaacauccugcgcacccaggagagcgagugcgugugcaucaacgggaccugcacggucgugaugaccgacggcuccgccucgggccgggcggacaccaagauccucuucaucgaggaggggaagaucgugcacaucucgccccuguccggcagcgcccagcacgucgaggagugcuccugcuacccccgcuacccgggggugcggugcaucugccgcgacaacuggaagggcucgaaccggcccguggucgacaucaacgugaaggacuacuccaucgacagcuccuacgugugcucgggccuggucggggacacgccccgcaagaacgaccgguccucgaacuccuacugccgcaaccccaacaacgagaagggcaaccacggggugaagggcugggccuucgacgacgggaacgacguguggaugggccggaccaucagcgaggacucccgcucgggcuacgagaccuucaaggucaucgggggcugguccaccccgaacagcaagcuccagaucaaccgccaggugaucgucgacuccgacaaccggucgggguacuccggcaucuucucgguggagggcaagagcugcaucaaccggugcuucuacguggagcugauccgcgggcgcgagcaggagacccgggucugguggacguccaacucgaucgugguguucugcggcaccuccgggaccuacggcgccgggagcuggcccgacggcgccgacaucaaccugaugcccaucuga

SEQ ID NO: 16978 - RNA, 1410 nt, Artificial Sequence
  derived and/or modified CDS sequence (AUadapt) from InfluenzaA__ABC02269__NA
augaaccccaaccagaagaucaucaccaucggcucggugucccugaccaucgccacgaucugcuuccucaugcagaucgccauccuggucaccaccgugacccugcacuucaagcaguacgagugcgacucgccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccauccgccugucggccggcggggacaucugggugacccgggagcccuacgucuccugcgaccccggcaagugcuaccaguucgcccucgggcagggcaccacccuggacaacaagcacucgaacgacacgauccacgaccgcaccccgcaccggacccugcucaugaacgagcugggcgugcccuuccaccuggggacccgccaggugugcaucgccugguccagcuccucgugccacgacggcaaggcguggcuccacgucugcgugacgggguacgacaagaacgccaccgccuccuucaucuacgacggccggcugguggacucgaucggguccuggagccagaacauccugcgcacccaggaguccgagugcgucugcaucaacgggaccugcacgguggugaugaccgacggcucggccuccggccgggcggacaccaagauccucuucaucgaggagggcaagaucguccacaccucgccccugagcggguccgcccagcacguggaggagugcucgugcuacccccgcuacccgggcgugcggugcaucugccgcgacaacuggaagggcuccaaccggcccgucguggacaucaacgugaaggacuacagcaucgacuccucguacgucugcuccgggcuggugggcgacacgccccgcaacaacgaccggucguccagcuccuacugccgcaaccccaacaacgagaaggggacccacggcgugaaggggugggccuucgacgacggcaacgacgucuggaugggccggaccaucucggaggacucccgcucgggguacgagaccuucaaggugaucggcgggugguccacgccgaacagcaagcuccagaucaaccggcaggucaucguggacuccgacaaccgcucgggcuacuccgggaucuucucgguggagggcaagagcugcaucaaccggugcuucuacgucgagcugauccgcggccgcgagcaggagacccgggugugguggaccuccaacucgaucguggucuucugcgggaccuccggcacguacgggaccggcagcuggcccgacggggccgacaucaaccugaugcccaucuga

SEQ ID NO: 16979 - RNA, 1413 nt, Artificial Sequence
  derived and/or modified CDS sequence (AUadapt) from InfluenzaA__ABC02280__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcgugugcaaccagcgcaucaucaccuacgagaacuccaccugggucaaccacaccuacgugaacaucaacaacacgaacgugaucgcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccaggggucccugcucaacgacaagcacucgaacggcaccgucaaggaccgcucccccuaccgggcccugaugagcugcccccugggggaggcccccagcccguacaacuccaaguucgagucgguggcgugguccgccagcgccugccacgacggcaugggcuggcucaccaucgggaucuccggccccgacaacggggccguggcgguccugaaguacaacggcaucaucacggagaccaucaagucguggaagaagcagauccugcgcacccaggaguccgagugcgugugcgugaacggcagcugcuucaccaucaugacggacgggcccuccaacggcgccgccagcuacaagaucuucaagaucgagaaggggaaggucaccaaguccaucgagcucaacgcccccaacuuccacuacgaggagugcucgugcuacccggacaccggcaccgugaugugcgugugccgggacaacuggcacggguccaaccgccccugggucagcuucaaccagaaccuggacuaccagaucggcuacaucugcuccggcguguucggggacaacccccggcccaaggacggcgaggggucgugcaacccggugacggucgacggcgccaacggggugaagggcuucuccuacaaguacggcaacgggguguggaucggccgcaccaagagcaaccggcugcgcaagggguucgagaugaucugggaccccaacggcuggaccgacaccgacuccgacuucagcgucaagcaggacgugguggcgaucacggacuggucgggguacuccggcagcuucguccagcaccccgagcucaccggccuggacugcauccggcccugcuucuggguggagcugguccgcgggcucccgaaggagaacaccaccaucuggacguccggcucguccaucagcuucugcggggugaacuccgacaccgccaacuggagcuggcccgacggcgccgagcugcccuucaccaucgacaaguga

SEQ ID NO: 16980 - RNA, 1410 nt, Artificial Sequence; identical to SEQ ID NO: 16975
  derived and/or modified CDS sequence (AUadapt) from InfluenzaA__ABC02302__NA

SEQ ID NO: 16981 - RNA, 1410 nt, Artificial Sequence; identical to SEQ ID NO: 16972
  derived and/or modified CDS sequence (AUadapt) from InfluenzaA__ABC02313__NA

SEQ ID NO: 16982 - RNA, 1410 nt, Artificial Sequence; identical to SEQ ID NO: 16977
  derived and/or modified CDS sequence (AUadapt) from InfluenzaA__ABC02324__NA

SEQ ID NO: 16983 - RNA, 1410 nt, Artificial Sequence
  derived and/or modified CDS sequence (AUadapt) from InfluenzaA__ABC02335__NA
augaaccccaaccagaagaucaucaccaucggcucggugucccugaccaucgccacgaucugcuuccucaugcagaucgccauccuggucaccaccgugacccugcacuucaagcaguacgagugcgacucgccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccauccgccugucggccggcggggacaucugggugacccgggagcccuacgucuccugcgaccccggcaagugcuaccaguucgcccucgggcagggcaccacccuggacaacaagcacucgaacgacacgauccacgaccgcaccccgcaccggacccugcucaugaacgagcugggcgugcccuuccaccuggggacccgccaggugugcaucgccugguccagcuccucgugccacgacggcaaggcguggcuccacgucugcgugacgggguacgacaagaacgccaccgccuccuucaucuacgacggccggcugguggacagcaucggguccuggucgcagaacauccugcgcacccaggaguccgagugcgucugcaucaacgggaccugcacgguggugaugaccgacggcucggccuccggccgggcggacaccaagauccucuucaucaaggagggcaagaucguccacaucagcccccugucgggguccgcccagcacguggaggagugcucgugcuacccccgcuacccgggcgugcggugcaucugccgcgacaacuggaagggcuccaaccggcccgucguggacaucaacgugaaggacuacagcaucgacuccucguacgucugcuccgggcuggugggcgacacgccccgcaacaacgaccggagcuccaacucguacugccgcaaccccaacaacgagaaggggaaccacggcgugaaggggugggccuucgacgacggcaacgacgucuggaugggccggaccaucuccgaggacucgcgcuccggguacgagaccuucaaggugaucggcggguggagcaccccgaacuccaagcuccagaucaaccggcaggucaucguggacucggacaaccgcuccggcuacucggggaucuucuccguggagggcaagagcugcaucaaccggugcuucuacgucgagcugauccgcggccgcgagcaggagacccgggugugguggacgucgaacuccaucguggucuucugcgggaccagcggcaccuacgggaccggcuccuggcccgacggggccgacaucaaccugaugcccaucuga

SEQ ID NO: 16984 - RNA, 1410 nt, Artificial Sequence
  derived and/or modified CDS sequence (AUadapt) from InfluenzaA__ABC39808__NA
augaaccccaaccagaagaucaucaccaucggcucggugucccugaccaucgccacgaucugcuuccucaugcagaucgccauccuggucaccaccgugacccugcacuucaagcaguacgagugcagcuccccgcccaacaaccaggugaugcccugcgagcccaucaucaucgagcgcaacaucacggagaucgucuaccucaccaacaccaccaucgagaaggagaucugcccgaagcugguggaguaccggaacuggucgaagccccagugcaagaucacgggguucgcgcccuucuccaaggacaacagcauccgccuguccgccggcggggacaucugggugacccgggagcccuacgucucgugcgacccguccaagugcuaccaguucgcccucggccaggggaccacccuggacaacaagcacagcaacgacacgauccacgaccgcacgccccaccggacccugcucaugaacgagcugggcgugcccuuccaccugggcacccgccaggugugcaucgccugguccucguccagcugccacgacgggaaggccuggcuccacgucugcgugaccggcuacgacaagaacgcgaccgccuccuucaucuacgacgggcggcugguggacucgaucggcuccuggagcaagaacauccugcgcacccaggaguccgagugcgucugcaucaacgggaccugcacgguggugaugaccgacggcucggccagcgagcgggccgacaccaagauccucuucaucgaggagggcaagaucguccacaucucgccccuguccggguccgcgcagcacguggaggagugcagcugcuacccgcgcuaccccggcgugcggugcgucugccgcgacaacuggaagggguccaaccggcccgugguggacaucaacgucaaggacuacucgaucguguccagcuacgugugcuccggccuggucggcgacacgccccgcaagaacgaccggucguccagcuccuacugccgcaacccgaacaacgagaagggggaccacggcgugaaggggugggccuucgacgacggcaacgacgucuggauggggcggaccaucucggaggagucccgcagcggcuacgagaccuucaaggugaucggcgggugguccacccccaacucgaagucccagaucaaccgccaggugaucgucgacagcggcaaccggucgggguacuccggcaucuucagcguggaggggaaguccugcaucaaccggugcuucuacguggagcucauccgcggccgcaagcaggagacccgggucugguggacgucgaacuccaucgugguguucugcggcaccagcgggaccuacggcaccggguccuggcccgacggcgccgacaucaaccugaugcccaucuga

SEQ ID NO: 16985 - RNA, 1410 nt, Artificial Sequence; identical to SEQ ID NO: 16784
  derived and/or modified CDS sequence (AUadapt) from InfluenzaA__ABC40525__NA

SEQ ID NO: 16986 - RNA, 1413 nt, Artificial Sequence
  derived and/or modified CDS sequence (AUadapt) from InfluenzaA__ABC40536__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcgugugcaaccagcgcaucaucaccuacgagaacuccaccugggucaaccacaccuacgugaacaucaacaacacgaacgugaucgcggggaaggacaagaccagcgucacccuggccggcaacuccucgcugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcgguggccguccugaaguacaacggcaucaucacggagaccaucaaguccuggaagaagcagauccugcgcacccaggagagcgagugcgugugcgugaacggcuccugcuucaccaucaugacggacgggcccucgaacggcgccgccuccuacaagaucuucaagaucgagaaggggaaggucaucaagagcaucgagcucaacgcccccaacuuccacuacgaggagugcuccugcuacccggacaccggcaccgugaugugcgugugccgggacaacuggcacgggagcaaccgccccugggucuccuucaaccagaaccuggacuaccagaucggcuacaucugcucgggcguguucggggacaacccccggcccaaggacggcgagggguccugcaacccggugaccgucgacggcgcgaacggggugaagggcuucagcuacaaguacggcaacgggguguggaucggccgcacgaaguccaaccggcugcgcaagggguucgagaugaucugggaccccaacggcuggaccgacaccgacucggacuucuccgucaagcaggacgugguggccaucaccgacuggagcggguacagcggcuccuucguccagcaccccgagcucacgggccuggacugcauccggcccugcuucuggguggagcugguccgcgggcucccgaaggagaacaccaccaucuggaccucgggcuccagcaucuccuucugcggggugaacagcgacacggccaacugguccuggcccgacggcgccgagcugcccuucaccaucgacaaguga

SEQ ID NO: 16987 - RNA, 1410 nt, Artificial Sequence; identical to SEQ ID NO: 16978
  derived and/or modified CDS sequence (AUadapt) from InfluenzaA__ABC40547__NA

SEQ ID NO: 16988 - RNA, 1410 nt, Artificial Sequence
  derived and/or modified CDS sequence (AUadapt) from InfluenzaA__ABC40558__NA
augaaccccaaccagaagaucaucaccaucggcucggugucccugaccaucgccacgaucugcuuccucaugcagaucgccauccuggucaccaccgugacccugcacuucaagcaguacgagugcagcuccccgcccaacaaccaggugaugcccugcgagcccaucaucaucgagcgcaacaucacggagaucgucuaccucaccaacaccaccaucgagaaggagaucugcccgaagcugguggaguaccggaacuggucgaagccccagugcaagaucacgggguucgcgcccuucuccaaggacaacagcauccgccuguccgccggcggggacaucugggugacccgggagcccuacgucucgugcgacccgggcaagugcuaccaguucgcccucgggcagggcaccacccuggacaacaagcacuccaacgacacgauccacgaccgcacccccuaccggacccugcucaugaacgagcugggcgugcccuuccaccuggggacccgccaggugugcaucgccuggagcuccucguccugccacgacggcaaggccuggcuccacgucugcgugacggggcacgacaagaacgcgaccgccagcuucaucuacgacggccggcugguggacuccaucgggucgugguccaagagcauccugcgcacccaggaguccgagugcgucugcaucaacgggaccugcacgguggugaugaccgacggcucggccagcgagcgggccgacaccaagauccucuucaucgaggagggcaagaucguccacaucucgccccuguccggcuccgcgcagcacguggaggagugcagcugcuacccgcgcuaccccggggugcggugcgucugccgcgacaacuggaagggcuccaaccggcccgugguggacaucaacgucaaggacuacucgaucguguccagcuacgugugcuccggccuggucggggacacgccccgcaagaacgaccggucguccagcuccuacugccagaacccgaacaacgagaagggcaaccacggggugaagggcugggccuucgacgacgggaacgacgucuggaugggccgcaccaucucggaggagucccggagcggcuacgagaccuucaaggugaucgggggcugguccacccccaacucgaagcuccagaucaaccgccaggugaucgucgacaucgacaaccgguccggguacagcggcaucuucucgguggaggggaaguccugcaucaaccgcugcuucuacguggagcugauccggggccgcgagcaggagacccgcgucugguggacgagcaacuccaucgugguguucugcggcaccagcgggaccuacggcaccggguccuggcccgacggcgccgacaucaaccugaugcccaucuga

SEQ ID NO: 16989 - RNA, 1410 nt, Artificial Sequence
  derived and/or modified CDS sequence (AUadapt) from InfluenzaA__ABC40611__NA
augaaccccaaccagaagaucaucaccaucggcucgaucucccugaccaucgccacgaucugcuuccucaugcagaucgccauccuggugaccaccgucacccugcacuucaagcaguacgagugcaacagccucccgaacaaccaggugaugcugugcgagcccacgaucaucgagcgcaacaucaccgagaucguguaccugaccaacaccacgaucgagaaggagaucugccccaagcucgcggaguaccggaacugguccaagccccagugcaagaucaccggguucgccccguucucgaaggacaacuccauccgccugagcgccggcggggacaucugggucacccgggagcccuacguguccugcgaccccgacaagugcuaccaguucgcccugggccaggggaccacgcucaacaaccgccacucgaacgacaccgugcacgaccggacccccuaccgcacccugcugaugaacgagcucggcgucccguuccaccugggcacgaagcaggucugcaucgccugguccagcuccucgugccacgacgggaaggcguggcugcacgugugcgugaccggccacgacgagaacgccaccgccuccuucaucuacgacgggcggcucguggacagcaucggcuccuggucgaagaagauccugcgcacccaggaguccgagugcgugugcaucaacgggacgugcaccgucgugaugaccgacggcagcgccuccggccgggcggacaccaagauccuguucaucgaggaggggaagaucauccacaucucgcagcucagcggcuccgcccagcacguggaggagugcucgugcuacccccgcuaccccgggguccggugcgugugccgcgacaacuggaagggcuccaaccggcccaucguggacaucaacgucaaggacuacagcaucguguccucguacgugugcuccggccuggucggggacacgccgcgcaagaacgacagcuccucguccagccacugccugaaccccaacaacgaggagggcgggcacggcgugaaggggugggccuucgacgacggcaacgacguguggaugggccggaccaucuccgagaaguuccgcucgggguacgagaccuucaaggucaucgagggcugguccaagcccaacagcaagcuccagaucaaccgccaggugaucgucgaccgggacaaccgguccggguacucgggcaucuucuccguggagggcaagagcugcaucaaccgcugcuucuacguggagcugauccgggggcgcaagcaggagaccgaggucugguggacgucgaacuccaucgugguguucugcggcaccagcgggaccuacggcaccggguccuggcccgacggcgccgacaucaaccugaugccgaucuga

SEQ ID NO: 16990 - RNA, 1410 nt, Artificial Sequence
  derived and/or modified CDS sequence (AUadapt) from InfluenzaA__ABC40622__NA
augaaccccaaccagaagaucaucaccaucggcucggugucccugaccaucgccacgaucugcuuccucaugcagaucgccauccuggucaccaccgugacccugcacuucaagcaguacgagugcgacucgccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccauccgccugucggccggcggggacaucugggugacccgggagcccuacgucuccugcgaccccggcaagugcuaccaguucgcccucgggcagggcaccacccuggacaacaagcacucgaacgacacgauccacgaccgcaccccgcaccggacccugcucaugaacgagcugggcgugcccuuccaccuggggacccgccaggugugcaucgccugguccagcuccucgugccacgacggcaaggcguggcuccacgucugcgugacgggguacgacaagaacgccaccgccuccuucaucuacgacggccggcugguggacucgaucggguccuggagccagaacauccugcgcacccaggaguccgagugcgucugcaucaacgggaccugcacgguggugaugaccgacggcaacgccucgggccgggcggacaccaagauccucuucaucgaggagggcaagaucguccacaucucgccccuguccgggagcgcccagcacguggaggagugcuccugcuacccccgcuacccgggcgugcggugcaucugccgcgacaacuggaagggcucgaaccggcccgucguggacaucaacgugaaggacuacuccaucgacucguccuacgucugcagcgggcuggugggcgacacgccccgcaacaacgaccgguccucgaacuccuacugccgcaaccccaacaacgagaaggggaaccacggcgugaaggggugggccuucgacgacggcaacgacgucuggaugggccggaccaucucggaggacucccgcagcggguacgagaccuucaaggugaucggcgggugguccaccccgaacucgaagcuccagaucaaccggcaggucaucguggacuccgacaaccgcucgggcuacuccgggaucuucagcguggagggcaaguccugcaucaaccggugcuucuacgucgagcugauccgcggccgcgagcaggagacccgggugugguggacgucgaacucgaucguggucuucugcgggaccuccggcaccuacgggaccggcagcuggcccgacggggccgacaucaaccugaugcccaucuga

SEQ ID NO: 16991 - RNA, 1410 nt, Artificial Sequence
  derived and/or modified CDS sequence (AUadapt) from InfluenzaA__ABC40634__NA
augaaccccaaccagaagaucaucaccaucggcucggugucccugaccaucgccacgaucugcuuccucacccagaucgccauccuggucaccaccgugacgcugcacuucaagcaguacgagugcaacucgccgcccaacaaccaggugaugcucugcgagcccaccaucaucgagcgcaacaucaccgagaucgucuaccugaccaacacgaccaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggacgacccugaacaacggccacucgaacgacaccguccacgaccgcaccccguaccggacgcuccugaugaacgagcugggcgugcccuuccaccucgggaccaagcaggucugcaucgccugguccagcuccucgugccacgacggcaaggcguggcugcacgugugcgugaccggggacgacaagaacgccaccgccuccuucaucuacaacggccgccugguggacagcaucggguccuggucgaagaagauccuccggacgcaggaguccgagugcgucugcaucgacgggaccugcaccguggugaugaccgacggcucggccuccgggaaggcggacacgaagauccuguucaucgaggagggcaagaucguccacaccagccugcucucgggguccgcccagcacguggaggagugcucgugcuacccccgcuaccccggcgugcggugcgucugccgcgacaacuggaagggcuccaaccggccgaucguggacaucaacgugaaggacuacagcaucgucuccucguacgugugcuccgggcuggugggcgacacgccccgcaagaacgacagcuccucguccucgcacugccuggaccccaacaacgaggagggcggccacggggucaagggcugggccuucgacgacggcaacgacguguggauggggcggaccaucuccgagaagcuccgcagcggcuacgagaccuucaaggucaucgaggggugguccaagcccaacucgaagcugcagaucaaccgccaggugaucguggaccggggcaaccgguccggguacucgggcaucuucuccgucgagggcaagagcugcaucaaccgcugcuucuacguggagcugauccgggggcgcaaccaggagaccgaggugcucuggaccucgaacuccaucgucguguucugcggcaccagcgggacguacggcaccggguccuggccggacggcgccgacaucaaccugaugcccaucuga

SEQ ID NO: 16992 - RNA, 1410 nt, Artificial Sequence
  derived and/or modified CDS sequence (AUadapt) from InfluenzaA__ABC40645__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacgagaacgcgaccgccagcuucaucuacaacgggcgccugguggacuccgucgugagcugguccaagaagauccugcggacccaggagucggagugcgugugcaucaacggcacgugcaccgucgugaugaccgacggguccgccagcggcaaggccgacaccaagauccucuucaucgaggagggcaagaucgugcacacgucgacccuguccgggagcgcgcagcacgucgaggagugcuccugcuacccccgcuaccccggcgugcggugcgugugccgcgacaacuggaaggggucgaaccggccgaucgucgacaucaacaucaaggacuacuccaucgugagcuccuacgugugcucgggccuggucggcgacacgccccgcaagaacgacuccagcuccagcucccacugccucgaccccaacaacgaggagggcgggcacggggugaagggcugggccuucgacgacgggaacgacgucuggaugggccggaccaucucggagaagcugcgcuccggcuacgagaccuucaaggugaucgagggguggagcaaccccaacuccaagcugcagaucaaccgccaggugaucgucgaccggggcaaccggucgggguacuccggcaucuucagcguggagggcaagucgugcaucaaccgcugcuucuacguggagcucauccgggggcgcaagcaggagaccgagguccuguggaccuccaacagcaucgugguguucugcggcaccuccgggacguacggcaccgggagcuggccggacggcgccgacaucaaccugaugcccaucuga

SEQ ID NO: 16993 - RNA, 1410 nt, Artificial Sequence
  derived and/or modified CDS sequence (AUadapt) from InfluenzaA__ABC41706__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucgagcgcaacaucaccgagaucgucuaccugaccaacaccacgaucgagaaggagaucugccccaagcugguggaguaccggaacugguccaagccgcagugcaacaucaccggguucgcgcccuucagcaaggacaacuccauccgccucucggccggcggggacaucugggugacccgggagcccuacgucuccugcgaccccgacaagugcuaccaguucgcccugggccaggggaccacgcugaacaacggccacagcaacgacaccgugcacgaccgcaccccguaccggacccuccugaugaacgagcugggcgugcccuuccaccucgggacgcgccaggucugcaucgccugguccucguccagcugccacgacggcaaggccuggcugcacgugugcgugaccggggacgacaagaacgcgaccgccuccuucaucuacaacggccggcuggucgacucgaucggguccuggagcaagaagauccuccgcacccaggaguccgagugcgugugcaucaacggcacgugcaccguggucaugaccgacggcucggccuccgggaaggccgacaccaagauccuguucaucgaggagggcaagaucgugcacaucagcacgcugucgggguccgcgcagcacguggaggagugcucgugcuacccccgguaccccggcguccgcugcgugugccgggacaacuggaagggcuccaaccgcccgaucguggacaucaacgucaaggacuacagcaucguguccucguacgugugcuccgggcucgucggcgacacgccccggaagaacgacagcuucuccucgucccacugccuggaccccaacaacgaggagggcgggcacggggugaagggcugggccuucgacgacggcaacgacgucuggauggggcgcaccaucagcgagaagcugcgguccggcuacgagaccuucaaggugaucgagggguggucgaagcccaacuccaagcuccagaucaaccgccaggugaucgucgagcggggcaaccgcagcggguacuccggcaucuucucgguggagggcaaguccugcaucaaccggugcuucuacguggagcugauccgcgggcggaaggaggagaccgaggucugguggaccagcaacucgaucgugguguucugcggcaccuccgggaccuacggcacggggagcuggccggacggcgccgacaucaaccugaugcccaucuga

SEQ ID NO: 16994 - RNA, 1413 nt, Artificial Sequence
  derived and/or modified CDS sequence (AUadapt) from InfluenzaA__ABC41717__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagucggagugcgugugcgugaacggcuccugcuucaccaucaugacggacgggcccagcaacggcgccgccuccuacaagaucuucaagaucgagaaggggaaggucaccaagucgaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcucgggcguguucggggacaacccccgccccaaggacggcaagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccgacaccgacagcgacuucuccgucaagcaggacgugguggccgucacggacuggucgggguacagcggcuccuucgugcagcaccccgagcucaccggccuggacugcauccgccccugcuucugggucgagcuggugcgggggcucccgcgcgagaacaccaccaucuggacgucgggcuccagcaucuccuucugcgggguggacagcgacaccgccaacugguccuggcccgacggcgccgagcugcccuucaccaucgacaaguga

SEQ ID NO: 16995 - RNA, 1410 nt, Artificial Sequence
  derived and/or modified CDS sequence (AUadapt) from InfluenzaA__ABC41728__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucgagcgcaacaucaccgagaucgucuaccugaccaacaccacgaucgagaaggagaucugccccaagcugguggaguaccggaacugguccaagccgcagugcaacaucaccggguucgcgcccuucagcaaggacaacuccauccgccucucggccggcggggacaucugggugacccgggagcccuacgucuccugcgaccccgacaagugcuaccaguucgcccugggccaggggaccacgcugaacaacggccacagcaacgacaccgugcacgaccgcaccccguaccggacccuccugaugaacgagcugggcgugcccuuccaccucgggacgcgccaggucugcaucgccugguccucguccagcugccacgacggcaaggccuggcugcacgugugcgugaccggggacgacaagaacgcgaccgccuccuucaucuacaacggccggcuggucgacucgaucggguccuggagcaagaacauccuccgcacccaggaguccgagugcgugugcaucaacggcacgugcaccguggucaugaccgacggcucggccuccgggaaggccgacaccaagauccuguucaucgaggagggcaagaucgugcacaucagcacgcugucgggguccgcgcagcacguggaggagugcucgugcuacccccgguaccccggcguccgcugcgugugccgggacaacuggaagggcuccaaccgcccgaucguggacaucaacgucaaggacuacagcaucguguccucguacgugugcuccgggcucgucggcgacacgccccggaagaacgacagcuucuccucgucccacugccuggaccccaacaacgaggagggcgggcacggggugaagggcugggccuucgacgacggcaacgacgucuggauggggcgcaccaucagcgagaagcugcgguccggcuacgagaccuucaaggugaucgagggguggucgaagcccaacuccaagcuccagaucaaccgccaggugaucgucgagcggggcaaccgcagcggguacuccggcaucuucucgguggagggcaaguccugcaucaaccggugcuucuacguggagcugauccgcgggcggaaggaggagaccgaggucugguggaccagcaacucgaucgugguguucugcggcaccuccgggaccuacggcacggggagcuggccggacggcgccgacaucaaccugaugcccaucuga

SEQ ID NO: 16996 - RNA, 1410 nt, Artificial Sequence; identical to SEQ ID NO: 16993
  derived and/or modified CDS sequence (AUadapt) from InfluenzaA__ABC41742__NA

SEQ ID NO: 16997 - RNA, 1410 nt, Artificial Sequence; identical to SEQ ID NO: 16993
  derived and/or modified CDS sequence (AUadapt) from InfluenzaA__ABC41956__NA

SEQ ID NO: 16998 - RNA, 1410 nt, Artificial Sequence; identical to SEQ ID NO: 16993
  derived and/or modified CDS sequence (AUadapt) from InfluenzaA__ABC41967__NA

SEQ ID NO: 16999 - RNA, 1410 nt, Artificial Sequence; identical to SEQ ID NO: 16993
  derived and/or modified CDS sequence (AUadapt) from InfluenzaA__ABC42017__NA

SEQ ID NO: 17000 - RNA, 1410 nt, Artificial Sequence; identical to SEQ ID NO: 16993
  derived and/or modified CDS sequence (AUadapt) from InfluenzaA__ABC42117__NA

SEQ ID NO: 17001 - RNA, 1410 nt, Artificial Sequence; identical to SEQ ID NO: 16993
  derived and/or modified CDS sequence (AUadapt) from InfluenzaA__ABC42128__NA

SEQ ID NO: 17002 - RNA, 1410 nt, Artificial Sequence; identical to SEQ ID NO: 16993
  derived and/or modified CDS sequence (AUadapt) from InfluenzaA__ABC42139__NA

SEQ ID NO: 17003 - RNA, 1410 nt, Artificial Sequence
  derived and/or modified CDS sequence (AUadapt) from InfluenzaA__ABC42150__NA
augaaccccaaccagaagaucaucaccaucggcucggugucccugaccaucgccacgaucugcuuccucaugcagaucgccauccuggcgaccaccgucacccugcacuucaagcagcacgagugcaacucgccgcccaacaaccaggugaugcucugcgagcccacgaucaucgagcgcaacaucaccgagaucguguaccugaccaacaccacgaucgagaaggagaucugccccaagcuggucgaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccucgugccacgacggcaaggcguggcugcacgucugcgugaccggggacgacaagaacgccaccgccuccuucaucuacaacggccggcugguggacagcaucggguccuggucgaagaagauccuccgcacccaggaguccgagugcgucugcaucaacggcacgugcaccguggugaugaccgacggcagcgccuccgggaaggcggacaccaagauccuguucaucgaggagggcaagaucguccacaucucgacgcugagcggguccgcccagcacguggaggagugcucgugcuacccccgguaccccggcgugcgcugcgucugccgggacaacuggaagggcuccaaccgcccgaucguggacaucaacgugaaggacuacucgaucgucuccagcuacgugugcuccgggcucgugggcgacacgccccggaagaacgacucguucuccagcucccacugccuggaccccaacaacgaggagggcgggcacggggucaagggcugggccuucgacgacggcaacgacguguggauggggcgcaccaucucgggcaagcugcgguccggguacgagaccuucaaggucaucgagggcuggucgaagcccaacuccaagcuccagaucaaccgccaggugaucguggagcgggggaaccgcagcggcuacuccggcaucuucucggucgaggggaaguccugcaucaaccggugcuucuacguggagcugauccgcggccggaaggaggagaccgaggugugguggaccagcaacucgaucgucguguucugcgggaccuccggcaccuacgggacgggcagcuggccggacggcgccgacaucaaccugaugcccaucuga

SEQ ID NO: 17004 - RNA, 1410 nt, Artificial Sequence; identical to SEQ ID NO: 16993
  derived and/or modified CDS sequence (AUadapt) from InfluenzaA__ABC42161__NA

SEQ ID NO: 17005 - RNA, 1410 nt, Artificial Sequence
  derived and/or modified CDS sequence (AUadapt) from InfluenzaA__ABC42172__NA
augaaccccaaccagaagaucaucaccaucggcucggugucccugaccaucgccacgaucugcucgcucaugcagaucgccauccuggucaccaccgugacccugcacuucaagcagcacgagugcaacuccccgcccaacaaccaggugaugcucugcgagcccacgaucaucgagcgcaacaucaccgagaucgucuaccugaccaacaccacgaucgagaaggagaucugccccaagcugguggaguaccggaacuggagcaagccgcagugcaacaucaccggguucgcgcccuucuccaaggacaacucgauccgccucuccgccggcggggacaucugggugacccgggagcccuacgucagcugcgaccccgacaagugcuaccaguucgcccugggccaggggaccacgcugaacaacggccacuccaacgacaccgugcacgaccgcaccccguaccggacccuccugaugaacgagcugggcgugcccuuccaccucgggacgcgccaggucugcaucgccuggucguccucguccugccacgacggcaaggccuggcugcacgugugcgugaccggggacgacaagaacgcgaccgccagcuucaucuacaacggccggcuggucgacuccaucgggucgugguccaagaagauccuccgcacccaggagagcgagugcgugugcaucaacggcacgugcaccguggucaugaccgacggcuccgccucggggaaggccgacaccaagauccuguucaucgaggagggcaagaucgugcacaucagcacgcuguccgggucggcgcagcacguggaggagugcuccugcuacccccgguaccccggcguccgcugcgugugccgggacaacuggaagggcucgaaccgcccgaucguggacaucaacgucaaggacuacuccaucgugagcuccuacgugugcucggggcucgucggcgacacgccccggaagaacgacuccuucagcuccucgcacugccuggaccccaacaacgaggagggcgggcacggggugaagggcugggccuucgacgacggcaacgacgucuggauggggcgcaccaucuccgagaagcugcggucgggcuacgagaccuucaaggugaucgaggggugguccaagcccaacagcaagcuccagaucaaccgccaggugaucgucgagcggggcaaccgcuccggguacucgggcaucuucuccguggagggcaagagcugcaucaaccggugcuucuacguggagcugauccgcgggcggaaggaggagaccgaggucugguggaccucgaacuccaucgugguguucugcggcaccagcgggaccuacggcacgggguccuggccggacggcgccgacaucaaccugaugcccaucuga

SEQ ID NO: 17006 - RNA, 1410 nt, Artificial Sequence; identical to SEQ ID NO: 16993
  derived and/or modified CDS sequence (AUadapt) from InfluenzaA__ABC42183__NA

SEQ ID NO: 17007 - RNA, 1410 nt, Artificial Sequence; identical to SEQ ID NO: 16993
  derived and/or modified CDS sequence (AUadapt) from InfluenzaA__ABC42195__NA

SEQ ID NO: 17008 - RNA, 1410 nt, Artificial Sequence; identical to SEQ ID NO: 16993
  derived and/or modified CDS sequence (AUadapt) from InfluenzaA__ABC42310__NA

SEQ ID NO: 17009 - RNA, 1410 nt, Artificial Sequence; identical to SEQ ID NO: 16993
  derived and/or modified CDS sequence (AUadapt) from InfluenzaA__ABC42321__NA

SEQ ID NO: 17010 - RNA, 1410 nt, Artificial Sequence; identical to SEQ ID NO: 16993
  derived and/or modified CDS sequence (AUadapt) from InfluenzaA__ABC42349__NA

SEQ ID NO: 17011 - RNA, 1410 nt, Artificial Sequence; identical to SEQ ID NO: 16993
  derived and/or modified CDS sequence (AUadapt) from InfluenzaA__ABC42464__NA

SEQ ID NO: 17012 - RNA, 1410 nt, Artificial Sequence; identical to SEQ ID NO: 16993
  derived and/or modified CDS sequence (AUadapt) from InfluenzaA__ABC42497__NA

SEQ ID NO: 17013 - RNA, 1410 nt, Artificial Sequence; identical to SEQ ID NO: 16993
  derived and/or modified CDS sequence (AUadapt) from InfluenzaA__ABC42508__NA

SEQ ID NO: 17014 - RNA, 1410 nt, Artificial Sequence; identical to SEQ ID NO: 16993
  derived and/or modified CDS sequence (AUadapt) from InfluenzaA__ABC42519__NA

SEQ ID NO: 17015 - RNA, 1410 nt, Artificial Sequence; identical to SEQ ID NO: 16993
  derived and/or modified CDS sequence (AUadapt) from InfluenzaA__ABC42530__NA

SEQ ID NO: 17016 - RNA, 1410 nt, Artificial Sequence; identical to SEQ ID NO: 16993
  derived and/or modified CDS sequence (AUadapt) from InfluenzaA__ABC42577__NA

SEQ ID NO: 17017 - RNA, 1410 nt, Artificial Sequence; identical to SEQ ID NO: 16993
  derived and/or modified CDS sequence (AUadapt) from InfluenzaA__ABC42588__NA

SEQ ID NO: 17018 - RNA, 1410 nt, Artificial Sequence; identical to SEQ ID NO: 16729
  derived and/or modified CDS sequence (AUadapt) from InfluenzaA__ABC42599__NA

SEQ ID NO: 17019 - RNA, 1410 nt, Artificial Sequence; identical to SEQ ID NO: 16729
  derived and/or modified CDS sequence (AUadapt) from InfluenzaA__ABC42610__NA

SEQ ID NO: 17020 - RNA, 1410 nt, Artificial Sequence; identical to SEQ ID NO: 16729
  derived and/or modified CDS sequence (AUadapt) from InfluenzaA__ABC42621__NA

SEQ ID NO: 17021 - RNA, 1410 nt, Artificial Sequence; identical to SEQ ID NO: 16729
  derived and/or modified CDS sequence (AUadapt) from InfluenzaA__ABC42632__NA

SEQ ID NO: 17022 - RNA, 1410 nt, Artificial Sequence; identical to SEQ ID NO: 16729
  derived and/or modified CDS sequence (AUadapt) from InfluenzaA__ABC42643__NA

SEQ ID NO: 17023 - RNA, 1410 nt, Artificial Sequence; identical to SEQ ID NO: 16729
  derived and/or modified CDS sequence (AUadapt) from InfluenzaA__ABC42654__NA

SEQ ID NO: 17024 - RNA, 1410 nt, Artificial Sequence; identical to SEQ ID NO: 16729
  derived and/or modified CDS sequence (AUadapt) from InfluenzaA__ABC42665__NA

SEQ ID NO: 17025 - RNA, 1410 nt, Artificial Sequence; identical to SEQ ID NO: 16729
  derived and/or modified CDS sequence (AUadapt) from InfluenzaA__ABC42676__NA

SEQ ID NO: 17026 - RNA, 1410 nt, Artificial Sequence; identical to SEQ ID NO: 16729
  derived and/or modified CDS sequence (AUadapt) from InfluenzaA__ABC42687__NA

SEQ ID NO: 17027 - RNA, 1410 nt, Artificial Sequence; identical to SEQ ID NO: 16729
  derived and/or modified CDS sequence (AUadapt) from InfluenzaA__ABC42698__NA

SEQ ID NO: 17028 - RNA, 1410 nt, Artificial Sequence; identical to SEQ ID NO: 16729
  derived and/or modified CDS sequence (AUadapt) from InfluenzaA__ABC42709__NA

SEQ ID NO: 17029 - RNA, 1410 nt, Artificial Sequence; identical to SEQ ID NO: 16729
  derived and/or modified CDS sequence (AUadapt) from InfluenzaA__ABC42720__NA

SEQ ID NO: 17030 - RNA, 1410 nt, Artificial Sequence
  derived and/or modified CDS sequence (AUadapt) from InfluenzaA__ABC42742__NA
augaaccccaaccagaagaucaucaccaucggcucggugucccugaccaucagcacgaucugcuucuucaugcagaucgccauccucaugaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaaggagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgccggaacgacuccagcuccagcucccacugccucgaccccaacaacgaggagggcgggcacggggucaagggcugggccuucgacgacgggaacgacguguggaugggccgcaccaucucggagaagcugcgguccggcuacgagaccuucaaggucaucgagggguggagcaaccccaacuccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 17031 - RNA, 1410 nt, Artificial Sequence; identical to SEQ ID NO: 16729
  derived and/or modified CDS sequence (AUadapt) from InfluenzaA__ABC42764__NA

SEQ ID NO: 17032 - RNA, 1410 nt, Artificial Sequence; identical to SEQ ID NO: 16729
  derived and/or modified CDS sequence (AUadapt) from InfluenzaA__ABC42775__NA

SEQ ID NO: 17033 - RNA, 1410 nt, Artificial Sequence; identical to SEQ ID NO: 16729
  derived and/or modified CDS sequence (AUadapt) from InfluenzaA__ABC42786__NA

SEQ ID NO: 17034 - RNA, 1410 nt, Artificial Sequence; identical to SEQ ID NO: 16729
  derived and/or modified CDS sequence (AUadapt) from InfluenzaA__ABC42797__NA

SEQ ID NO: 17035 - RNA, 1410 nt, Artificial Sequence; identical to SEQ ID NO: 16729
  derived and/or modified CDS sequence (AUadapt) from InfluenzaA__ABC42808__NA

SEQ ID NO: 17036 - RNA, 1410 nt, Artificial Sequence; identical to SEQ ID NO: 16729
  derived and/or modified CDS sequence (AUadapt) from InfluenzaA__ABC42819__NA

SEQ ID NO: 17037 - RNA, 1410 nt, Artificial Sequence
  derived and/or modified CDS sequence (AUadapt) from InfluenzaA__ABC42841__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaaggagauccugcggacccaggagucggagugcgugugcaucaacggcacgugcaccguggucaugaccgacggguccgccagccgcaaggccgacaccaagauccucuucaucgaggagggcaagaucgugcacacgucgacccuguccggcagcgcgcagcacguggaggagugcuccugcuacccccgguaccccgggguccgcugcgugugccgggacaacuggaagggcucgaaccgcccgaucguggacaucaacaucaaggacuacuccaucgucagcuccuacgugugcucggggcuggugggcgacacgccccggaagaacgacuccagcuccagcucccacugccucgaccccaacaacgaggagggcgggcacggcgucaaggggugggccuucgacgacggcaacgacguguggauggggcgcaccaucucggagaagcugcgguccggcuacgagaccuucaaggucaucgagggcuggagcaaccccaacuccaagcugcagaucaaccgccaggugaucguggaccgggggaaccgcucgggcuacuccgggaucuucagcgucgagggcaagucgugcaucaaccggugcuucuacguggagcucauccgcgggcggaaggaggagaccgaggugcuguggaccuccaacagcaucgucguguucugcggcaccuccggcacguacgggaccggcagcuggccggacggggccgacaucaaccugaugcccaucuga

SEQ ID NO: 17038 - RNA, 1410 nt, Artificial Sequence; identical to SEQ ID NO: 16729
  derived and/or modified CDS sequence (AUadapt) from InfluenzaA__ABC42852__NA

SEQ ID NO: 17039 - RNA, 1410 nt, Artificial Sequence; identical to SEQ ID NO: 16729
  derived and/or modified CDS sequence (AUadapt) from InfluenzaA__ABC42863__NA

SEQ ID NO: 17040 - RNA, 1410 nt, Artificial Sequence; identical to SEQ ID NO: 16568
  derived and/or modified CDS sequence (AUadapt) from InfluenzaA__ABC42874__NA

SEQ ID NO: 17041 - RNA, 1410 nt, Artificial Sequence; identical to SEQ ID NO: 16568
  derived and/or modified CDS sequence (AUadapt) from InfluenzaA__ABC42885__NA

SEQ ID NO: 17042 - RNA, 1410 nt, Artificial Sequence; identical to SEQ ID NO: 16568
  derived and/or modified CDS sequence (AUadapt) from InfluenzaA__ABC42896__NA

SEQ ID NO: 17043 - RNA, 1410 nt, Artificial Sequence; identical to SEQ ID NO: 16993
  derived and/or modified CDS sequence (AUadapt) from InfluenzaA__ABC42914__NA

SEQ ID NO: 17044 - RNA, 1410 nt, Artificial Sequence; identical to SEQ ID NO: 16993
  derived and/or modified CDS sequence (AUadapt) from InfluenzaA__ABC42932__NA

SEQ ID NO: 17045 - RNA, 1410 nt, Artificial Sequence
  derived and/or modified CDS sequence (AUadapt) from InfluenzaA__ABC42943__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucgagcgcaacaucaccgagaucgucuaccugaccaacaccacgaucgagaaggagaucugccccaagcuggugggguaccggaacugguccaagccgcagugcaacaucaccggcuucgcgcccuucagcaaggacaacuccauccgccucucggccgggggcgacaucugggugacccgggagcccuacgucuccugcgaccccgacaagugcuaccaguucgcccuggggcagggcaccacgcugaacaacggccacagcaacgacaccgugcacgaccgcaccccguaccggacccuccugaugaacgagcugggggugcccuuccaccucggcacgcgccaggucugcaucgccugguccucguccagcugccacgacgggaaggccuggcugcacgugugcgugaccggcgacgacaagaacgcgaccgccuccuucaucuacaacgggcggcuggucgacucgaucggcuccuggagcaagaagauccuccgcacccaggaguccgagugcgugugcaucaacggcacgugcaccguggucaugaccgacgggucggccuccggcaaggccgacaccaagauccuguucaucgaggaggggaagaucgugcacaucagcacgcugucgggcuccgcgcagcacguggaggagugcucgugcuacccccgguaccccggcguccgcugcgugugccgggacaacuggaagggguccaaccgcccgaucguggacaucaacgucaaggacuacagcaucguguccucguacgugugcuccggccucgucggggacacgccccggaagaacgacagcuucuccucgucccacugccuggaccccaacaacgaggagggcgggcacggcgugaagggcugggccuucgacgacgggaacgacgucuggaugggccgcaccaucagcgagaagcugcgguccggguacgagaccuucaaggugaucgagggcuggucgaagcccaacuccaagcuccagaucaaccgccaggugaucgucgagcgggggaaccgcagcggcuacuccggcaucuucucgguggaggggaaguccugcaucaaccggugcuucuacguggagcugauccgcggccggaaggaggagaccgaggucugguggaccagcaacucgaucgugguguucugcgggaccuccggcaccuacgggacgggcagcuggccggacggcgccgacaucaaccugaugcccaucuga

SEQ ID NO: 17046 - RNA, 1410 nt, Artificial Sequence; identical to SEQ ID NO: 16993
  derived and/or modified CDS sequence (AUadapt) from InfluenzaA__ABC42954__NA

SEQ ID NO: 17047 - RNA, 1410 nt, Artificial Sequence; identical to SEQ ID NO: 16993
  derived and/or modified CDS sequence (AUadapt) from InfluenzaA__ABC42965__NA

SEQ ID NO: 17048 - RNA, 1410 nt, Artificial Sequence
  derived and/or modified CDS sequence (AUadapt) from InfluenzaA__ABC42976__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggcgaugcucugcgagcccacgaucaucgagcgcaacaucaccgagaucguguaccugaccaacaccacgaucgagaaggagaucugccccaagcuggucgaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccucgugccacgacggcaaggcguggcugcacgucugcgugaccggggacgacaagaacgccaccgccuccuucaucuacaacggccggcugguggacagcaucggguccuggucgaagaagauccuccgcacccaggaguccgagugcgucugcaucaacggcacgugcaccguggugaugaccgacggcagcgccuccgggaaggcggacaccaagauccuguucaucgaggagggcaagaucguccacaucucgacgcugagcggguccgcccagcacguggaggagugcucgugcuacccccgguaccccggcgugcgcugcgucugccgggacaacuggaagggcuccaaccgcccgaucguggacaucaacgugaaggacuacucgaucgucuccagcuacgugugcuccgggcucgugggcgacacgccccggaagaacgacucguucuccagcucccacugccuggaccccaacaacgaggagggcgggcacggggucaagggcugggccuucgacgacggcaacgacguguggauggggcgcaccaucucggagaagcugcgguccggcuacgagaccuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaaggaggagaccgaggugugguggaccagcaacucgaucgucguguucugcggcaccuccgggaccuacggcacggggagcuggccggacggcgccgacaucaaccugaugcccaucuga

SEQ ID NO: 17049 - RNA, 1410 nt, Artificial Sequence; identical to SEQ ID NO: 16993
  derived and/or modified CDS sequence (AUadapt) from InfluenzaA__ABC42987__NA

SEQ ID NO: 17050 - RNA, 1410 nt, Artificial Sequence; identical to SEQ ID NO: 16993
  derived and/or modified CDS sequence (AUadapt) from InfluenzaA__ABC42998__NA

SEQ ID NO: 17051 - RNA, 1410 nt, Artificial Sequence; identical to SEQ ID NO: 16993
  derived and/or modified CDS sequence (AUadapt) from InfluenzaA__ABC43009__NA

SEQ ID NO: 17052 - RNA, 1410 nt, Artificial Sequence; identical to SEQ ID NO: 16993
  derived and/or modified CDS sequence (AUadapt) from InfluenzaA__ABC43020__NA

SEQ ID NO: 17053 - RNA, 1410 nt, Artificial Sequence
  derived and/or modified CDS sequence (AUadapt) from InfluenzaA__ABC43042__NA
augaaccccaaccagaagaucaucaccaucggcucggugucccugaccaucgccacgaucugcuuccucaugcagaucgccauccuggucaccaccgugacccugcacuucaagcagcacgagugcaacagcccgcccaacaaccaggugaugcucugcgagcccacgaucaucgagcgcaacaucaccgagaucgucuaccugaccaacaccacgaucgagaaggagaucugccccaagcugguggaguaccggaacugguccaagccgcagugcaacaucaccggguucgcgcccuucucgaaggacaacuccauccgccucagcgccggcggggacaucugggugacccgggagcccuacgucuccugcgaccccgacaagugcuaccaguucgcccugggccaggggaccacgcugaacaacggccacucgaacgacaccgugcacgaccgcaccccguaccggacccuccugaugaacgagcugggcgugcccuuccaccucgggacgcgccaggucugcaucgccugguccagcuccucgugccacgacggcaaggccuggcugcacgugugcgugaccggggacgacaagaacgcgaccgccuccuucaucuacaacggccggcuggucgacagcaucggguccuggucgaagaagauccuccgcacccaggaguccgagugcgugugcaucaacggcacgugcaccguggucaugaccgacggcagcgccuccgggaaggccgacaccaagauccuguucaucgaggagggcaagaucgugcacaucucgacgcugagcggguccgcgcagcacguggaggagugcucgugcuacccccgguaccccggcguccgcugcgugugccgggacaacuggaagggcuccaaccgcccgaucguggacaucaacgucaaggacuacagcaucguguccucguacgugugcuccgggcucgucggcgacacgccccggaagaacgacagcuucuccucgucccacugccuggaccccaacaacgaggagggcgggcacggggugaagggcugggccuucgacgacggcaacgacgucuggauggggcgcaccaucagcgagaagcugcgguccggcuacgagaccuucaaggugaucgagggguggucgaagcccaacuccaagcuccagaucaaccgccaggugaucgucgagcggggcaaccgcagcggguacuccggcaucuucucgguggagggcaaguccugcaucaaccggugcuucuacguggagcugauccgcgggcggaaggaggagaccgaggucugguggaccagcaacucgaucgugguguucugcggcaccuccgggaccuacggcacggggagcuggccggacggcgccgacaucaaccugauguccaucuga

SEQ ID NO: 17054 - RNA, 1410 nt, Artificial Sequence; identical to SEQ ID NO: 16993
  derived and/or modified CDS sequence (AUadapt) from InfluenzaA__ABC43053__NA

SEQ ID NO: 17055 - RNA, 1410 nt, Artificial Sequence
  derived and/or modified CDS sequence (AUadapt) from InfluenzaA__ABC43064__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucgagcgcaacaucaccgagaucgucuaccugaccaacaccacgaucgagaaggagaucugccccaagcugguggaguaccggaacugguccaagccgcagugcaacaucaccggguucgcgcccuucagcaaggacaacuccauccgccucucggccggcggggacaucugggugacccgggagcccuacgucuccugcgaccccgacaagugcuaccaguucgcccugggccaggggaccacgcugaacaacggccacagcaacgacaccgugcacgaccgcaccccguaccggacccuccugaugaacgagcugggcgugcccuuccaccucgggacgcgccaggucugcaucgccugguccucguccagcugccacgacggcaaggccuggcugcacgugugcgugaccggggacgacaagaacgcgaccgccuccuucaucuacaacggccggcuggucgacucgaucggguccuggagcaagaagauccuccgcacccaggaguccgagugcgugugcaucaacggcacgugcaccguggucaugaccgacggcucggccuccgggaaggccgacaccaagauccuguucaucgaggagggcaagaucgugcacaucagcacgcugucgggguccgcgcagcacguggaggagugcucgugcuacccccgguaccccggcguccgcugcgugugccgggacaacuggaagggcuccaaccgcccgaucguggacaucaacgucaaggacuacagcaucguguccucguacgugugcuccgggcucgucggcgacacgccccggaagaacgacagcuucuccucgucccacugccuggaccccaacaacgaggagggcgggcacggggugaagggcugggccuucgacgacggcaacgacgucuggauggggcgcaccaucagcgagaagcugcgguccggcuacgagaccuucaaggugaucgagggguggucgaagcccaacuccaagcuccagaucaaccgccaggugaucgucgagcggggcaaccgcagcggguacuccggcaucuucucgguggagggcaaguccugcaucaaccggugcuucuacguggagcugauccgcgggcggaaggagaagaccgaggucugguggaccagcaacucgaucgugguguucugcggcaccuccgggaccuacggcacggggagcuggccggacggcgccgacaucaaccugaugcccaucuga

SEQ ID NO: 17056 - RNA, 1410 nt, Artificial Sequence; identical to SEQ ID NO: 16993
  derived and/or modified CDS sequence (AUadapt) from InfluenzaA__ABC43075__NA

SEQ ID NO: 17057 - RNA, 1410 nt, Artificial Sequence
  derived and/or modified CDS sequence (AUadapt) from InfluenzaA__ABC43086__NA
augaaccccaaccagaagaucaucaccaucggcucggugucccugaucaucgccaccaucugcuuccucaugcagaucgccauccuggucacgaccgugacccugcacuucaagcagcacgagugcaacagcccgcccaacaaccaggugaugcucugcgagcccaccaucaucgagcgcaacaucacggagaucgucuaccugaccaacaccaccaucgagaaggagaucugccccaagcugguggaguaccggaacugguccaagccgcagugcaacaucacgggguucgcgcccuucucgaaggacaacuccauccgccucagcgccggcggggacaucugggugacccgggagcccuacgucuccugcgaccccgacaagugcuaccaguucgcccugggccaggggaccacccugaacaacggccacucgaacgacacggugcacgaccgcaccccguaccggacccuccugaugaacgagcugggcgugcccuuccaccucgggacccgccaggucugcaucgccugguccagcuccucgugccacgacggcaaggccuggcugcacgugugcgugacgggggacgacaagaacgcgaccgccuccuucaucuacaacggccggcuggucgacagcaucggguccuggucgaagaagauccuccgcacccaggaguccgagugcgugugcaucaacgggaccugcacgguggucaugaccgacggcagcgccuccgggaaggccgacaccaagauccuguucaucgaggagggcaagaucgugcacaucucgacccugagcggguccgcgcagcacguggaggagugcucgugcuacccccgguaccccggcguccgcugcgugugccgggacaacuggaagggcuccaaccgcccgaucguggacaucaacgucaaggacuacagcaucguguccucguacgugugcuccgggcucgucggcgacacgccccggaagaacgacagcuucuccucgucccacugccuggaccccaacaacgaggagggcggccacggggugaagggcugggccuucgacgacggcaacgacgucuggauggggcgcaccaucagcgagaagcugcgguccggcuacgagaccuucaaggugaucgagggguggucgaagcccaacuccaagcuccagaucaaccgccaggugaucgucgagcggggcaaccgcagcggguacuccggcaucuucucgguggagggcaaguccugcaucaaccggugcuucuacguggagcugauccgcgggcggaaggaggagaccgaggucugguggacgagcaacucgaucgugguguucugcggcaccuccgggaccuacggcaccgggagcuggccggacggcgccgacaucaaccugaugcccaucuga

SEQ ID NO: 17058 - RNA, 1410 nt, Artificial Sequence; identical to SEQ ID NO: 16993
  derived and/or modified CDS sequence (AUadapt) from InfluenzaA__ABC43097__NA

SEQ ID NO: 17059 - RNA, 1410 nt, Artificial Sequence; identical to SEQ ID NO: 16993
  derived and/or modified CDS sequence (AUadapt) from InfluenzaA__ABC43108__NA

SEQ ID NO: 17060 - RNA, 1410 nt, Artificial Sequence; identical to SEQ ID NO: 16993
  derived and/or modified CDS sequence (AUadapt) from InfluenzaA__ABC43119__NA

SEQ ID NO: 17061 - RNA, 1410 nt, Artificial Sequence; identical to SEQ ID NO: 16729
  derived and/or modified CDS sequence (AUadapt) from InfluenzaA__ABC43130__NA

SEQ ID NO: 17062 - RNA, 1410 nt, Artificial Sequence; identical to SEQ ID NO: 16729
  derived and/or modified CDS sequence (AUadapt) from InfluenzaA__ABC43141__NA

SEQ ID NO: 17063 - RNA, 1410 nt, Artificial Sequence; identical to SEQ ID NO: 16729
  derived and/or modified CDS sequence (AUadapt) from InfluenzaA__ABC43152__NA

SEQ ID NO: 17064 - RNA, 1410 nt, Artificial Sequence; identical to SEQ ID NO: 16729
  derived and/or modified CDS sequence (AUadapt) from InfluenzaA__ABC43163__NA

SEQ ID NO: 17065 - RNA, 1410 nt, Artificial Sequence; identical to SEQ ID NO: 16729
  derived and/or modified CDS sequence (AUadapt) from InfluenzaA__ABC43174__NA

SEQ ID NO: 17066 - RNA, 1410 nt, Artificial Sequence
  derived and/or modified CDS sequence (AUadapt) from InfluenzaA__ABC43185__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaaggagauccugcggacccaggagucggagugcgugugcaucaacggcacgugcaccguggucaugaccgacggguccgccagcggcaaggccgacacccgcauccucuucaucgaggagggcaagaucgugcacacgucgacccuguccgggagcgcgcagcacguggaggagugcuccugcuacccccgguaccccggcguccgcugcgugugccgggacaacuggaaggggucgaaccgcccgaucguggacaucaacaucaaggacuacuccaucgucagcuccuacgugugcucgggccuggugggcgacacgccccggaagaacgacuccagcuccagcucccacugccucgaccccaacaacgaggagggcgggcacggggucaagggcugggccuucgacgacgggaacgacguguggaugggccgcaccaucucggagaagcugcgguccggcuacgagaccuucaaggucaucgagggguggagcaaccccaacuccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 17067 - RNA, 1410 nt, Artificial Sequence; identical to SEQ ID NO: 16729
  derived and/or modified CDS sequence (AUadapt) from InfluenzaA__ABC43478__NA

SEQ ID NO: 17068 - RNA, 1410 nt, Artificial Sequence; identical to SEQ ID NO: 16729
  derived and/or modified CDS sequence (AUadapt) from InfluenzaA__ABC43489__NA

SEQ ID NO: 17069 - RNA, 1410 nt, Artificial Sequence; identical to SEQ ID NO: 16729
  derived and/or modified CDS sequence (AUadapt) from InfluenzaA__ABC43500__NA

SEQ ID NO: 17070 - RNA, 1410 nt, Artificial Sequence
  derived and/or modified CDS sequence (AUadapt) from InfluenzaA__ABC43511__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagacgaccaucaucgagcgcaacaucaccgagaucguguaccucaccaacacgaccaucgagaaggagaucugccccaagcuggccgaguaccggaacuggucgaagccccagugcgacaucaccggguucgcgccguucuccaaggacaacagcauccgccuguccgccggcggggacaucugggucacccgggagcccuacgugucgugcgaccccgacaagugcuaccaguucgcccucggccaggggacgacccugaacaacgugcacuccaacgacaccguccacgaccgcacccccuaccggacgcugcucaugaacgagcugggcgugccguuccaccugggcaccaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaaggagauccugcggacgcaggagucggagugcgugugcaucaacgggaccugcaccguggucaugaccgacggguccgccagcggcaaggccgacacgaagauccucuucaucgaggagggcaagaucgugcacaccucgacccuguccgggagcgcgcagcacguggaggagugcuccugcuacccccgcuaccccggcguccggugcgugugccgcgacaacuggaaggggucgaaccggcccaucguggacaucaacaucaaggacuacuccaucgucagcuccuacgugugcucgggccuggugggcgacaccccgcgcaagaacgacuccagcuccagcucccacugccucgaccccaacaacgaggagggcggccacggggucaagggcugggccuucgacgacgggaacgacguguggaugggccggacgaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcacguccgggaccuacggcaccgggagcuggcccgacggcgccgacaucaaccugaugccgaucuga

SEQ ID NO: 17071 - RNA, 1410 nt, Artificial Sequence; identical to SEQ ID NO: 16729
  derived and/or modified CDS sequence (AUadapt) from InfluenzaA__ABC43522__NA

SEQ ID NO: 17072 - RNA, 1410 nt, Artificial Sequence; identical to SEQ ID NO: 16729
  derived and/or modified CDS sequence (AUadapt) from InfluenzaA__ABC43533__NA

SEQ ID NO: 17073 - RNA, 1410 nt, Artificial Sequence; identical to SEQ ID NO: 16729
  derived and/or modified CDS sequence (AUadapt) from InfluenzaA__ABC43544__NA

SEQ ID NO: 17074 - RNA, 1410 nt, Artificial Sequence; identical to SEQ ID NO: 16729
  derived and/or modified CDS sequence (AUadapt) from InfluenzaA__ABC43555__NA

SEQ ID NO: 17075 - RNA, 1410 nt, Artificial Sequence; identical to SEQ ID NO: 16972
  derived and/or modified CDS sequence (AUadapt) from InfluenzaA__ABC46557__NA

SEQ ID NO: 17076 - RNA, 1410 nt, Artificial Sequence
  derived and/or modified CDS sequence (AUadapt) from InfluenzaA__ABC46579__NA
augaaccccaaccagaagaucaucaccaucggcucggugucccugaccaucgccacgaucugcuuccucaugcagaucgccauccuggucaccaccgugacccugcacuucaagcaguacgagugcucguccccgcccaacaaccaggugaugcccugcgagcccaucaucaucgagcgcaacaucacggagaucgucuaccucaccaacaccaccaucgagaaggagaucugcccgaagcugguggaguaccggaacuggagcaagccccagugcaagaucacgggguucgcgcccuucuccaaggacaacucgauccgccuguccgccggcggggacaucugggugacccgggagcccuacgucagcugcgacccgggcaagugcuaccaguucgcccucgggcagggcaccacccuggacaacaagcacuccaacgacacgauccacgaccgcacccccuaccggacccugcucaugaacgagcugggcgugcccuuccaccuggggacccgccaggugugcaucgccuggucguccagcuccugccacgacggcaaggccuggcuccacgucugcgugacggggcacgacaagaacgcgaccgccucguucaucuacgacggccggcugguggacuccaucgggagcugguccaagaacauccugcgcacccaggagucggagugcgucugcaucaacgggaccugcacgguggugaugaccgacggcuccgccagcgagcgggccgacaccaagauccucuucaucgaggagggcaagaucguccacaucucgccccuguccggcagcgcgcagcacguggaggagugcuccugcuacccgcgcuaccccggggugcggugcgucugccgcgacaacuggaagggcucgaaccggcccgugguggacaucaacgucaaggacuacuccaucgugagcuccuacgugugcucgggccuggucggggacacgccccgcaagaacgaccgguccagcuccucguacugccgcaacccgaacaacgagaagggcaaccacggggugaagggcugggccuucgacgacgggaacgacgucuggaugggccggaccaucuccgaggagagccgcuccggcuacgagaccuucaaggugaucgggggcuggucgacccccaacuccaagcuccagaucaaccgccaggugaucgucgacagcgacaaccgguccggguacucgggcaucuucagcguggaggggaaguccugcaucaaccggugcuucuacguggagcugauccgcggccgcgagcaggagacccgggucugguggacgucgaacuccaucgugguguucugcggcaccagcgggaccuacggcaccggguccuggcccgacggcgccgacaucaaccugaugcccaucuga

SEQ ID NO: 17077 - RNA, 1410 nt, Artificial Sequence; identical to SEQ ID NO: 16916
  derived and/or modified CDS sequence (AUadapt) from InfluenzaA__ABC50170__NA

SEQ ID NO: 17078 - RNA, 1410 nt, Artificial Sequence; identical to SEQ ID NO: 16916
  derived and/or modified CDS sequence (AUadapt) from InfluenzaA__ABC50181__NA

SEQ ID NO: 17079 - RNA, 1410 nt, Artificial Sequence; identical to SEQ ID NO: 16916
  derived and/or modified CDS sequence (AUadapt) from InfluenzaA__ABC50192__NA

SEQ ID NO: 17080 - RNA, 1410 nt, Artificial Sequence; identical to SEQ ID NO: 16568
  derived and/or modified CDS sequence (AUadapt) from InfluenzaA__ABC50203__NA

SEQ ID NO: 17081 - RNA, 1410 nt, Artificial Sequence
  derived and/or modified CDS sequence (AUadapt) from InfluenzaA__ABC50214__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacucgaacgacaccguccacgaccgcaccccguaccggacccuccugaugaacgagcugggcgugcccuuccaccucgggacgcgccaggugugcaucgccugguccagcuccucgugccacgacggcaaggcguggcugcacgucugcgugaccggggacgacgagaacgccaccgccuccuucaucuacaacggccggcugguggacagcaucggguccuggucgaagaagauccuccgcacccaggaguccgagugcgucugcaucaacggcacgugcaccguggugaugaccgacggcucggccuccgggaaggcggacaccaagauccuguucaucgaggagggcaagaucguccacaucagcacgcugucgggguccgcccagcacguggaggagugcagcugcuacccccgguaccccggcgugcgcugcgucugccgggacaacuggaagggcuccaaccgcccgaucaucgacaucaacgugaaggacuacucgaucguguccucguacgucugcuccgggcucgugggcgacacgccccggaagaacgacagcuucuccucgucccacugccuggaccccaacaacgaggagggcgggcacggggugaagggcugggccuucgacgacggcaacgacgucuggauggggcgcaccaucagcgagaagcugcgguccggcuacgagaccuucaaggugaucgagggguggucgaagcccaacccgaagcuccagaccaaccgccaggucaucguggagcggggcaaccgcuccggguacucgggcaucuucuccguggagggcaagagcugcaucaaccggugcuucuacgucgagcugauccgcgggcggaaggaggagaccgaggugugguggaccuccaacucgaucguggucuucugcggcaccagcgggacguacggcaccggguccuggcccgacggcgccgacaucaaccugaugcccaucuga

SEQ ID NO: 17082 - RNA, 1410 nt, Artificial Sequence; identical to SEQ ID NO: 16568
  derived and/or modified CDS sequence (AUadapt) from InfluenzaA__ABC50225__NA

SEQ ID NO: 17083 - RNA, 1410 nt, Artificial Sequence; identical to SEQ ID NO: 16568
  derived and/or modified CDS sequence (AUadapt) from InfluenzaA__ABC50247__NA

SEQ ID NO: 17084 - RNA, 1410 nt, Artificial Sequence
  derived and/or modified CDS sequence (AUadapt) from InfluenzaA__ABC50258__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccucgugccacgacggcaaggcguggcugcacgucugcgugaccggggacgacgagaacgccaccgccuccuucaucuacaacggccggcugguggacagcaucggguccuggucgaagaagauccuccgcacccaggaguccgagugcgucugcaucaacggcacgugcaccguggugaugaccgacggcagcgccuccgggaaggcggacaccaagauccuguucaucgaggagggcaagaucguccacaucucgacgcugagcggguccgcccagcacguggaggagugcucgugcuacccccgguaccccggcgugcgcugcgucugccgggacaacuggaagggcuccaaccgcccgaucaucgacaucaacgugaaggacuacucgaucguguccagcuacgucugcuccgggcucgugggcgacacgccccggaagaacgacucguucuccagcucccacugccuggaccccaacaacgaggagggcgggcacggggugaagggcugggccuucgacgacggcaacgacgucuggauggggcgcaccaucucggagaagcugcgguccggcuacgagaccuucaaggugaucgagggguggucgaagcccaacuccaagcuccagaccaaccgccaggucaucguggagcggggcaaccgcagcggguacuccggcaucuucucgaucgagggcaaguccugcaucaaccggugcuucuacguggagcugauccgcgggcggaaggaggagaccgaggucugguggaccagcaacucgaucgugguguucugcggcaccuccgggacguacggcaccgggagcuggccggacggcgccgacaucaaccugaugcccaucuga

SEQ ID NO: 17085 - RNA, 1410 nt, Artificial Sequence; identical to SEQ ID NO: 16568
  derived and/or modified CDS sequence (AUadapt) from InfluenzaA__ABC50280__NA

SEQ ID NO: 17086 - RNA, 1410 nt, Artificial Sequence; identical to SEQ ID NO: 16568
  derived and/or modified CDS sequence (AUadapt) from InfluenzaA__ABC50291__NA

SEQ ID NO: 17087 - RNA, 1410 nt, Artificial Sequence
  derived and/or modified CDS sequence (AUadapt) from InfluenzaA__ABC50302__NA
augaaccccaaccagaagaucaucaccaucggcucggugucccugaccaucgccacgaucugcuuccucaugcagaucgccauccugaucaccaccgucacccugcacuucaagcaguacgagugcaacucgccgcccaacaaccaggugaugcucugcgagcccacgaucaucgagcgcaacaucaccgagaucguguaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggucacccgggagcccuacguguccugcgaccccgacaagugcuaccaguucgcccugggccaggggaccacgcugaacaacggccacagcaacgacaccgugcacgaccgcaccccguaccggacccuccugaugaacgagcugggcguccccuuccaccucgggacgcgccaggugugcaucgccugguccucguccucgugccacgacggcaaggcguggcugcacgugugcgucaccggggacgacgagaacgccaccgccuccuucaucuacaacggccggcugguggacagcaucggguccuggucgaagaagauccuccgcacccaggaguccgagugcgugugcaucaacggcacgugcaccgucgugaugaccgacggcagcgccuccgggaaggcggacaccaagauccuguucaucgaggagggcaagaucgugcacaucucgacgcugagcggguccgcccagcacgucgaggagugcucgugcuacccccgguaccccggcgugcgcugcgugugccgggacaacuggaagggcuccaaccgcccgaucgucgacaucaacgugaaggacuacucgaucguguccagcuacgucugcuccgggcucgugggcgacacgccccggaagaacgacucguucuccagcucccacugccuggaccccaacaacgaggagggcgggcacggggugaagggcugggccuucgacgacggcaacgacgucuggauggggcgcaccaucucggagaagcugcgguccggcuacgagaccuucaaggugaucgagggguggucgaagcccaacuccaagcuccagaccaaccgccaggucaucguggagcggggcaaccgcagcggguacuccggcaucuucucgguggagggcaaguccugcaucaaccggugcuucuacgucgagcugauccgcgggcggaaggaggagaccgaggugugguggaccagcaacucgaucguggucuucugcggcaccuccgggacguacggcaccgggagcuggccggacggcgccgacaucaaccugaugcccaucuga

SEQ ID NO: 17088 - RNA, 1410 nt, Artificial Sequence
  derived and/or modified CDS sequence (AUadapt) from InfluenzaA__ABC50313__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacucgaacgacaccguccacgaccgcaccccguaccggacccuccugaugaacgagcugggcgugcccuuccaccucgggacgcgccaggugugcaucgccugguccagcuccucgugccacgacggcaaggcguggcugcacgucugcgugaccggggacgacgagaacgccaccgccuccuucaucuacaacggccggcugguggacagcaucggguccuggucgaagaagauccuccgcacccaggaguccgagugcgucugcaucaacggcacgugcaccguggugaugaccgacggcucggccuccgggaaggcggacaccaagauccuguucaucgaggagggcaagaucguccacaucagcacgcugucgggguccgcccagcacguggaggagugcucgugcuacccccgguaccccggcgugcgcugcgucugccgggacaacuggaagggcuccaaccgcccgaucguggacaucaacgugaaggacuacagcaucgucuccucguacgugugcuccgggcucgugggcgacacgccccggaagaacgacagcuucuccucgucccacugccuggaccccaacaacgaggagggcgggcacggggucaagggcugggccuucgacgacggcaacgacguguggauggggcgcaccaucucggagaagcugcgguccggcuacgagaccuucaaggucaucgagggguggagcaagcccaacuccaagcuccagaccaaccgccaggugaucguggagcggggcaaccgcucgggguacuccggcaucuucucggucgagggcaaguccugcaucaaccggugcuucuacguggagcugauccgcgggcggaaggaggagaccgaggugugguggaccagcaacucgaucgucguguucugcggcaccuccgggacguacggcaccgggagcuggccggacggcgccgacaucaaccugaugcccaucuga

SEQ ID NO: 17089 - RNA, 1410 nt, Artificial Sequence; identical to SEQ ID NO: 16568
  derived and/or modified CDS sequence (AUadapt) from InfluenzaA__ABC50324__NA

SEQ ID NO: 17090 - RNA, 1410 nt, Artificial Sequence; identical to SEQ ID NO: 16556
  derived and/or modified CDS sequence (AUadapt) from InfluenzaA__ABC50335__NA

SEQ ID NO: 17091 - RNA, 1410 nt, Artificial Sequence
  derived and/or modified CDS sequence (AUadapt) from InfluenzaA__ABC50346__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccucgugccacgacggcaaggcguggcugcacgucugcgugaccggggacgacgagaacgccaccgccuccuucaucuacaacggccggcugguggacagcaucggguccuggucgaagaagauccuccgcacccaggaguccgagugcgucugcaucaacggcacgugcaccguggugaugaccgacggcagcgccuccgggaaggcggacaccaagauccuguucaucgaggagggcaagaucguccacaucucgacgcugagcggguccgcccagcacguggaggagugcucgugcuacccccgguaccccggcgugcgcugcgucugccgggacaacuggaagggcuccaaccgcccgaucaucgacaucaacgugaaggacuacucgaucguguccagcuacgucugcuccgggcucgugggcgacacgccccggaagaacgacucguucuccagcucccacugccuggaccccaacaacgaggagggcgggcacggggugaagggcugggccuucgacgacggcaacgacgucuggauggggcgcaccaucucggagaagcugcgguccggcuacgagaccuucaaggugaucgagggguggucgaagcccaacuccaagcuccagaccaaccgccaggucaucguggagcggggcaaccgcagcggguacuccggcaucuucucgguggagggcaaguccugcaucaaccggugcuucuacgucgagcugauccgcgggcggaaggaggagaccgaggugugguggaccagcaacucgaucguggucuucugcggcaccuccgggacguacggcaccgggagcuggccggacggcgccgacaucaaccugaugcccaucuga

SEQ ID NO: 17092 - RNA, 1410 nt, Artificial Sequence; identical to SEQ ID NO: 16568
  derived and/or modified CDS sequence (AUadapt) from InfluenzaA__ABC50357__NA

SEQ ID NO: 17093 - RNA, 1410 nt, Artificial Sequence; identical to SEQ ID NO: 16568
  derived and/or modified CDS sequence (AUadapt) from InfluenzaA__ABC50368__NA

SEQ ID NO: 17094 - RNA, 1410 nt, Artificial Sequence; identical to SEQ ID NO: 16568
  derived and/or modified CDS sequence (AUadapt) from InfluenzaA__ABC50379__NA

SEQ ID NO: 17095 - RNA, 1410 nt, Artificial Sequence; identical to SEQ ID NO: 16568
  derived and/or modified CDS sequence (AUadapt) from InfluenzaA__ABC50390__NA

SEQ ID NO: 17096 - RNA, 1410 nt, Artificial Sequence
  derived and/or modified CDS sequence (AUadapt) from InfluenzaA__ABC50412__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccucguucaucuacaacgggcgccugguggacuccaucgucagcugguccaaggagauccugcggacccaggagucggagugcgugugcaucaacggcacgugcaccguggucaugaccgacggguccgccagcggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggacuacuccaucgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucagcgagaagcugcgccugggcuacgagaccuucaaggucaucgaggggugguccaaccccaacucgaagcuccagaucaaccgccaggugaucguggaccggggcaaccgguccggguacagcggcaucuucuccgucgagggcaagucgugcaucaaccgcugcuucuacguggagcugauccgggggcgcaaggaggagaccgaggugcuguggaccagcaacuccaucgucguguucugcggcaccagcgggacguacggcaccggguccuggccggacggcgccgacaucaaccucaugcccaucuga

SEQ ID NO: 17097 - RNA, 1410 nt, Artificial Sequence; identical to SEQ ID NO: 17096
  derived and/or modified CDS sequence (AUadapt) from InfluenzaA__ABC50423__NA

SEQ ID NO: 17098 - RNA, 1410 nt, Artificial Sequence; identical to SEQ ID NO: 16681
  derived and/or modified CDS sequence (AUadapt) from InfluenzaA__ABC54671__NA

SEQ ID NO: 17099 - RNA, 1410 nt, Artificial Sequence; identical to SEQ ID NO: 16813
  derived and/or modified CDS sequence (AUadapt) from InfluenzaA__ABC54682__NA

SEQ ID NO: 17100 - RNA, 1410 nt, Artificial Sequence; identical to SEQ ID NO: 16993
  derived and/or modified CDS sequence (AUadapt) from InfluenzaA__ABC67322__NA

SEQ ID NO: 17101 - RNA, 1410 nt, Artificial Sequence; identical to SEQ ID NO: 16568
  derived and/or modified CDS sequence (AUadapt) from InfluenzaA__ABC67474__NA

SEQ ID NO: 17102 - RNA, 1410 nt, Artificial Sequence; identical to SEQ ID NO: 17091
  derived and/or modified CDS sequence (AUadapt) from InfluenzaA__ABC67546__NA

SEQ ID NO: 17103 - RNA, 1410 nt, Artificial Sequence
  derived and/or modified CDS sequence (AUadapt) from InfluenzaA__ABC67557__NA
augaaccccaaccagaagaucaucaccaucggcucggugucccugaccaucagcacgaucugcuucuucaugcagaucgccauccucgucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggugacccgggagcccuacgugucgugcgaccccgacaagugcuaccaguucgcccucggccaggggaccacgcugaacaacguccacuccaacgacaccgugcacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccuggucgacuccaucgugagcugguccaagaagauccugcggacccaggagucggagugcgugugcaucaacggcacgugcaccgucgugaugaccgacggguccgccagcggcaaggccgacaccaagauccucuucaucgaggagggcaagaucgugcacacgucgacccuguccgggagcgcgcagcacgucgaggagugcuccugcuacccccgcuaccccggcgugcggugcgugugccgcgacaacuggaaggggucgaaccggccgaucgucgacaucaacaucaaggacuacuccaucgugagcuccuacgugugcucgggccuggucggcgacacgccccgcaagaacgacuccagcuccagcucccacugccucgaccccaacaacgaggagggcgggcacggggugaagggcugggccuucgacgacgggaacgacgucuggaugggccggaccaucucggagaagcugcgcuccggcuacgagaccuucaaggugaucgagggguggagcaaccccaacuccaagcugcagaucaaccgccaggugaucgucgaccggggcaaccggucgggguacuccggcaucuucagcguggagggcaagucgugcaucaaccgcugcuucuacguggagcucauccgggggcgcaaggaggagaccgagguccuguggaccuccaacagcaucgugguguucugcggcaccuccgggacguacggcaccgggagcuggccggacggcgccgacaucaaccugaugcccaucuga

SEQ ID NO: 17104 - RNA, 1410 nt, Artificial Sequence
  derived and/or modified CDS sequence (AUadapt) from InfluenzaA__ABC67568__NA
augaaccccaaccagaagaucaucaccaucggcucggugucccugaccaucgccacgaucugcuuccucaugcagaucgccauccuggucaccaccgugacccugcacuucaagcaguacgagugcgacucgccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccauccgccugucggccggcggggacaucugggugacccgggagcccuacgucuccugcgaccccggcaagugcuaccaguucgcccucgggcagggcaccacccuggacaacaagcacucgaacgacacgauccacgaccgcaccccgcaccggacccugcucaugaacgagcugggcgugcccuuccaccuggggacccgccaggugugcaucgccugguccagcuccucgugccacgacggcaaggcguggcuccacgucugcgugacgggguacgacaagaacgccaccgccuccuucaucuacgacggccggcugguggacagcaucggguccuggucgcagaacauccugcgcacccaggaguccgagugcgucugcaucaacgggaccugcacgguggugaugaccgacggcucggccuccggccgggcggacaccaagauccucuucaucgaggagggcaagaucguccacaucagcccccugucgggguccgcccagcacguggaggagugcucgugcuacccccgcuacccgggcgugcggugcaucugccgcgacaacuggaagggcuccaaccggcccgucguggacaucaacgugaaggacuacagcaucgacuccucguacgucugcuccgggcuggugggcgacacgccccgcaacaacgaccggagcuccaacucguacugccgcaaccccaacaacgagaaggggaaccacggcgugaaggggugggccuucgacgacggcaacgacgucuggaugggccggaccaucuccgaggacucgcgcuccggguacgagaccuucaaggugaucggcggguggagcaccccgaacuccaagcuccagaucaaccggcaggucaucguggacucggacaaccgcuccggcuacucggggaucuucuccguggagggcaagagcugcaucaaccggugcuucuacgucgagcugauccgcggccgcgagcaggagacccgggugugguggacgucgaacuccaucguggucuucugcgggaccagcggcaccuacgggaccggcuccuggcccgacggggccaacaucaaccugaugcccaucuga

SEQ ID NO: 17105 - RNA, 1410 nt, Artificial Sequence
  derived and/or modified CDS sequence (AUadapt) from InfluenzaA__ABC67579__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagccggcggaguaccggaacugguccaagccccagugcaagaucaccggguucgcccccuucagcaaggacaacuccauccgccugucggccggcggggacaucugggugacccgggagcccuacguguccugcgacccggacaagugcuaccaguucgcccucggccaggggaccacgcugaacaacggccacucgaacgacaccguccacgaccgcacccccuaccggacccugcucaugaacgagcugggcgugcccuuccaccuggggacgaagcaggucugcaucgccugguccagcuccucgugccacgacggcaaggcguggcuccacgugugcgugaccgggcacgacgagaacgccaccgccuccuucaucuacgacggccgccugguggacucgaucggguccuggagcaagaagauccugcggacccaggaguccgagugcgucugcaucaacggcacgugcaccguggugaugaccgacggcucggccuccgggcgcgcggacaccaagauccucuucaucgaggagggcaagaucguccacaucucgcagcugagcggguccgcccagcacguggaggagugcucgugcuacccccgguacccgggcgugcgcugcgucugccgggacaacuggaagggcuccaaccgccccaucguggacaucaacgugaaggaccacucgaucgucuccagcuacgugugcuccgggcuggugggcgacacgccccggaagaacgacucguccucguccagccacugccucaaccccaacaacgaggagggcgggcacggggucaagggcugggccuucgacgacggcaacgacguguggauggggcgcaccaucuccgagaagcugcggucgggcuacgagaccuucaaggucaucgaggggugguccaagccgaacucgaagcugcagaucaaccgccaggugaucguggaccggggcaaccgcuccggguacagcggcaucuucuccgucgagggcaagucgugcaucaaccggugcuucuacguggagcucauccgcgggcggaagcaggagaccgaggugugguggacgucgaacuccaucgucguguucugcggcaccagcgggaccuacggcaccggguccuggcccgacggcgccgacaucaaccugaugcccaucuga

SEQ ID NO: 17106 - RNA, 1410 nt, Artificial Sequence; identical to SEQ ID NO: 16729
  derived and/or modified CDS sequence (AUadapt) from InfluenzaA__ABC67590__NA

SEQ ID NO: 17107 - RNA, 1410 nt, Artificial Sequence; identical to SEQ ID NO: 16729
  derived and/or modified CDS sequence (AUadapt) from InfluenzaA__ABC67601__NA

SEQ ID NO: 17108 - RNA, 1410 nt, Artificial Sequence; identical to SEQ ID NO: 16568
  derived and/or modified CDS sequence (AUadapt) from InfluenzaA__ABC67612__NA

SEQ ID NO: 17109 - RNA, 1410 nt, Artificial Sequence; identical to SEQ ID NO: 16568
  derived and/or modified CDS sequence (AUadapt) from InfluenzaA__ABC67623__NA

SEQ ID NO: 17110 - RNA, 1410 nt, Artificial Sequence
  derived and/or modified CDS sequence (AUadapt) from InfluenzaA__ABC67634__NA
augaaccccaaccagaagaucaucaccaucggcucggugucccugaccaucgccacgaucugcuuccucaugcagaucgccauccuggucaccaccgugacccugcacuucaagcaguacgagugcaacccgccgcccaacaaccaggugaugcucugcgagcccacgaucaucgagcgcaacaucaccgagaucgucuaccugaccaacaccacgaucgagaaggagaucugccccaagcuggcggaguaccggaacuggucgaagccccagugcaacaucaccggguucgcccccuucuccaaggacaacagcauccgccucuccgccggcggggacaucugggugacccgggagcccuacgugucgugcgacccggacaagugcuaccaguucgcccugggccaggggaccacgcugaacaacggccacuccaacgacaccguccacgaccgcacccccuaccggacccuccugaugaacgagcugggcgugcccuuccaccucgggacgcgccaggugugcaucgccuggucguccagcuccugccacgacggcaaggcguggcugcacgucugcgugaccggggacgacgagaacgccaccgccucguucaucuacaacggccggcugguggacuccaucgggagcugguccaagaagauccuccgcacccaggagucggagugcgucugcaucaacggcacgugcaccguggugaugaccgacggcuccgccucggggaaggcggacaccaagauccuguucaucgaggagggcaagaucguccacaucuccacgcugagcgggucggcccagcacguggaggagugcuccugcuacccccgguacccgggcgugcgcugcgucugccgggacaacuggaagggcagcaaccgccccaucguggacaucaacgugaaggacuacuccaucgucucguccuacgugugcucggggcucgugggcgacacgccccggaagaacgacuccuucagcuccucgcacugccuggaccccaacaacgaggagggcgggcacggggucaagggcugggccuucgacgacggcaacgacguguggauggggcgcaccaucuccgagaagcugcggagcggcuacgagaccuucaaggucaucgaggggugguccaagccgaacucgaagcuccagaccaaccgccaggugaucguggagcggggcaaccgcuccggguacucgggcaucuucuccgucgagggcaagagcugcaucaaccggugcuucuacguggagcugauccgcgggcggaaggaggagaccgaggugugguggaccuccaacucgaucgucguguucugcggcaccagcgggacguacggcaccggguccuggcccgacggcgccgacaucaaccugaugcccaucuga

SEQ ID NO: 17111 - RNA, 1410 nt, Artificial Sequence; identical to SEQ ID NO: 16568
  derived and/or modified CDS sequence (AUadapt) from InfluenzaA__ABC67645__NA

SEQ ID NO: 17112 - RNA, 1410 nt, Artificial Sequence; identical to SEQ ID NO: 16568
  derived and/or modified CDS sequence (AUadapt) from InfluenzaA__ABC67656__NA

SEQ ID NO: 17113 - RNA, 1410 nt, Artificial Sequence
  derived and/or modified CDS sequence (AUadapt) from InfluenzaA__ABC67700__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggucguccagcuccugccacgacgggaaggccuggcuccacgugugcgugaccggcgacgacaagaacgcgaccgccucguucaucuacaacgggcgccugguggacuccaucgucagcugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcucgggccuggugggcgacacgccccgcaagaacgacuccagcuccucgucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaacuccaacucgaagcugcagaucaaccgccaggugaucguggaccggggcaaccgguccggguacagcggcaucuucucggucgaggggaaguccugcaucaaccgcugcuucuacguggagcucauccggggccgcaaggaggagaccgaggugcuguggaccagcaacuccaucgucguguucugcggcaccagcgggacguacggcaccggguccuggcccgacggcgccgacaucaaccugaugccgaucuga

SEQ ID NO: 17114 - RNA, 1410 nt, Artificial Sequence
  derived and/or modified CDS sequence (AUadapt) from InfluenzaA__ABC67711__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaaggagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 17115 - RNA, 1410 nt, Artificial Sequence
  derived and/or modified CDS sequence (AUadapt) from InfluenzaA__ABC67736__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcguggccuggagcuccucguccugccacgacgggaaggccuggcuccacgugugcgugaccggcgacgacaagaacgcgaccgccagcuucaucuacaacgggcgccuggucgacuccaucgugagcugguccaaggagauccugcggacccaggagucggagugcgugugcaucaacggcacgugcaccgucgugaugaccgacggguccgccagcggcaaggccgacaccaagauccucuucaucgaggagggcaagaucgugcacacgucgacccuguccgggagcgcgcagcacgucgaggagugcuccugcuacccccgcuaccccggcgugcggugcgugugccgcgacaacuggaaggggucgaaccggccgaucgucgacaucaacaucaaggacuacuccaucgugagcuccuacgugugcucgggccuggucggcgacacgccccgcaagaacgacuccagcuccagcucccacugccucgaccccaacaacgaggagggcgggcacggggugaagggcugggccuucgacgacgggaacgacgucuggaugggccggaccaucucggagaagcugcgcuccggcuacgagaccuucaaggugaucgagggguggagcaaccccaacuccaagcugcagaucaaccgccaggugaucgucgaccggggcaaccggucgggguacuccggcaucuucagcguggagggcaagucgugcaucaaccgcugcuucuacguggagcucauccgggggcgcaaggaggagaccgagguccuguggaccuccaacagcaucgugguguucugcggcaccuccgggacguacggcaccgggagcuggccggacggcgccgacaucaaccugaugcccaucuga

SEQ ID NO: 17116 - RNA, 1410 nt, Artificial Sequence
  derived and/or modified CDS sequence (AUadapt) from InfluenzaA__ABC67809__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaagaagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 17117 - RNA, 1410 nt, Artificial Sequence; identical to SEQ ID NO: 16993
  derived and/or modified CDS sequence (AUadapt) from InfluenzaA__ABC67820__NA

SEQ ID NO: 17118 - RNA, 1410 nt, Artificial Sequence; identical to SEQ ID NO: 16972
  derived and/or modified CDS sequence (AUadapt) from InfluenzaA__ABC67842__NA

SEQ ID NO: 17119 - RNA, 1410 nt, Artificial Sequence; identical to SEQ ID NO: 16568
  derived and/or modified CDS sequence (AUadapt) from InfluenzaA__ABC67853__NA

SEQ ID NO: 17120 - RNA, 1410 nt, Artificial Sequence; identical to SEQ ID NO: 16972
  derived and/or modified CDS sequence (AUadapt) from InfluenzaA__ABC67864__NA

SEQ ID NO: 17121 - RNA, 1410 nt, Artificial Sequence; identical to SEQ ID NO: 17091
  derived and/or modified CDS sequence (AUadapt) from InfluenzaA__ABC67886__NA

SEQ ID NO: 17122 - RNA, 1410 nt, Artificial Sequence; identical to SEQ ID NO: 16568
  derived and/or modified CDS sequence (AUadapt) from InfluenzaA__ABC67897__NA

SEQ ID NO: 17123 - RNA, 1410 nt, Artificial Sequence; identical to SEQ ID NO: 16568
  derived and/or modified CDS sequence (AUadapt) from InfluenzaA__ABC67970__NA

SEQ ID NO: 17124 - RNA, 1410 nt, Artificial Sequence
  derived and/or modified CDS sequence (AUadapt) from InfluenzaA__ABC67981__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccucgugccacgacggcaaggcguggcugcacgucugcgugaccggggacgacgagaacgccaccgccuccuucaucuacaacggccggcugguggacagcaucggguccuggucgaagaagauccuccgcacccaggaguccgagugcgucugcaucaacggcacgugcaccguggugaugaccgacggcagcgccuccgggaaggcggacaccaagauccuguucaucgaggagggcaagaucguccacaucucgacgcugagcggguccgcccagcacguggaggagugcucgugcuacccccaguaccccggcgugcggugcgucugccgcgacaacuggaagggcuccaaccggccgaucguggacaucaacgugaaggacuacucgaucgucuccagcuacgugugcuccgggcucgugggcgacacgccccgcaagaacgacucguucuccagcucccacugccuggaccccaacaacgaggagggcgggcacggggucaagggcugggccuucgacgacggcaacgacguguggauggggcggaccaucucggagaagcugcgcuccggcuacgagaccuucaaggucaucgagggguggucgaagcccaacuccaagcuccagaccaaccgccaggugaucguggagcggggcaaccggagcggguacuccggcaucuucucggucgagggcaaguccugcaucaaccgcugcuucuacguggagcugauccgggggcgcaaggaggagaccgaggugugguggaccagcaacucgaucgucguguucugcggcaccuccgggacguacggcaccgggagcuggccggacggcgccgacaucaaccugaugcccaucuga

SEQ ID NO: 17125 - RNA, 1410 nt, Artificial Sequence
  derived and/or modified CDS sequence (AUadapt) from InfluenzaA__ABC67992__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccagcugccacgacggcaaggcguggcugcacgucugcgugaccggggacgacgagaacgccaccgccuccuucaucuacaacggccggcugguggacucgaucggguccuggagcaagaagauccuccgcacccaggaguccgagugcgucugcaucaacggcacgugcaccguggugaugaccgacggcucggccuccgggaaggcggacaccaagauccuguucaucgaggagggcaagaucguccacaucagcacgcugucgggguccgcccagcacguggaggagugcucgugcuacccccgguaccccggcgugcgcugcgucugccgggacaacuggaagggcuccaaccgcccgaucguggacaucaacgugaaggacuacagcaucgucuccucguacgugugcuccgggcucgugggcgacacgccccggaagaacaacagcuucuccucgucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggucgaagcccaacuccaagcuccagaccaaccgccaggugaucguggagcggggcaaccgcagcggguacuccggcaucuucucggucgagggcaaguccugcaucaaccggugcuucuacguggagcugauccgcgggcggaaggaggagaucgaggugugguggaccagcaacucgaucgucguguucugcggcaccuccgggaccuacggcacggggagcuggccggacggcgccgacaucaaccugaugcccaucuga

SEQ ID NO: 17126 - RNA, 1410 nt, Artificial Sequence; identical to SEQ ID NO: 17091
  derived and/or modified CDS sequence (AUadapt) from InfluenzaA__ABC68003__NA

SEQ ID NO: 17127 - RNA, 1410 nt, Artificial Sequence
  derived and/or modified CDS sequence (AUadapt) from InfluenzaA__ABC68052__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccagcugccacgacggcaaggcguggcugcacgucugcgugaccggggacgacgagaacgccaccgccuccuucaucuacaacggccggcugguggacucgaucggguccuggagcaagaagauccuccgcacccaggaguccgagugcgucugcaucaacggcacgugcaccguggugaugaucgacggcucggccuccgggaaggcggacaccaagauccuguucaucgaggagggcaagaucguccacaucagcacccugucgggguccgcccagcacguggaggagugcucgugcuacccccgguaccccggcgugcgcugcgucugccgggacaacuggaagggcuccaaccgcccgaucguggacaucaacgugaaggacuacagcaucgucuccucguacgugugcuccgggcucgugggcgacacgccccggaagaacgacagcuucuccucgucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggucgaagcccaacuccaagcuccagaccaaccgccaggugaucguggagcggggcaaccgcagcggguacuccggcaucuucucggucgagggcaaguccugcaucaaccggugcuucuacguggagcugauccgcgggcggaaggaggagacggaggugugguggaccagcaacucgaucgucguguucugcggcaccuccgggaccuacggcacggggagcuggccggacggcgccgacaucaaccugaugcccaucuga

SEQ ID NO: 17128 - RNA, 1410 nt, Artificial Sequence; identical to SEQ ID NO: 16568
  derived and/or modified CDS sequence (AUadapt) from InfluenzaA__ABC68063__NA

SEQ ID NO: 17129 - RNA, 1410 nt, Artificial Sequence; identical to SEQ ID NO: 16568
  derived and/or modified CDS sequence (AUadapt) from InfluenzaA__ABC68074__NA

SEQ ID NO: 17130 - RNA, 1410 nt, Artificial Sequence; identical to SEQ ID NO: 17114
  derived and/or modified CDS sequence (AUadapt) from InfluenzaA__ABC68085__NA

SEQ ID NO: 17131 - RNA, 1410 nt, Artificial Sequence
  derived and/or modified CDS sequence (AUadapt) from InfluenzaA__ABC68096__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccagcugccacgacggcaaggcguggcugcacgucugcgugaccggggacgacgagaacgccaccgccuccuucaucuacaacggccggcugguggacucgaucggguccuggagcaagaagauccuccgcacccaggaguccgagugcgucugcaucaacggcacgugcaccguggugaugaccgacggcucggccuccgggaaggcggacaccaagauccuguucaucgaggagggcaagaucguccacaucagcacgcugucgggguccgcccagcacguggaggagugcucgugcuacccccgguaccccggcgugcgcugcgucugccgggacaacuggaagggcuccaaccgcccgaucguggacaucaacgugaaggacuacagcaucgucuccucguacgugugcuccgggcucgugggcgacacgccccggaagaacgacagcuucuccucgucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggucgaagcccaacuccaagcuccacaucaaccgccaggugaucguggagcggggcaaccgcagcggguacuccggcaucuucucggucgagggcaaguccugcaucaaccggugcuucuacguggagcugauccgcgggcggaaggaggagaccgaggugugguggaccagcaacucgaucgucguguucugcggcaccuccgggaccuacggcacggggagcuggccggacggcgccgacaucaaccugaugcccaucuga

SEQ ID NO: 17132 - RNA, 1410 nt, Artificial Sequence
  derived and/or modified CDS sequence (AUadapt) from InfluenzaA__ABC68225__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccucguccagcugccacgacggcaaggcguggcugcacgugugcgugaccggggacgacgagaacgccaccgccuccuucaucuacaacggccgccugguggacucgaucggguccuggucgaagaagauccuccggacccaggaguccgagugcgucugcaucaacggcacgugcaccguggugaugaccgacggcagcgccuccgggaaggcggacaccaagauccuguucaucgaggagggcaagaucguccacacgucgagccuguccgggucggcccagcacguggaggagugcuccugcuacccccgcuaccccggcgugcggugcgucugccgcgacaacuggaagggcagcaaccggccgaucguggacaucaacgugaaggacuacuccaucgucucguccuacgugugcagcgggcucgugggcgacacgccccgcaagaacgacuccucguccucgucccacugccuggaccccaacaacgaggagggcgggcacggggucaagggcugggccuucgacgacggcaacgacguguggauggggcggaccaucagcgagaagcugcgcuccggcuacgagaccuucaaggucaucgagggguggucgaagcccaacuccaagcuccagaucaaccgccaggugaucguggaccggggcaaccggagcggguacuccggcaucuucucggucgagagcaaguccugcaucaaccgcugcuucuacguggagcugauccggggccgcaagcaggagaccgaggugcuguggaccucgaacuccaucgucguguucugcgggaccagcggcaccuacgggacgggcuccuggccggacggggccgacaucaaccucaugcccaucuga

SEQ ID NO: 17133 - RNA, 1410 nt, Artificial Sequence; identical to SEQ ID NO: 16921
  derived and/or modified CDS sequence (AUadapt) from InfluenzaA__ABC68236__NA

SEQ ID NO: 17134 - RNA, 1350 nt, Artificial Sequence
  derived and/or modified CDS sequence (AUadapt) from InfluenzaA__ABC72646__NA
augaaucccaacaagaagaucaucaccaucggcucgaucugcauggugaccgggauggucucccugaugcuccagaucggcaaccugaucagcaucugggugucccacagcauccauacggggaaccagcagaaggccgagccgaucuccaacaccaacuuccugaccgagaaggccguggcgagcgucaagcucgccggcaacuccagccugugccccaucaaugggugggccguguacuccaaggacaacagcauccgcaucggcuccaagggcgacguguucgucauccgggagcccuucaucaguugcucccaccuggagugccgcaccuucuuccucacgcaggggagccugcugaacgacaagcauuccaacggcaccgugaaggaccggagcccccaccgcacccucauguccugcccggugggggaggcccccagccccuacaauucccgguucgagagcgucgccuggagcgcguccgccugccacgacggcaccagcuggcugacgaucgggaucuccggccccgacaguggcgccguggccgugcugaaguacaacgggaucaucaccgacaccaucaaguccuggcgcaacaacauccuccggacccaggagucggagugcgcgugugucaacggcuccugcuucacggugaugaccgacgggccgagcaacggccaggccucccacaagaucuucaagauggauaagggcaagguggucaagagcguggagcuggacgcccccaacuaccacuacgaggagugcuccuguuaccccgacgccggggagaucacgugcgugugccgcgacaacuggcacggcagcaaucggcccugggucuccuucaaccagaaccuggaguaccagaucggguacaucugcagcggcguguuuggggacaccccgcgccccaacgacggcaccggcuccugcgggcccgugagcuccaacggcaccuacggggucaagggcuucaguuucaaguacgggaacggcguguggaucggccggaccaaguccaccaacagccgcagcggguucgagaugaucugggaucccaacggcuggacggagaccgacuccagcuucuccgugaagcaggacaucgucgccaucaccgacuggagcggguacuccggcaguuucgugcagcacccggagcucaccgggcuggacugcauccggcccugcuucugggucgagcugauccgcggccggcccaaggaguccacgaucuggaccagcggcuccaguaucuccuucugcggggugaacagcgacaccgugggcugguccuggcccgacggggcggagcucccguucaccaucgacaaguga

SEQ ID NO: 17135 - RNA, 1410 nt, Artificial Sequence; identical to SEQ ID NO: 16337
  derived and/or modified CDS sequence (AUadapt) from InfluenzaA__ABC84392__NA

SEQ ID NO: 17136 - RNA, 1410 nt, Artificial Sequence; identical to SEQ ID NO: 16911
  derived and/or modified CDS sequence (AUadapt) from InfluenzaA__ABC84403__NA

SEQ ID NO: 17137 - RNA, 1410 nt, Artificial Sequence; identical to SEQ ID NO: 16916
  derived and/or modified CDS sequence (AUadapt) from InfluenzaA__ABC84414__NA

SEQ ID NO: 17138 - RNA, 1410 nt, Artificial Sequence
  derived and/or modified CDS sequence (AUadapt) from InfluenzaA__ABC84425__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccucgucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggucgaaccccaacuccaagcugcagaucaaccgccaggugaucguggaccggggcaaccggagcggguacuccggcaucuucucggucgaggggaagaacugcaucaaccgcugcuucuacguggagcucauccggggccgcaaggaggagaccgaggugcuguggaccagcaacuccaucgucguguucugcggcaccagcgggacguacggcaccggguccuggccggacggcgccgacaucaaccugaugcccaucuga

SEQ ID NO: 17139 - RNA, 1410 nt, Artificial Sequence; identical to SEQ ID NO: 16729
  derived and/or modified CDS sequence (AUadapt) from InfluenzaA__ABC84436__NA

SEQ ID NO: 17140 - RNA, 1410 nt, Artificial Sequence
  derived and/or modified CDS sequence (AUadapt) from InfluenzaA__ABC84447__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucguccaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacucgaacgacaccguccacgaccgcaccccguaccggacccuccugaugaacgagcugggcgugcccuuccaccucgggacgcgccaggugugcaucgccugguccagcuccucgugccacgacggcaaggcguggcugcacgucugcgugaccggggacgacgagaacgccaccgccuccuucaucuacaacggccggcugguggacagcaucggguccuggucgaagaagauccuccgcacccaggaguccgagugcgucugcaucaacggcacgugcaccguggugaugaccgacggcucggccuccgggaaggcggacaccaagauccuguucaucgaggagggcaagaucguccacaucagcacgcugucgggguccgcccagcacguggaggagugcucgugcuacccccgguaccccggcgugcgcugcgucugccgggacaacuggaagggcuccaaccgcccgaucguggacaucaacgugaaggacuacagcaucgucuccucguacgugugcuccgggcucgugggcgacacgccccggaagaacgacagcuucuccucgucccacugccuggaccccaacaacgaggagggcgggcacggggucaagggcugggccuucgacgacggcaacgacguguggauggggcgcaccaucucggagaagcugcgguccggcuacgagaccuucaaggucaucgagggguggagcaagcccaacuccaagcuccagaccaaccgccaggugaucguggagcggggcaaccgcucgggguacuccggcaucuucucggucgagggcaaguccugcaucaaccggugcuucuacguggagcugauccgcgggcggaaggaggagaccgaggugugguggaccagcaacucgaucgucguguucugcggcaccuccgggacguacggcaccgggagcuggccggacggcgccgacaucaaccugaugcccaucuga

SEQ ID NO: 17141 - RNA, 1410 nt, Artificial Sequence; identical to SEQ ID NO: 17116
  derived and/or modified CDS sequence (AUadapt) from InfluenzaA__ABC84501__NA

SEQ ID NO: 17142 - RNA, 1410 nt, Artificial Sequence; identical to SEQ ID NO: 17116
  derived and/or modified CDS sequence (AUadapt) from InfluenzaA__ABC84512__NA

SEQ ID NO: 17143 - RNA, 1410 nt, Artificial Sequence
  derived and/or modified CDS sequence (AUadapt) from InfluenzaA__ABC84523__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccuggccgacuccaucgugucgugguccaaggagauccugcggacccaggagagcgagugcgucugcaucaacggcacgugcaccguggugaugaccgacggguccgccucgggcaaggcggacaccaagauccucuucaucgaggagggcaagaucguccacacgagcacccuguccgggucggcccagcacguggaggagugcuccugcuacccccgcuaccccggcgugcggugcgucugccgcgacaacuggaaggggagcaaccggccgaucguggacaucaacaucaaggacuacuccaucgugucguccuacgucugcagcggccuggugggcgacacgccccgcaagaacgacuccucguccagcucccacugccucgaccccaacaacgaggagggcgggcacggggugaagggcugggccuucgacgacgggaacgacgucuggaugggccggaccaucucggagaagcugcgcuccggcuacgagaccuucaaggugaucgagggguggagcaaccccaacuccaagcugcagaucaaccggcaggucaucguggaccgcggcaaccggucgggguacuccggcaucuucagcguggagggcaagucgugcaucaaccgcugcuucuacgucgagcucauccgggggcgcaaggaggagaccgaggugcuguggaccuccaacagcaucguggucuucugcggcaccuccgggacguacggcaccgggagcuggccggacggcgccgacaucaaccugaugcccaucuga

SEQ ID NO: 17144 - RNA, 1410 nt, Artificial Sequence
  derived and/or modified CDS sequence (AUadapt) from InfluenzaA__ABC84545__NA
augaaccccaaccagaagaucaucaccaucggcucggugucccugaccaucgccacgaucugcuuccucaugcagaucgccauccuggucaccaccgugacccugcacuucaagcaguacgagugcgacucgccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccauccgccugucggccggcggggacaucugggugacccgggagcccuacgucuccugcgaccccggcaagugcuaccaguucgcccucgggcagggcaccacccuggacaacaagcacucgaacgacacgauccacgaccgcaccccgcaccggacccugcucaugaacgagcugggcgugcccuuccaccuggggacccgccaggugugcaucgccugguccagcuccucgugccacgacggcaaggcguggcuccacgucugcgugacgggguacgacaagaacgccaccgccuccuucaucuacgacggccggcugguggacucgaucggguccuggagccagaacauccugcgcacccaggaguccgagugcgucugcaucaacgggaccugcacgguggugaugaccgacggcucggccuccggcucggcggacaccaagauccucuucaucgaggagggcaagaucguccacaucagcccccuguccgggucggcccagcacguggaggagugcuccugcuacccccgguacccgggcgugcgcugcaucugccgggacaacuggaagggcagcaaccgccccgucguggacaucaacgugaaggaccacuccaucgacucguccuacgucugcucggggcuggugggcgacacgccccggaacaacgaccgcuccagcaacuccuacugccggaaccccaacaacgagaaggggaaccacggcgugaaggggugggccuucgacgacggcaacgacgucuggaugggccgcaccaucucggaggacucccggucgggguacgagaccuucaaggugaucggcgggugguccaccccgaacagcaagcuccagaucaaccgccaggucaucguggacuccgacaaccggucgggcuacuccgggaucuucucgguggagggcaagagcugcaucaaccgcugcuucuacgucgagcugauccggggccgcgagcaggagacccgcgugugguggacguccaacucgaucguggucuucugcgggaccuccggcaccuacgggaccggcagcuggcccgacggggccgacaucaaccugaugcccaucuga

SEQ ID NO: 17145 - RNA, 1410 nt, Artificial Sequence; identical to SEQ ID NO: 17132
  derived and/or modified CDS sequence (AUadapt) from InfluenzaA__ABC84574__NA

SEQ ID NO: 17146 - RNA, 1410 nt, Artificial Sequence; identical to SEQ ID NO: 17132
  derived and/or modified CDS sequence (AUadapt) from InfluenzaA__ABC85757__NA

SEQ ID NO: 17147 - RNA, 1410 nt, Artificial Sequence; identical to SEQ ID NO: 17143
  derived and/or modified CDS sequence (AUadapt) from InfluenzaA__ABC85768__NA

SEQ ID NO: 17148 - RNA, 1410 nt, Artificial Sequence; identical to SEQ ID NO: 17132
  derived and/or modified CDS sequence (AUadapt) from InfluenzaA__ABC85779__NA

SEQ ID NO: 17149 - RNA, 1410 nt, Artificial Sequence; identical to SEQ ID NO: 17132
  derived and/or modified CDS sequence (AUadapt) from InfluenzaA__ABC85790__NA

SEQ ID NO: 17150 - RNA, 1410 nt, Artificial Sequence; identical to SEQ ID NO: 17116
  derived and/or modified CDS sequence (AUadapt) from InfluenzaA__ABC85801__NA

SEQ ID NO: 17151 - RNA, 1410 nt, Artificial Sequence; identical to SEQ ID NO: 17116
  derived and/or modified CDS sequence (AUadapt) from InfluenzaA__ABC85812__NA

SEQ ID NO: 17152 - RNA, 1410 nt, Artificial Sequence; identical to SEQ ID NO: 17143
  derived and/or modified CDS sequence (AUadapt) from InfluenzaA__ABC85823__NA

SEQ ID NO: 17153 - RNA, 1410 nt, Artificial Sequence; identical to SEQ ID NO: 17115
  derived and/or modified CDS sequence (AUadapt) from InfluenzaA__ABC85834__NA

SEQ ID NO: 17154 - RNA, 1410 nt, Artificial Sequence; identical to SEQ ID NO: 17116
  derived and/or modified CDS sequence (AUadapt) from InfluenzaA__ABC85845__NA

SEQ ID NO: 17155 - RNA, 1410 nt, Artificial Sequence; identical to SEQ ID NO: 17143
  derived and/or modified CDS sequence (AUadapt) from InfluenzaA__ABC85856__NA

SEQ ID NO: 17156 - RNA, 1410 nt, Artificial Sequence; identical to SEQ ID NO: 17115
  derived and/or modified CDS sequence (AUadapt) from InfluenzaA__ABC85867__NA

SEQ ID NO: 17157 - RNA, 1410 nt, Artificial Sequence; identical to SEQ ID NO: 17114
  derived and/or modified CDS sequence (AUadapt) from InfluenzaA__ABC85900__NA

SEQ ID NO: 17158 - RNA, 1410 nt, Artificial Sequence
  derived and/or modified CDS sequence (AUadapt) from InfluenzaA__ABC85911__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccucgugccacgacggcaaggcguggcugcacgucugcgugaccggggacgacgagaacgccaccgccuccuucaucuacaacggccggcugguggacagcaucggguccuggucgaagaagauccuccgcacccaggaguccgagugcgucugcaucaacggcacgugcaccguggugaugaccgacggcagcgccuccgggaaggcggacaccaagauccuguucaucgaggagggcaagaucguccacaucucgacgcugagcggguccgcccagcacguggaggagugcucgugcuacccccgguaccccggcgugcgcugcgucugccgggacaacuggaagggcuccaaccgcccgaucguggacaucaacgugaaggacuacucgaucgucuccagcuacgugugcuccgggcucgugggcgacacgccccggaagaacgacucguucuccagcucccacugccuggaccccaacaacgaggagggcgggcacggggucaagggcugggccuucgacgacggcaacgacauguggauggggcgcaccaucucggagaagcugcgguccggcuacgagaccuucaaggugaucgagggguggucgaagcccaacuccaagcuccagaccaaccgccaggucaucguggagcggggcaaccgcagcggguacuccggcaucuucucgguggagggcaaguccugcaucaaccggugcuucuacgucgagcugauccgcgggcggaaggaggagaccgaggugugguggaccagcaacucgaucguggucuucugcggcaccuccgggacguacggcaccgggagcuggccggacggcgccgacaucaaccugaugcccaucuga

SEQ ID NO: 17159 - RNA, 1410 nt, Artificial Sequence
  derived and/or modified CDS sequence (AUadapt) from InfluenzaA__ABC85922__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaccaucgagcgcaacaucaccgagaucgucuaccugaccaacacgaccaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgacagcgacaagugcuaccaguucgcccugggccaggggacgacccugaacaacggccacuccaacgacaccguccacgaccgcacccccuaccggacgcuccugaugaacgagcugggcgugccguuccaccucgggacccgccaggugugcaucgccuggucguccucguccugccacgacggcaaggcguggcugcacgucugcgugaccggggacgacgagaacgccaccgccagcuucaucuacaacggccggcugguggacuccaucgggucgugguccaagaagauccuccgcacgcaggagagcgagugcgucugcaucaacgggaccugcaccguggugaugaccgacggcuccgccucggggaaggcggacacgaagauccuguucaucgaggagggcaagaucguccacaucagcacccuguccgggucggcccagcacguggaggagugcuccugcuacccccgguaccccggcgugcgcugcgucugccgggacaacuggaagggcucgaaccgccccaucguggacaucaacgugaaggacuacuccaucgucagcuccuacgugugcucggggcucgugggcgacaccccgcggaagaacgacuccuucagcuccucgcacugccuggaccccaacaacgaggagggcggccacggggucaagggcugggccuucgacgacggcaacgacguguggauggggcgcaccaucuccgagaagcugcggucgggcuacgagacguucaaggucaucgaggggugguccaagcccaacagcaagcuccagaccaaccgccaggugaucguggagcggggcaaccgcuccggguacucgggcaucuucuccgucgagggcaagagcugcaucaaccggugcuucuacguggagcugauccgcgggcggaaggaggagaccgaggugugguggaccucgaacuccaucgucguguucugcggcacgagcgggaccuacggcaccggguccuggcccgacggcgccgacaucaaccugaugccgaucuga

SEQ ID NO: 17160 - RNA, 1410 nt, Artificial Sequence; identical to SEQ ID NO: 16568
  derived and/or modified CDS sequence (AUadapt) from InfluenzaA__ABC85933__NA

SEQ ID NO: 17161 - RNA, 1410 nt, Artificial Sequence
  derived and/or modified CDS sequence (AUadapt) from InfluenzaA__ABC85955__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacucgaacgacaccguccacgaccgcaccccguaccggacccuccugaugaacgagcugggcgugcccuuccaccucgggacgcgccaggugugcaucgccugguccagcuccucgugccacgacggcaaggcguggcugcacgucugcgugaccggggacgacgagaacgccaccgccuccuucaucuacaacggccggcugguggacagcaucggguccuggucgaagaagauccuccgcacccaggaguccgagugcgucugcaucaacggcacgugcaccguggugaugaccgacggcucggccuccgggaaggcggacaccaagauccuguucaucgaggagggcaagaucguccacaucagcacgcugucgggguccgcccagcacguggaggagugcucgugcuacccccgguaccccggcgugcgcugcgucugccgggacaacuggaagggcuccaaccgcccgaucguggacaucaacgugaaggacuacagcaucgucuccucguacgugugcuccgggcucgugggcgacacgccccggaagaacgacagcuucuccucgucccacugccuggaccccaacaacgaggagggcgggcacggggucaagggcugggccuucgacgacggcaacgacguguggauggggcgcaccaucucggagaagcugcgguccggcuacgagaccuucaaggucaucgagggguggagcaagcccaacuccaagcuccagaccaaccgccaggugaucguggagcggggcaaccgcucgggguacuccggcaucuucucggucgagggcaaguccugcaucaaccggugcuucuacguggagcugauccgcgggcggaaggaggagaccgaggugugguggaccagcaacucgaucgucguguucugcggcaccuccgggacguacggcaccgggagcuggccggacggcgccgacaucaaccgcaugcccaucuga

SEQ ID NO: 17162 - RNA, 1410 nt, Artificial Sequence; identical to SEQ ID NO: 16568
  derived and/or modified CDS sequence (AUadapt) from InfluenzaA__ABC85966__NA

SEQ ID NO: 17163 - RNA, 1410 nt, Artificial Sequence; identical to SEQ ID NO: 16568
  derived and/or modified CDS sequence (AUadapt) from InfluenzaA__ABC85977__NA

SEQ ID NO: 17164 - RNA, 1410 nt, Artificial Sequence
  derived and/or modified CDS sequence (AUadapt) from InfluenzaA__ABC85988__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggggaucugccccaagcuggcggaguaccggaacugguccaagccgcagugcaacaucaccggcuucgcccccuucagcaaggacaacuccauccgccucucggccgggggcgacaucugggugacccgggagcccuacguguccugcgaccccgacaagugcuaccaguucgcccuggggcagggcaccacgcugaacaacggccacagcaacgacaccguccacgaccgcaccccguaccggacccuccugaugaacgagcugggggugcccuuccaccucggcacgcgccaggugugcaucgccugguccucguccucgugccacgacgggaaggcguggcugcacgucugcgugaccggcgacgacgagaacgccaccgccuccuucaucuacaacgggcggcugguggacagcaucggcuccuggucgaagaagauccuccgcacccaggaguccgagugcgucugcaucaacggcacgugcaccguggugaugaccgacgggagcgccuccggcaaggcggacaccaagauccuguucaucgaggaggggaagaucguccacaucucgacgcugagcggcuccgcccagcacguggaggagugcucgugcuacccccgguaccccggcgugcgcugcgucugccgggacaacuggaagggguccaaccgcccgaucguggacaucaacgugaaggacuacucgaucgucuccagcuacgugugcuccggccucgugggggacacgccccggaagaacgacucguucuccagcucccacugccuggaccccaacaacgaggagggcgggcacggcgucaagggcugggccuucgacgacgggaacgacguguggaugggccgcaccaucucggagaagcugcgguccggguacgagaccuucaaggucaucgagggcuggucgaagcccaacuccaagcuccagaccaaccgccaggugaucguggagcgggggaaccgcagcggcuacuccggcaucuucucggucgaggggaaguccugcaucaaccggugcuucuacguggagcugauccgcggccggaaggaggagaccgaggugugguggaccagcaacucgaucgucguguucugcgggaccuccggcacguacgggaccggcagcuggccggacggcgccgacaucaaccugaugcccaucuga

SEQ ID NO: 17165 - RNA, 1410 nt, Artificial Sequence; identical to SEQ ID NO: 16729
  derived and/or modified CDS sequence (AUadapt) from InfluenzaA__ABC85999__NA

SEQ ID NO: 17166 - RNA, 1410 nt, Artificial Sequence; identical to SEQ ID NO: 16729
  derived and/or modified CDS sequence (AUadapt) from InfluenzaA__ABC86010__NA

SEQ ID NO: 17167 - RNA, 1410 nt, Artificial Sequence
  derived and/or modified CDS sequence (AUadapt) from InfluenzaA__ABC86021__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaaggagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggacguacggcaccgggagcuggccggacggcgccaacaucaaccugaugcccaucuga

SEQ ID NO: 17168 - RNA, 1410 nt, Artificial Sequence; identical to SEQ ID NO: 16993
  derived and/or modified CDS sequence (AUadapt) from InfluenzaA__ABC86127__NA

SEQ ID NO: 17169 - RNA, 1410 nt, Artificial Sequence; identical to SEQ ID NO: 17076
  derived and/or modified CDS sequence (AUadapt) from InfluenzaA__ABC86140__NA

SEQ ID NO: 17170 - RNA, 1410 nt, Artificial Sequence; identical to SEQ ID NO: 16886
  derived and/or modified CDS sequence (AUadapt) from InfluenzaA__ABC86151__NA

SEQ ID NO: 17171 - RNA, 1413 nt, Artificial Sequence
  derived and/or modified CDS sequence (AUadapt) from InfluenzaA__ABC86240__NA
augaaccccaaccagaagaucaucaccaucggcucgaucuccguggccaucgggaucaucagccugauccuccagaucggcaacaucaucuccaucugggccucgcacuccauccagaccgggagccagaacuacacgggcaucugcaaccagaagaucaucaccuacgagaaccgcaccugggucaaccagaccuacgugaacaucaacaacacgaacguggucgcggggaaggacaagaccuccaugacccuggccggcaacucgucccugugcccgauccggggcugggccaucuacaccaaggacaacagcauccgcaucggguccaagggcgacguguucgugauccgggagcccuucaucucgugcucccaccucgagugccgcacguucuuccugacccagggggcccugcucaacgacaagcacagcaacggcaccaucaaggaccggucccccuuccgcgcccugaugucgugcccccugggggaggcgccgucccccuacaacagccgguucgaguccgucgccuggucggccagcgccugccacgacggccucggcuggcugaccaucgggaucuccggccccgacaacggggcgguggccgugcugaaguacaacggcaucaucacggagaccaucaagucguggaagaagcagauccuccgcacccaggaguccgagugcgucugcgugaacggcagcugcuucaccaucaugacggacgggcccuccaaccgggccgccucguaccgcaucuucaagaucgagaagggccgggugaccaaguccaucgagcuggacgccccgaacuaccacuacgaggagugcagcugcuaccccgacaccgggaccgucaugugcgugugccgcgacaacuggcacggcuccaaccggcccugggugucguucaaccagaaccuggacuaccagaucggguacaucugcuccggcgucuucggcgacaacccccgcccgaaggacggggagggcagcugcaaccccgugacgguggacggggcggacggcgucaagggguucuccuaccgguacggcaacggcguguggaucgggcgcaccaagucgaaccggcuccgcaagggcuucgagaugaucugggaccccaacggguggaccgacaccgacuccgacuucagcaugaagcaggacguggucgccaugacggacugguccggcuacucgggguccuucgugcagcaccccgagcugaccggccuggacugcaugcggccgugcuucuggguggagcucguccgcggccugccccgggagaacaccaccaucuggacgagcgggucguccaucagcuucugcggcgugaacuccgagaccgccaacuggagcuggcccgacggggccgagcugcccuucaccaucgacaaguga

SEQ ID NO: 17172 - RNA, 1410 nt, Artificial Sequence
  derived and/or modified CDS sequence (AUadapt) from InfluenzaA__ABC97377__NA
augaaccccaaccagaagaucaucaccaucggcucggugucccugaccaucgccacgaucugcuuccucaugcagaucgccauccuggucaccaccgugacccugcacuucaagcaguacgagugcgacucgccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccauccgccugucggccggcggggacaucugggugacccgggagcccuacgucuccugcgaccccggcaagugcuaccaguucgcccucgggcagggcaccacccuggacaacaagcacagcaacgacacgauccacgaccgcaccccgcaccggacccugcucaugaacgagcugggcgugcccuuccaccuggggacccgccaggugugcaucgccugguccucguccucgugccacgacggcaaggcguggcuccacgucugcgugacgggguacgacaagaacgccaccgccuccuucaucuacgacggccggcugguggacagcaucggguccuggucgcagaacauccugcgcacccaggaguccgagugcgucugcaucaacgggaccugcacgguggugaugaccgacggcagcgccuccggcucggcggacaccaagauccucuucaucgaggagggcaagaucguccacaucucgccccuguccgggagcgcccagcacguggaggagugcuccugcuacccccgguacccgggcgugcgcugcaucugccgggacaacuggaagggcucgaaccgccccgucguggacaucaacgugaaggacuacuccaucgacagcuccuacgucugcucggggcuggugggcgacacgccccggaacaacgaccgcuccucgaacuccuacugccggaaccccaacaacgagaaggggaaccacggcgugaaggggugggccuucgacgacggcaacgacgucuggaugggccgcaccaucagcgaggacucccggucgggguacgagaccuucaaggugaucggcgggugguccaccccgaacagcaagcuccagaucaaccgccaggucaucguggacuccgacaaccggucgggcuacuccgggaucuucucgguggagggcaagagcugcaucaaccgcugcuucuacgucgagcugauccggggccgcgagcaggagacccgcgugugguggacguccaacucgaucguggucuucugcgggaccuccggcaccuacgggaccggcagcuggcccgacggggccgacaucaaccugaugcccaucuga

SEQ ID NO: 17173 - RNA, 1410 nt, Artificial Sequence; identical to SEQ ID NO: 16539
  derived and/or modified CDS sequence (AUadapt) from InfluenzaA__ABD15452__NA

SEQ ID NO: 17174 - RNA, 1410 nt, Artificial Sequence; identical to SEQ ID NO: 16627
  derived and/or modified CDS sequence (AUadapt) from InfluenzaA__ABD15463__NA

SEQ ID NO: 17175 - RNA, 1410 nt, Artificial Sequence; identical to SEQ ID NO: 16547
  derived and/or modified CDS sequence (AUadapt) from InfluenzaA__ABD15474__NA

SEQ ID NO: 17176 - RNA, 1410 nt, Artificial Sequence
  derived and/or modified CDS sequence (AUadapt) from InfluenzaA__ABD15485__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccucgugccacgacggcaaggcguggcugcacgucugcgugaccggggacgacaagaacgccaccgccuccuucaucuacaacggccggcugguggacagcaucggguccuggucgaagaagauccuccgcacccaggaguccgagugcgucugcaucaacggcacgugcaccguggugaugaccgacggcagcgccuccgggaaggcggacaccaagauccuguucaucgaggagggcaagaucguccacaucucgacgcugagcggguccgcccagcacguggaggagugcucgugcuacccccgguaccccggcgugcgcugcgucugccgggacaacuggaagggcuccaaccgcccgaucguggacaucaacgugaaggacuacucgaucgucuccagcuacgugugcuccgggcucgugggcgacacgccccggaagaacgacucguucuccagcucccacugccuggaccccaacaacgaggagggcgggcacggggucaagggcugggccuucgacgacggcaacgacguguggauggggcgcaccaucucggagaagcugcgguccggcuacgagaccuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaaggaggagaccgaggugugguggaccagcaacucgaucgucguguucugcggcaccuccgggaccuacggcacggggagcuggccggacggcgccaacaucaaccugaugcccaucuga

SEQ ID NO: 17177 - RNA, 1410 nt, Artificial Sequence; identical to SEQ ID NO: 16627
  derived and/or modified CDS sequence (AUadapt) from InfluenzaA__ABD15496__NA

SEQ ID NO: 17178 - RNA, 1410 nt, Artificial Sequence; identical to SEQ ID NO: 16547
  derived and/or modified CDS sequence (AUadapt) from InfluenzaA__ABD15507__NA

SEQ ID NO: 17179 - RNA, 1413 nt, Artificial Sequence
  derived and/or modified CDS sequence (AUadapt) from InfluenzaA__ABD15518__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagucggagugcgugugcgugaacggcuccugcuucaccaucaugacggacgggcccagcaacggcggggccuccuacaagaucuucaagaucgagaagggcaaggucaccaagucgaucgagcucaacgcccccaacuuccacuacgaggagugcuccugcuacccggacaccgggaccgugaugugcgugugccgcgacaacuggcacggcagcaaccggcccugggucuccuucaaccagaaccuggacuaccagaucggcuacaucugcucggggguguucggcgacaacccccgccccaaggacgggaagggcuccugcaacccggugacggucgacggggccgacggcgugaagggcuucagcuacaaguacgggaacggcguguggaucgggcggaccaaguccaaccgccugcggaagggcuucgagaugaucugggaccccaacggguggaccgacaccgacagcgacuucuccgucaagcaggacgugguggcgaucacggacuggucgggcuacagcggcuccuucguccagcaccccgagcucaccgggcuggacugcauccgccccugcuucuggguggagcugguccggggccucccgcgcgagaacaccaccaucuggacgucgggguccagcaucuccuucugcggcguggacagcgacaccgccaacugguccuggcccgacggcgccgagcugcccuucaccaucgacaaguga

SEQ ID NO: 17180 - RNA, 1410 nt, Artificial Sequence; identical to SEQ ID NO: 16729
  derived and/or modified CDS sequence (AUadapt) from InfluenzaA__ABD15529__NA

SEQ ID NO: 17181 - RNA, 1410 nt, Artificial Sequence; identical to SEQ ID NO: 16916
  derived and/or modified CDS sequence (AUadapt) from InfluenzaA__ABD15551__NA

SEQ ID NO: 17182 - RNA, 1410 nt, Artificial Sequence
  derived and/or modified CDS sequence (AUadapt) from InfluenzaA__ABD15562__NA
augaaccccaaccagaagaucaucaccaucggcucggugucccugaccaucgccacgaucugcuuccucaugcagaucgccauccuggucaccaccgugacccugcacuucaagcaguacgagugcucguccccgcccaacaaccaggugaugcucugcgagcccacgaucaucgagcgcaacaucaccgagaucgucuaccugaccaacaccacgaucgagaaggagaucugccccaagcuggcggaguaccggaacuggagcaagccgcagugcaagaucaccggguucgcccccuucuccaaggacaacucgauccgccucuccgccggcggggacaucugggugacccgggagcccuacgugagcugcgaccccgacaagugcuaccaguucgcccugggccaggggaccacgcugaacaaccgccacuccaacgacaccguccacgaccggaccccguaccgcacccuccugaugaacgagcugggcgugcccuuccaccucggcacgaagcaggucugcaucgccuggucguccagcuccugccacgacgggaaggcguggcugcacgugugcgugaccggccacgacgagaacgccaccgccucguucaucuacgacgggcggcugguggacuccaucggcagcugguccaagaagauccuccgcacccaggagucggagugcgucugcaucaacgggacgugcaccaucgugaugaccgacggcuccgccagcggccgggcggacaccaagauccuguucaucgaggaggggaagaucgugcacaucucgccccuguccggcagcgcccagcacgucgaggagugcuccugcuacccccgcuacccgggggugcggugcgugugccgcgacaacuggaagggcucgaaccggcccaucgucgacaucaacgugaaggacuacuccaucgugagcuccuacgucugcucgggccucgugggggacacgccccgcaagaacgacuccagcuccucgucccacugccugaaccccaacaacgaggagggcgggcacggcgugaaggggugggccuucgacgacggcaacgacgucuggaugggccggaccaucagcgagaaguuccgcuccggguacgagaccuucaaggugaucgagggcuggucgaagccgaacuccaagcugcagaucaaccggcaggucaucguggaccgcgggaaccggagcggcuacuccgggaucuucucgguggagggcaagagcugcaucaaccgcugcuucuacgucgagcucauccggggccgcaagcaggagaccgaggugugguggacguccaacucgaucguggucuucugcgggaccuccggcaccuacgggaccggcagcuggcccgacggggccgacaucaaccugaugcccaucuga

SEQ ID NO: 17183 - RNA, 1410 nt, Artificial Sequence
  derived and/or modified CDS sequence (AUadapt) from InfluenzaA__ABD15573__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacucgaacgacaccguccacgaccgcaccccguaccggacccuccugaugaacgagcugggcgugcccuuccaccucgggacgaagcaggucugcauggccugguccagcuccucgugccacgacggcaaggcguggcugcacgugugcgugaccgggcacgacgagaacgccaccgccuccuucaucuacgacggccgccugguggacagcaucggguccuggucgaagaagauccuccggacccaggaguccgagugcgucugcaucaacggcacgugcaccguggugaugaccgacggcucggccuccgggcgcgcggacaccaagauccuguucaucgaggagggcaagaucguccacaucagccagcugucgggguccgcccagcacguggaggagugcucgugcuacccccgguaccccggcgugcgcugcgucugccgggacaacuggaagggcuccaaccgcccgaucguggacaucaacgugaaggaccacagcaucgucuccucguacgugugcuccgggcucgugggcgacacgccccggaagaacgacagcuccucguccucgcacugccugaaccccaacaacgaggagggcgggcacggggucaagggcugggccuucgacgacggcaacgacguguggauggggcgcaccaucuccgagaagcugcggagcggcuacgagaccuucaaggucaucgaggggugguccaagcccaacucgaagcuccagaucaaccgccaggugaucguggaccggggcaaccgcuccggguacucgggcaucuucuccgucgagggcaagagcugcaucaaccggugcuucuacguggagcugauccgcgggcggaagcaggagaccgaggugugguggacgucgaacuccaucgucguguucugcggcaccagcgggaccuacggcaccggguccuggccggacggcgccgacaucaaccugaugcccaucuga

SEQ ID NO: 17184 - RNA, 1410 nt, Artificial Sequence
  derived and/or modified CDS sequence (AUadapt) from InfluenzaA__ABD15584__NA
augaaccccaaccagaagaucaucaccaucggcucggugucccugaccaucgccacgaucugcuuccucaugcagaucgccauccuggucaccaccgugacccugcacuucaagcaguacgagugcucguccccgcccaacaaccaggugaugcucugcgagcccacgaucaucgagcgcaacaucaccgagaucgucuaccugaccaacaccacgaucgagaaggagaucugccccaagcuggcggaguaccggaacuggagcaagccgcagugcaagaucaccggguucgcccccuucuccaaggacaacucgauccgccucuccgccggcggggacaucugggugacccgggagcccuacgugagcugcgaccccgacaagugcuaccaguucgcccugggccaggggaccacgcugaacaaccgccacuccaacgacaccguccacgaccggaccccguaccgcacccuccugaugaacgagcugggcgugcccuuccaccucggcacgaagcaggucugcaucgccuggucguccagcuccugccacgacgggaaggcguggcugcacgugugcgugaccggccacgacgagaacgccaccgccucguucaucuacgacgggcggcugguggacuccaucggcagcugguccaagaagauccuccgcacccaggagucggagugcgucugcaucaacgggacgugcaccguggugaugaccgacggcuccgccagcggccgggcggacaccaagauccuguucaucgaggaggggaagaucguccacaucucgccccuguccggcagcgcccagcacguggaggagugcuccugcuacccccgcuacccgggggugcggugcgucugccgcgacaacuggaagggcucgaaccggcccaucguggacaucaacgugaaggacuacuccaucgucagcuccuacgugugcucgggccucgugggggacacgccccgcaagaacgacuccagcuccucgucccacugccugaaccccaacaacgaggagggcgggcacggcgucaaggggugggccuucgacgacgagaacgacguguggaugggccggaccaucagcgagaaguuccgcuccggcuacgagaccuucaaggucaucgagggguggucgaagccgaacuccaagcugcagaucaaccgccaggugaucguggaccggggcaaccggagcggguacuccggcaucuucucggucgagggcaagagcugcaucaaccgcugcuucuacguggagcucauccgggggcgcaagcaggagaccgaggugugguggacguccaacucgaucaucgucuucugcggcaccuccgggaccuacggcaccgggagcuggcccgacggcgccgacaucaaccugaugcccaucuga

SEQ ID NO: 17185 - RNA, 1410 nt, Artificial Sequence; identical to SEQ ID NO: 16916
  derived and/or modified CDS sequence (AUadapt) from InfluenzaA__ABD15595__NA

SEQ ID NO: 17186 - RNA, 1410 nt, Artificial Sequence; identical to SEQ ID NO: 16916
  derived and/or modified CDS sequence (AUadapt) from InfluenzaA__ABD15606__NA

SEQ ID NO: 17187 - RNA, 1410 nt, Artificial Sequence; identical to SEQ ID NO: 16916
  derived and/or modified CDS sequence (AUadapt) from InfluenzaA__ABD15617__NA

SEQ ID NO: 17188 - RNA, 1410 nt, Artificial Sequence; identical to SEQ ID NO: 16975
  derived and/or modified CDS sequence (AUadapt) from InfluenzaA__ABD15639__NA

SEQ ID NO: 17189 - RNA, 1410 nt, Artificial Sequence; identical to SEQ ID NO: 17132
  derived and/or modified CDS sequence (AUadapt) from InfluenzaA__ABD15650__NA

SEQ ID NO: 17190 - RNA, 1410 nt, Artificial Sequence; identical to SEQ ID NO: 16655
  derived and/or modified CDS sequence (AUadapt) from InfluenzaA__ABD15661__NA

SEQ ID NO: 17191 - RNA, 1410 nt, Artificial Sequence; identical to SEQ ID NO: 17132
  derived and/or modified CDS sequence (AUadapt) from InfluenzaA__ABD15683__NA

SEQ ID NO: 17192 - RNA, 1410 nt, Artificial Sequence; identical to SEQ ID NO: 16655
  derived and/or modified CDS sequence (AUadapt) from InfluenzaA__ABD15694__NA

SEQ ID NO: 17193 - RNA, 1410 nt, Artificial Sequence; identical to SEQ ID NO: 17132
  derived and/or modified CDS sequence (AUadapt) from InfluenzaA__ABD15705__NA

SEQ ID NO: 17194 - RNA, 1410 nt, Artificial Sequence; identical to SEQ ID NO: 17132
  derived and/or modified CDS sequence (AUadapt) from InfluenzaA__ABD15727__NA

SEQ ID NO: 17195 - RNA, 1410 nt, Artificial Sequence
  derived and/or modified CDS sequence (AUadapt) from InfluenzaA__ABD15749__NA
augaaccccaaccagaagaucaucaccaucggcucggugucccugaccaucgccacgaucugcuuccucaugcagaucgccguccuggugaccaccgugacccugcacuucaagcaguacgagugcaacucgccgcccaacaaccaggucaugcucugcgagcccacgaucaucgagcgcaacaucaccgagaucguguaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacgucuccugcgaccccgacaagugcuaccaguucgcccugggccaggggaccacgcugaacaacggccacagcaacgacaccgugcacgaccgcaccccguaccggacccuccugaugaacgagcugggcgugcccuuccaccucgggacgaagcaggucugcaucgccugguccucguccucgugccacgacggcaaggcguggcugcacgugugcgugaccggggacgacgagaacgccaccgccuccuucaucuacaacggccgccuggucgacagcaucggguccuggucgaagaagauccuccggacccaggaguccgagugcgugugcaucaacggcacgugcaccguggucaugaccgacggcagcgccuccgggaaggcggacaccaagauccuguucaucgaggagggcaagaucgugcacacgucgcugcucagcggguccgcccagcacguggaggagugcucgugcuacccccgcuaccccggcguccggugcgugugccgcgacaacuggaagggcuccaaccggccgaucguggacaucaacgucaaggacuacucgaucguguccagcuacgugugcuccgggcuggucggcgacacgccccgcaagaacgacucguccagcuccucgcacugccuggaccccaacaacgaggagggcgggcacggggugaagggcugggccuucgacgacggcaacgacgucuggauggggcggaccaucuccgagaagcuccgcucgggcuacgagaccuucaaggugaucgaggggugguccaagcccaacagcaagcugcagaucaaccgccaggugaucgucgaccggggcaaccgguccggguacucgggcaucuucuccguggagggcaagagcugcaucaaccgcugcuucuacguggagcugauccgggggcgcaagcaggagaccgagguccucuggaccucgaacuccaucgugguguucugcggcaccagcgggaccuacggcacgggguccuggccggacggcgccgacaucaaccugaugcccaucuga

SEQ ID NO: 17196 - RNA, 1410 nt, Artificial Sequence; identical to SEQ ID NO: 17195
  derived and/or modified CDS sequence (AUadapt) from InfluenzaA__ABD15760__NA

SEQ ID NO: 17197 - RNA, 1410 nt, Artificial Sequence; identical to SEQ ID NO: 17132
  derived and/or modified CDS sequence (AUadapt) from InfluenzaA__ABD15771__NA

SEQ ID NO: 17198 - RNA, 1410 nt, Artificial Sequence; identical to SEQ ID NO: 17132
  derived and/or modified CDS sequence (AUadapt) from InfluenzaA__ABD15782__NA

SEQ ID NO: 17199 - RNA, 1410 nt, Artificial Sequence; identical to SEQ ID NO: 17132
  derived and/or modified CDS sequence (AUadapt) from InfluenzaA__ABD15793__NA

SEQ ID NO: 17200 - RNA, 1410 nt, Artificial Sequence; identical to SEQ ID NO: 17116
  derived and/or modified CDS sequence (AUadapt) from InfluenzaA__ABD16306__NA

SEQ ID NO: 17201 - RNA, 1410 nt, Artificial Sequence
  derived and/or modified CDS sequence (AUadapt) from InfluenzaA__ABD16317__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcggcugguggacuccaucgucagcugguccaaggagauccugcgcacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgguaccccggcguccgcugcgugugccgggacaacuggaaggggucgaaccgcccgaucguggacaucaacaucaaggacuacuccaucgucagcuccuacgugugcucgggccuggugggcgacacgccccggaagaacgacuccagcuccagcucccacugccucgaccccaacaacgaggagggcgggcacggggucaagggcugggccuucgacgacgggaacgacguguggaugggccgcaccaucucggagaagcugcgguccggcuacgagaccuucaaggucaucgagggguggagcaaccccaacuccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 17202 - RNA, 1410 nt, Artificial Sequence; identical to SEQ ID NO: 17116
  derived and/or modified CDS sequence (AUadapt) from InfluenzaA__ABD16328__NA

SEQ ID NO: 17203 - RNA, 1410 nt, Artificial Sequence
  derived and/or modified CDS sequence (AUadapt) from InfluenzaA__ABD16339__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucucgugguccaagaagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccucggggcacugccucgaccccaacaacgaggagggcgggcacggcgucaaggggugggccuucgacgacggcaacgacguguggaugggccggaccaucuccgagaagcugcgcagcggguacgagaccuucaaggucaucgagggcugguccaaccccaacucgaagcugcagaucaaccgccaggugaucguggaccgggggaaccgguccggcuacagcgggaucuucuccgucgagggcaagucgugcaucaaccgcugcuucuacguggagcucauccggggccgcaaggaggagaccgaggugcuguggaccagcaacuccaucgucguguucugcgggaccagcggcacguacgggaccggcuccuggccggacggggccgacaucaaccugaugcccaucuga

SEQ ID NO: 17204 - RNA, 1410 nt, Artificial Sequence
  derived and/or modified CDS sequence (AUadapt) from InfluenzaA__ABD16361__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggaagcugguggacuccaucgucagcugguccaagaagauccugcgcacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgguaccccggcguccgcugcgugugccgggacaacuggaaggggucgaaccgcccgaucguggacaucaacaucaaggacuacuccaucgucagcuccuacgugugcucgggccuggugggcgacacgccccggaagaacgacuccagcuccagcucccacugccucgaccccaacaacgaggagggcgggcacggggucaagggcugggccuucgacgacgggaacgacguguggaugggccgcaccaucucggagaagcugcgguccggcuacgagaccuucaaggucaucgagggguggagcaaccccaacuccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 17205 - RNA, 1410 nt, Artificial Sequence; identical to SEQ ID NO: 17116
  derived and/or modified CDS sequence (AUadapt) from InfluenzaA__ABD16475__NA

SEQ ID NO: 17206 - RNA, 1410 nt, Artificial Sequence; identical to SEQ ID NO: 17116
  derived and/or modified CDS sequence (AUadapt) from InfluenzaA__ABD16486__NA

SEQ ID NO: 17207 - RNA, 1410 nt, Artificial Sequence; identical to SEQ ID NO: 17143
  derived and/or modified CDS sequence (AUadapt) from InfluenzaA__ABD16497__NA

SEQ ID NO: 17208 - RNA, 1410 nt, Artificial Sequence; identical to SEQ ID NO: 17116
  derived and/or modified CDS sequence (AUadapt) from InfluenzaA__ABD16508__NA

SEQ ID NO: 17209 - RNA, 1410 nt, Artificial Sequence
  derived and/or modified CDS sequence (AUadapt) from InfluenzaA__ABD16519__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccucguucaucuacaacgggcgccugguggacuccaucgucagcugguccaaggacauccugcggacccaggagucggagugcgugugcaucaacggcacgugcaccguggucaugaccgacggguccgccagcggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggacuacuccaucgucucguccuacgugugcagcggccuggugggcgacacgccccgcaagaccgacuccucguccagcucccacugccucgaccccaacaacgaggagggcgggcacggggucaagggcugggccuucgacgacgggaacgacguguggaugggccggaccaucagcgagaagcugcgccugggcuacgagaccuucaaggucaucgaggggugguccaaccccaacucgaagcuccagaucaaccgccaggugaucguggaccggggcaaccgguccggguacagcggcaucuucuccgucgagggcaagucgugcaucaaccgcugcuucuacguggagcugauccgggggcgcaaggaggagaccgaggugcuguggaccagcaacuccaucgucguguucugcggcacgagcgggaccuacggcaccggguccuggccggacggcgccgacaucaaccucaugcccaucuga

SEQ ID NO: 17210 - RNA, 1410 nt, Artificial Sequence
  derived and/or modified CDS sequence (AUadapt) from InfluenzaA__ABD16530__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucgagcgcaacaucaccgagaucgucuaccugaccaacaccacgaucgagaaggagaucugccccaagcugguggaguaccggaacugguccaagccgcagugcaacaucaccggguucgcgcccuucagcaaggacaacuccauccgccucucggccggcggggacaucugggugacccgggagcccuacgucuccugcgaccccgacaagugcuaccaguucgcccugggccaggggaccacgcugaacaacggccacagcaacgacaccgugcacgaccgcaccccguaccggacccuccugaugaacgagcugggcgugcccuuccaccucgggacgcgccaggucugcaucgccugguccucguccagcugccacgacggcaaggccuggcugcacgugugcgugaccggggacgacaagaacgcgaccgccuccuucaucuacaacggccggcuggucgacucgaucggguccuggucgaagaagauccuccgcacccaggaguccgagugcgugugcaucaacggcacgugcaccguggucaugaccgacggcagcgccuccgggaaggccgacaccaagauccuguucaucgaggagggcaagaucgugcacaucucgacgcugagcggguccgcgcagcacguggaggagugcucgugcuacccccgguaccccggcguccgcugcgugugccgggacaacuggaagggcuccaaccgcccgaucguggacaucaacgucaaggacuacagcaucguguccucguacgugugcuccgggcucgucggcgacacgccccggaagaacgacucguucuccagcucccacugccuggaccccaacaacgaggagggcgggcacggggugaagggcugggccuucgacgacggcaacgacgucuggauggggcgcaccaucucggagaagcugcgguccggcuacgagaccuucaaggugaucgagggguggagcaagcccaacuccaagcuccagaucaaccgccaggugaucgucgagcggggcaaccgcucgggguacuccggcaucuucagcguggagggcaagcggugcaucaaccgcugcuucuacguggagcugauccgggggcgcaaggaggagaccgaggucugguggaccuccaacucgaucgugguguucugcggcaccagcgggaccuacggcacgggguccuggccggacggcgccgacaucaaccugaugcccaucuga

SEQ ID NO: 17211 - RNA, 1410 nt, Artificial Sequence; identical to SEQ ID NO: 16993
  derived and/or modified CDS sequence (AUadapt) from InfluenzaA__ABD16541__NA

SEQ ID NO: 17212 - RNA, 1410 nt, Artificial Sequence; identical to SEQ ID NO: 17116
  derived and/or modified CDS sequence (AUadapt) from InfluenzaA__ABD16552__NA

SEQ ID NO: 17213 - RNA, 1410 nt, Artificial Sequence; identical to SEQ ID NO: 17115
  derived and/or modified CDS sequence (AUadapt) from InfluenzaA__ABD16563__NA

SEQ ID NO: 17214 - RNA, 1410 nt, Artificial Sequence
  derived and/or modified CDS sequence (AUadapt) from InfluenzaA__ABD16574__NA
augaaccccaaccagaagaucaucaccaucggcucggugucccugaccaucgccacgaucugcuuccucaugcagaucgccauccuggucaccaccgugacccugcacuucaagcaguacgagugcucguccccgcccaacaaccaggugaugcccugcgagcccacgaucaucgagcgcaacaucaccgagaucgucuaccucaccaacaccacgaucgagaaggagaucugcccgaagcugguggaguaccggaacuggagcaagccccagugcaagaucaccggguucgcgcccuucuccaaggacaacucgauccgccuguccgccggcggggacaucugggugacccgggagcccuacgucagcugcgacccgggcaagugcuaccaguucgcccucgggcagggcaccacgcugaacaaccgccacuccaacgacaccgugcacgaccggacccccuaccgcacccugcucaugaacgagcugggcgugcccuuccaccuggggacgaagcaggucugcaucgccuggucguccagcuccugccacgacggcaaggccuggcuccacgugugcgugaccgggcacgacgagaacgcgaccgccucguucaucuacgacggccggcuggucgacuccaucgggucgugguccaagaacauccugcgcacccaggagagcgagugcgugugcaucaacggcacgugcaccguggucaugaccgacggcuccgccucggagcgggccgacaccaagauccucuucaucgaggaggggaagaucgugcacaucagcccccuguccggcucggcgcagcacguggaggagugcuccugcuacccgcgcuaccccgggguccggugcgugugccgcgacaacuggaagggcagcaaccggcccaucguggacaucaacgucaaggacuacuccaucgugucguccuacgugugcagcggccuggucggggacacgccccgcaagaacgaccgguccucguccucguacugccgcaacccgaacaacgagaagggcucccacggggugaagggcugggccuucgacgacgggaacgacgucuggaugggccggaccaucggcgaggagcuccgcagcggguacgagaccuucaaggugaucggcgggugguccacccccaacucgaagcugcagaucaaccgccaggugaucgucgacuccggcaaccggagcggguacuccggcaucuucucgguggagggcaagagcugcaucaaccggugcuucuacguggagcugauccgcgggcgcaagaaggagacgcgggucugguggaccuccaacucgaucgugguguucugcggcaccuccgggaccuacggcacggggagcuggcccgacggcgccgacaucaaccucaugcccaucuga

SEQ ID NO: 17215 - RNA, 1410 nt, Artificial Sequence
  derived and/or modified CDS sequence (AUadapt) from InfluenzaA__ABD16585__NA
augaaccccaaccagaagaucaucaccaucggcucggugucccugaccaucgccacgaucugcuuccucaugcagaucgccauccuggucaccaccgugacccugcacuucaagcaguacgagugcucguccccgcccaacaaccaggugaugcccugcgagcccacgaucaucgagcgcaacaucaccgagaucgucuaccucaccaacaccacgaucgagaaggagaucugcccgaagcugguggaguaccggaacuggagcaagccccagugcaagaucaccggguucgcgcccuucuccaaggacaacucgauccgccuguccgccggcggggacaucugggugacccgggagcccuacgucagcugcgacccgggcaagugcuaccaguucgcccucgggcagggcaccacgcugaacaaccgccacuccaacgacaccgugcacgaccggacccccuaccgcacccugcucaugaacgagcugggcgugcccuuccaccuggggacgaagcaggucugcaucgccuggucguccagcuccugccacgacggcaaggccuggcuccacgugugcgugaccgggcacgacaagaacgcgaccgccucguucaucuacgacggccggcuggucgacuccaucgggucgugguccaagaacauccugcgcacccaggagagcgagugcgugugcaucaacggcacgugcaccguggucaugaccgacggcuccgccucggagcgggccgacaccaagauccucuucaucgaggaggggaagaucgugcacaucagcccccuguccggcucggcgcagcacguggaggagugcuccugcuacccgcgcuaccccgggguccggugcgugugccgcgacaacuggaagggcagcaaccggcccaucguggacaucaacgucaaggacuacuccaucgugucguccuacgugugcagcggccuggucggggacacgccccgcaagaacgaccgguccucguccucguacugccgcaacccgaacaacgagaagggcucccacggggugaagggcugggccuucgacgacgggaacgacgucuggaugggccggaccaucggcgaggagcuccgcagcggguacgagaccuucaaggugaucggcgggugguccacccccaacucgaagcugcagaucaaccgccaggugaucgucgacuccggcaaccggagcggguacuccggcaucuucucgguggagggcaagagcugcaucaaccggugcuucuacguggagcugauccgcgggcgcgagcaggagacgcgggucugguggaccuccaacucgaucgugguguucugcggcaccuccgggaccuacggcacggggagcuggcccgacggcgccgacaucaaccucaugcccaucuga

SEQ ID NO: 17216 - RNA, 1410 nt, Artificial Sequence
  derived and/or modified CDS sequence (AUadapt) from InfluenzaA__ABD16721__NA
augaaccccaaccagaagaucaucaccaucggcucggugucccugaccaucgccacgaucugcuuccucaugcagaucgccauccuggucaccaccgugacccugcacuucaagcaguacgagugcucguccccgcccaacaaccaggugaugcccugcgagcccaucaucaucgagcgcaacaucacgaagaucgucuaccucaccaacaccaccaucgagaaggagaucugcccgaagcugguggaguaccggaacuggagcaagccccagugcaagaucacgggguucgcgcccuucuccaaggacaacucgauccgccuguccgccggcggggacaucugggugacccgggagcccuacgucagcugcgacccgggcaagugcuaccaguucgcccucgggcagggcaccacccugaacaacaagcacuccaacgacacgauccacgaccgcacccccuaccggacccugcucaugaacgagcugggcgugcccuuccaccuggggaccaagcaggucugcaucgccuggucguccagcuccugccacgacggcaaggccuggcuccacgugugcgugacggggcacgacaagaacgcgaccgccucguucaucuacgacggccgccugguggacuccaucgggagcugguccaagaacauccugcggacccaggagucggagugcgucugcaucaacgggaccugcacgguggugaugaccgacggcuccgccagcgagcgcgccgacaccaagauccucuucaucgaggagggcaagaucguccacaucucgccccuguccggcucggcgcagcacguggaggagugcuccugcuacccgcgguaccccggggugcgcugcgucugccgggacaacuggaagggcagcaaccgccccaucguggacaucaacgugaaggacuacuccaucgucucguccuacgugugcagcggccuggugggggacacgccccggaagaacgaccgcuccucguccagcuacugccagaacccgaacaacgagaagggcaaccacggggucaagggcugggccuucgacgacgggaacgacguguggaugggccggaccaucggcgaggagcuccgcuccggguacgagaccuucaaggucaucggcggguggucgacccccaacuccaagcugcagaucaaccgccaggugaucguggacagcaagaaccgguccggcuacucggggaucuucuccgucgagggcaagagcugcaucaaccggugcuucuacguggagcugauccgcggccgggagcaggagacccgcgugugguggacgucgaacuccaucgucguguucugcgggaccagcggcaccuacgggaccggcuccuggcccgacggggccgacaucaaccucaugcccaucuga

SEQ ID NO: 17217 - RNA, 1410 nt, Artificial Sequence; identical to SEQ ID NO: 16886
  derived and/or modified CDS sequence (AUadapt) from InfluenzaA__ABD16732__NA

SEQ ID NO: 17218 - RNA, 1410 nt, Artificial Sequence
  derived and/or modified CDS sequence (AUadapt) from InfluenzaA__ABD16743__NA
augaaccccaaccagaagaucaucaccaucggcucggugucccugaccaucgccacgaucugcuuccucaugcagaucgccauccuggucaccaccgugacccugcacuucaagcaguacgagugcgacucgccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccauccgccugucggccggcggggacaucugggugacccgggagcccuacgucuccugcgaccccggcaagugcuaccaguucgcccucgggcagggcaccacccuggacaacaagcacucgaacgacacgauccacgaccgcaccccgcaccggacccugcucaugaacgagcugggcgugcccuuccaccuggggacccgccaggugugcaucgccugguccagcuccucgugccacgacggcaaggcguggcuccacgucugcgugacgggguacgacaagaacgccaccgccuccuucaucuacgacggccggcugguggacucgaucggguccuggagccagaacauccugcgcacccaggaguccgagugcgucugcaucaacgggaccugcacgguggugaugaccgacggcucggccuccggccgggcggacaccaagauccucuucaucgaggagggcaagaucguccacaccucgccccugagcggguccgcccagcacguggaggagugcucgugcuacccccgcuacccgggcgugcggugcaucugccgcgacaacuggaagggcuccaaccggcccgucguggacaucaacgugaaggacuacagcaucgacuccucguacgucugcuccgggcuggugggcgacacgccccgcaacaacgaccggucguccagcuccuacugccgcaaccccaacaacgagaaggggacccacggcgugaaggggugggccuucgacgacggcaacgacgucuggaugggccggaccaucucggaggacucccgcucgggguacgagaccuucaaggugaucggcgggugguccacgccgaacagcaagcuccagaugaaccggcaggucaucguggacuccgacaaccgcucgggcuacuccgggaucuucucgguggagggcaagagcugcaucaaccggugcuucuacgucgagcugauccgcggccgcgagcaggagacccgggugugguggaccuccaacucgaucguggucuucugcgggaccuccggcacguacgggaccggcagcuggcccgacggggccgacaucaaccugaugcccaucuga

SEQ ID NO: 17219 - RNA, 1410 nt, Artificial Sequence; identical to SEQ ID NO: 16978
  derived and/or modified CDS sequence (AUadapt) from InfluenzaA__ABD16754__NA

SEQ ID NO: 17220 - RNA, 1410 nt, Artificial Sequence; identical to SEQ ID NO: 17076
  derived and/or modified CDS sequence (AUadapt) from InfluenzaA__ABD16765__NA

SEQ ID NO: 17221 - RNA, 1410 nt, Artificial Sequence; identical to SEQ ID NO: 16520
  derived and/or modified CDS sequence (AUadapt) from InfluenzaA__ABD17326__NA

SEQ ID NO: 17222 - RNA, 1410 nt, Artificial Sequence
  derived and/or modified CDS sequence (AUadapt) from InfluenzaA__ABD38137__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacucgaacgacaccguccacgaccgcaccccguaccggacccuccugaugaacgagcugggcgugcccuuccaccucgggacgcgccaggugugcaucgccugguccagcuccucgugccacgacggcaaggcguggcugcacgucugcgugaccggggacgacgagaacgccaccgccuccuucaucuacaacggccggcugguggacagcaucggguccuggucgaagaagauccuccgcacccaggaguccgagugcgucugcaucaacggcacgugcaccguggugaugaccgacggcucggccuccgggaaggcggacaccaagauccuguucaucgaggagggcaagaucguccacaucagcacgcugucgggguccgcccagcacguggaggagugcagcugcuacccccgguaccccggcgugcgcugcgucugccgggacaacuggaagggcuccaaccgcccgaucaucgacaucaacgugaaggacuacucgaucguguccucguacgucugcuccgggcucgugggcgacacgccccggaagaacgacagcuucuccucgucccacugccuggaccccaacaacgaggagggcgggcacggggugaagggcugggccuucgacgacggcaacgacgucuggauggggcgcaccaucagcgagaagcugcgguccggcuacgagaccuucaaggugaucgagggguggucgaagcccaacuccaagcuccagaccaaccgccaggucaucguggagcggggcaaccgcucgggguacuccggcaucuucagcguggagggcaaguccugcaucaaccggugcuucuacgucgagcugauccgcgggcggaaggaggagccggaggugugguggaccucgaacagcaucguggucuucugcggcacccccgggaccuacggcacgggguccuggcccgacggcgccgacaucaaccugaugcccaucuga

SEQ ID NO: 17223 - RNA, 1413 nt, Artificial Sequence; identical to SEQ ID NO: 16788
  derived and/or modified CDS sequence (AUadapt) from InfluenzaA__ABD60782__NA

SEQ ID NO: 17224 - RNA, 1410 nt, Artificial Sequence
  derived and/or modified CDS sequence (AUadapt) from InfluenzaA__ABD60793__NA
augaaccccaaccagaagaucaucaccaucggcucggugucccugaccaucgccacgaucugcuuccucaugcagaucgccauccuggucaccaccgugacccugcacuucaagcaguacgagugcgacucgccggugaacaaccaggucaugcccugcgagcccaucaucaucgagcgcaacaucacggagaucguguaccucaccaacaccaccaucgagaaggagaucugccccaagcugguggaguaccggaacugguccaagccgcagugcaagaucacgggguucgcgcccuucagcaaggacaacuccauccgccugucggccggcggggacaucugggucacccgggagcccuacguguccugcgaccccggcaagugcuaccaguucgcccucgggcagggcaccacccuggacaacaagcacagcaacgacacgauccacgaccgcaccccgcaccggacccugcucaugaacgagcugggcgugcccuuccaccuggggacccgccaggucugcaucgccugguccucguccagcugccacgacggcaaggccuggcuccacgugugcgugacgggguacgacaagaacgcgaccgccuccuucaucuacgacggccggcuggucgacucgaucguguccuggagccagaacauccugcgcacccaggaguccgagugcgugugcaucaacgggaccugcacggucgugaugaccgacggcucggccuccgagcgggccgacaccaagauccucuucaucgaggagggcaagaucgugcacaucagcccccugucgggguccgcgcagcacgucgaggagugcucgugcuacccccgcuacccgggcgugcggugcaucugccgcgacaacuggaagggguccaaccggcccguggucgacaucaacgugaaggacuacagcaucgacuccucguacgugugcuccggccuggucggcgacacgccccgcaacaacgaccggagcuccaacucguacugccgcaaccccaacaacgagaaggggaaccacggcgugaaggggugggccuucgacgacggcaacgaccucuggauggggcggaccaucuccgaggacagccgcuccggcuacgagaccuucaaggucaucggcggguggucgaccccgaacuccaagcugcagaucaaccgccaggugaucguggacagcgacaaccgguccggcuacucggggaucuucuccgucgagggcaagagcugcaucaaccggugcuucuacguggagcugauccgcgggcgcgagcaggagacccgggugugguggacgucgaacuccaucaucgucuucugcggcaccagcggcaccuacgggaccggcuccuggcccgacggggccgacaucaaccucaugcccaucuga

SEQ ID NO: 17225 - RNA, 1410 nt, Artificial Sequence; identical to SEQ ID NO: 16921
  derived and/or modified CDS sequence (AUadapt) from InfluenzaA__ABD60804__NA

SEQ ID NO: 17226 - RNA, 1410 nt, Artificial Sequence; identical to SEQ ID NO: 17114
  derived and/or modified CDS sequence (AUadapt) from InfluenzaA__ABD60815__NA

SEQ ID NO: 17227 - RNA, 1410 nt, Artificial Sequence; identical to SEQ ID NO: 17116
  derived and/or modified CDS sequence (AUadapt) from InfluenzaA__ABD60826__NA

SEQ ID NO: 17228 - RNA, 1410 nt, Artificial Sequence; identical to SEQ ID NO: 17195
  derived and/or modified CDS sequence (AUadapt) from InfluenzaA__ABD60837__NA

SEQ ID NO: 17229 - RNA, 1410 nt, Artificial Sequence
  derived and/or modified CDS sequence (AUadapt) from InfluenzaA__ABD60848__NA
augaaccccaaccagaagaucaucaccaucggcucggugucccugaccaucgccacgaucugcuuccucaugcaggucgccauccuggugaccaccgugacccugcacuucaagcaguacgagugcaacucgccgcccaacaaccaggucaugcucugcgagcccacgaucaucgagcgcaacaucaccgagaucguguaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacgucuccugcgaccccgacaagugcuaccaguucgcccugggccaggggaccacgcugaacaacggccacagcaacgacaccgugcacgaccgcaccccguaccggacccuccugaugaacgagcugggcgugcccuuccaccucgggacgaagcaggucugcaucgccugguccucguccucgugccacgacggcaaggcguggcugcacgugugcgugaccggggacgacgagaacgccaccgccuccuucaucuacaacggccgccuggucgacagcaucggguccuggucgaagaagauccuccggacccaggaguccgagugcgugugcaucaacggcacgugcaccguggucaugaccgacggcagcgccuccgggaaggcggacaccaagauccuguucaucgaggagggcaagaucgugcacacgucgcugcucagcggguccgcccagcacguggaggagugcucgugcuacccccgcuaccccggcguccggugcgugugccgcgacaacuggaagggcuccaaccggccgaucguggacaucaacgucaaggacuacucgaucguguccagcuacgugugcuccgggcuggucggcgacacgccccgcaagaacgacucguccagcuccucgcacugccuggaccccaacaacgaggagggcgggcacggggugaagggcugggccuucgacgacggcaacgacgucuggauggggcggaccaucuccgagaagcuccgcucgggcuacgagaccuucaaggugaucgaggggugguccaagcccaacagcaagcugcagaucaaccgccaggugaucgucgaccggggcaaccgguccggguacucgggcaucuucuccguggagggcaagagcugcaucaaccgcugcuucuacguggagcugauccgggggcgcaagcaggagaccgagguccucuggaccucgaacuccaucgugguguucugcggcaccagcgggaccuacggcacgggguccuggccggacggcgccgacaucaaccugaugcccaucuga

SEQ ID NO: 17230 - RNA, 1413 nt, Artificial Sequence
  derived and/or modified CDS sequence (AUadapt) from InfluenzaA__ABD60881__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagucggagugcgugugcgugaacggcuccugcuucaccaucaugacggacgggcccagcaacggcgccgccuccuacaagaucuucaagaucgagaaggggaaggucaccaagucgaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcucgggcguguucggggacaacccccgccccaaggacggcgagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccgacaccgacagcaacuucuccgucaagcaggacgugguggccaucacggacuggucgggguacagcggcuccuucguccagcaccccgagcucaccggccuggacugcauccgccccugcuucuggguggagcugguccgggggcucccgcgcgagaacaccaccaucuggacgucgggcuccagcaucuccuucugcggggugaacagcgacaccgccaacugguccuggcccgacggcgccgagcugcccuucaccaucgacaaguga

SEQ ID NO: 17231 - RNA, 1413 nt, Artificial Sequence
  derived and/or modified CDS sequence (AUadapt) from InfluenzaA__ABD60892__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcgugaucaccuacgagaacuccaccugggucaaccacaccuacgugaacaucaacaacacgaacguggucgcggggaaggacaagaccucggugacccuggccggcaacuccagccugugcuccaucagcggcugggccaucuacaccaaggacaacuccauccggaucgggucgaagggcgacguguucgucauccgcgagccguucaucuccugcagccaccucgagugccggacguucuuccugacccagggggcccugcucaacgacaagcacuccaacggcaccgugaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcggucgccgugcugaaguacaacggcaucaucacggagaccaucaaguccuggaagaagcgcauccugcggacccaggagucggagugcgugugcgucaacggcuccugcuucaccaucaugacggacgggcccagcaacggcgccgccuccuacaagaucuucaagaucgagaaggggaaggugaccaagucgaucgagcucaacgcccccaacuuccacuacgaggagugcuccugcuacccggacaccggcaccgugaugugcgucugccgcgacaacuggcacgggagcaaccggcccuggguguccuucaaccagaaccuggacuaccagaucggcuacaucugcucgggcguguucggggacaacccccgccccaaggacggcgagggguccugcaacccggucacgguggacggcgcggacggggugaagggcuucagcuacaaguacggcaacggggucuggaucggccggaccaaguccaaccgccugcggaagggguucgagaugaucugggaccccaacggcuggaccgacaccgacagcaacuucuccgugaagcaggacguggucgccaucacggacuggucgggguacagcggcuccuucgugcagcaccccgagcucaccggccuggacugcauccgccccugcuucugggucgagcuggugcgggggcucccgcgcgagaacaccaccaucuggacgucgggcuccagcaucuccuucugcggggugaacagcgacaccgccaacugguccuggcccgacggcgccgagcugcccuucaccaucgacaaguga

SEQ ID NO: 17232 - RNA, 1413 nt, Artificial Sequence; identical to SEQ ID NO: 17230
  derived and/or modified CDS sequence (AUadapt) from InfluenzaA__ABD60903__NA

SEQ ID NO: 17233 - RNA, 1413 nt, Artificial Sequence; identical to SEQ ID NO: 16817
  derived and/or modified CDS sequence (AUadapt) from InfluenzaA__ABD60914__NA

SEQ ID NO: 17234 - RNA, 1410 nt, Artificial Sequence
  derived and/or modified CDS sequence (AUadapt) from InfluenzaA__ABD60925__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccucgugccacgacggcaaggcguggcugcacgucugcgugaccggggacgacaagaacgccaccgccuccuucaucuacaacggccggcugguggacagcaucggguccuggucgaagaagauccuccgcacccaggaguccgagugcgucugcaucaacggcacgugcaccguggugaugaccgacggcagcgccuccgggaaggcggacaccaagauccuguucaucgaggagggcaagaucguccacaucucgacgcugagcggguccgcccagcacguggaggagugcucgugcuacccccgguaccccggcgugcgcugcgucugccgggacaacuggaagggcuccaaccgcccgaucguggacaucaacaucaaggacuacucgaucguguccagcuacgucugcuccgggcucgugggcgacacgccccggaagaacgacucguucuccagcucccacugccuggaccccaacaacgaggagggcgggcacggggugaagggcugggccuucgacgacggcaacgacgucuggauggggcgcaccaucucggagaagcugcgguccggcuacgagaccuucaaggugaucgagggguggucgaagcccaacuccaagcuccagaucaaccgccaggucaucguggagcggggcaaccgcagcggguacuccggcaucuucucgguggagggcaaguccugcaucaaccggugcuucuacgucgagcugauccgcgggcggaaggaggagaccgaggugugguggaccagcaacucgaucguggucuucugcggcaccuccgggaccuacggcacggggagcuggccggacggcgccgacaucaaccugaugcccaucuga

SEQ ID NO: 17235 - RNA, 1413 nt, Artificial Sequence
  derived and/or modified CDS sequence (AUadapt) from InfluenzaA__ABD60947__NA
augaaccccaaccagaagaucaucaccaucggcucgaucugcauggccaucgggaucaucucccugauccuccagaucggcaacaucaucagcaucugggugucccacucgauccagaccgggucccagaaccacacgggcaucugcaaccagcgcaucaucaccuacgagaacagcaccugggucaaccagaccuacgugaacaucuccaacacgaacguggucgccgggaaggacaccaccucgaugacccuggcgggcaacuccagccugugcccgauccggggcugggccaucuacuccaaggacaacagcauccgcaucggguccaagggcgacguguucgugauccgggagcccuucaucucgugcucccaccucgagugccgcacguucuuccugacccagggggcccugcucaacgacaagcacagcaacggcaccaucaaggaccggucccccuaccgcgcccugaugucgugccccaucggggaggccccgucccccuacaacagccgguucgagagcgucgcgugguccgccucggccugccacgacggcaugggcuggcugaccaucgggaucuccggccccgacgacggggccguggcggugcucaaguacaacggcaucaucacggagaccaucaagagcuggcgcaagcagauccugcggacccaggaguccgagugcgucugcgugaacggcucgugcuucaccaucaugacggacgggcccuccgacggcccggccagcuaccgcaucuucaagaucgagaaggggaagaucaccaaguccaucgagcuggacgcccccaacagccacuacgaggagugcuccugcuaccccgacaccggcaccgugaugugcgucugccgggacaacuggcacgggucgaaccgccccuggguguccuucaaccagaaccucgacuaccagaucggcuacaucugcagcggcguguucggggacaacccgcggcccaaggacggcaagggguccugcgaccccgucaacguggacggcgccgacggggugaagggcuucucguaccgcuacggcaacggggucuggaucggccggacgaaguccaacagcucccgcaagggguucgagaugaucugggaccccaacggcuggaccgacaccgacagcaacuuccuggugaagcaggacguggucgccaugaccgacuggucgggguacuccggcagcuucgugcagcacccggagcugacgggccucgacugcaugcggcccugcuucuggguggagcugauccgcgggcggccccgcgagaagaccaccaucuggaccuccggcucguccaucagcuucugcggggucaacuccgacacggugaacuggagcuggcccgacggcgcggagcugccguucaccaucgacaaguga

SEQ ID NO: 17236 - RNA, 1410 nt, Artificial Sequence
  derived and/or modified CDS sequence (AUadapt) from InfluenzaA__ABD61263__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccucgugccacgacggcaaggcguggcugcacgucugcgugaccggggacgacaagaacgccaccgccuccuucaucuacaacggccggcugguggacagcaucggguccuggucgaagaagauccuccgcacccaggaguccgagugcgucugcaucaacggcacgugcaccguggugaugaccgacggcagcgccuccgggaaggcggacaccaagauccuguucaucgaggagggcaagaucguccacaucucgacgcugagcggguccgcccagcacguggaggagugcucgugcuacccccgguaccccggcgugcgcugcgucugccgggacaacuggaagggcuccaaccgcccgaucguggacaucaacgugaaggacuacucgaucgucuccagcuacgugugcuccgggcucgugggcgacacgccccggaagaacgacucguucuccagcucccacugccuggaccccaacaacgaggagggcgggcacgggaugaagggcugggccuucgacgacggcaacgacgucuggauggggcgcaccaucucggagaagcugcgguccggcuacgagaccuucaaggugaucgagggguggucgaagcccaacuccaagcuccaggucaaccgccaggugaucguggagcggggcaaccgcagcggguacuccggcaucuucucggucgagggcaaguccugcaucaaccggugcuucuacguggagcugauccgcgggcggaaggaggagaccgaggugugguggaccagcaacucgaucgucguguucugcggcaccuccgggaccuacggcacggggagcuggccggacggcgccgacaucaaccugaugcccaucuga

SEQ ID NO: 17237 - RNA, 1410 nt, Artificial Sequence; identical to SEQ ID NO: 16547
  derived and/or modified CDS sequence (AUadapt) from InfluenzaA__ABD61274__NA

SEQ ID NO: 17238 - RNA, 1410 nt, Artificial Sequence
  derived and/or modified CDS sequence (AUadapt) from InfluenzaA__ABD61285__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucucgugguccaaggagauccugcggacccaggagagcgagugcgugugcaucaacggcacgugcaccguggucaugaccgacgggaacgccuccggcaaggccgacaccaagauccucuucaucgaggagggcaagaucgugcacacgucgacccugagcggguccgcgcagcacguggaggagugcagcugcuacccccgcuaccccggcguccggugcgugugccgcgacaacuggaagggguccaaccggccgaucguggacaucaacaucaaggacuacucgaucgucuccagcuacgugugcuccggccuggugggcgacacgccccgcaagaacgacucguccagcuccucgcacugccucgaccccaacaacgaggagggcgggcacggggucaagggcugggccuucgacgacgggaacgacguguggaugggccggaccaucuccgagaagcugcgcagcggcuacgagaccuucaaggucaucgaggggugguccaaccccaacucgaagcugcagaucaaccgccaggugaucguggaccggggcaaccgguccggguacagcggcaucuucuccgucgagggcaagucgugcaucaaccgcugcuucuacguggagcucauccgggggcgcaaggaggagaccgaggugcuguggaccagcaacuccaucgucguguucugcggcaccagcgggacguacggcaccggguccuggccggacggcgccgacaucaaccugaugcccaucuga

SEQ ID NO: 17239 - RNA, 1410 nt, Artificial Sequence; identical to SEQ ID NO: 16993
  derived and/or modified CDS sequence (AUadapt) from InfluenzaA__ABD61296__NA

SEQ ID NO: 17240 - RNA, 1410 nt, Artificial Sequence; identical to SEQ ID NO: 17114
  derived and/or modified CDS sequence (AUadapt) from InfluenzaA__ABD61307__NA

SEQ ID NO: 17241 - RNA, 1410 nt, Artificial Sequence; identical to SEQ ID NO: 17132
  derived and/or modified CDS sequence (AUadapt) from InfluenzaA__ABD61318__NA

SEQ ID NO: 17242 - RNA, 1410 nt, Artificial Sequence; identical to SEQ ID NO: 16463
  derived and/or modified CDS sequence (AUadapt) from InfluenzaA__ABD61340__NA

SEQ ID NO: 17243 - RNA, 1410 nt, Artificial Sequence; identical to SEQ ID NO: 16463
  derived and/or modified CDS sequence (AUadapt) from InfluenzaA__ABD61351__NA

SEQ ID NO: 17244 - RNA, 1410 nt, Artificial Sequence
  derived and/or modified CDS sequence (AUadapt) from InfluenzaA__ABD61362__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggaggugugccccaagcuggcggaguaccggaacugguccaagccgcagugcaacaucaccggguucgcccccuucagcaaggacaacuccauccgccucucggccggcggggacaucugggugacccgggagcccuacgucuccugcgaccccgacaagugcuaccaguucgcccugggccaggggaccacgcugaacaacggccacagcaacgacaccgugcacgaccgcaccccguaccggacccuccugaugaacgagcugggcgugcccuuccaccucgggacgaagcaggucugcaucgccugguccucguccucgugccacgacggcaaggcguggcugcacgugugcgugaccggggacgacgagaacgccaccgccuccuucaucuacaacggccgccuggucgacagcaucggguccuggucgaagaagauccuccggacccaggaguccgagugcgugugcaucaacggcacgugcaccguggucaugaccgacggcagcgccuccgggaaggcggacaccaagauccuguucaucgaggagggcaagaucgugcacacgucgucgcuguccgggagcgcccagcacguggaggagugcuccugcuacccccgcuaccccggcguccggugcgugugccgcgacaacuggaagggcucgaaccggccgaucguggacaucaacgucaaggacuacuccaucgugagcuccuacgugugcucggggcucgucggcgacacgccccgcaagaacgacuccucguccagcucccacugccuggaccccaacaacgaggagggcgggcacggggugaagggcugggccuucgacgacggcaacgacgucuggauggggcggaccaucucggagaagcugcgcuccggcuacgagaccuucaaggugaucgagggguggagcaagcccaacuccaagcuccagaucaaccgccaggugaucgucgaccggggcaaccggucgggguacuccggcaucuucucgguggagggcaagagcugcaucaaccgcugcuucuacguggagcugauccgggggcgcaagcaggagaccgagguccuguggaccuccaacucgaucgugguguucugcggcaccuccgggaccuacggcacggggagcuggccggacggcgccgacaucgaccucaugcccaucuga

SEQ ID NO: 17245 - RNA, 1410 nt, Artificial Sequence; identical to SEQ ID NO: 17195
  derived and/or modified CDS sequence (AUadapt) from InfluenzaA__ABD61373__NA

SEQ ID NO: 17246 - RNA, 1410 nt, Artificial Sequence
  derived and/or modified CDS sequence (AUadapt) from InfluenzaA__ABD61384__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccucguccagcugccacgacggcaaggcguggcugcacgugugcgugaccggggacgacgagaacgccaccgccuccuucaucuacaacggccgccugguggacucgaucggguccuggucgaagaagauccuccggacccaggaguccgagugcgucugcaucaacggcacgugcaccguggugaugaccgacggcagcgccuccgggaaggcggacaccaagauccuguucaucgaggagggcaagaucguccacacgucgagccuguccgggucggcccagcacguggaggagugcuccugcuacccccgcuaccccggcgugcggugcgucugccgcgacaacuggaagggcagcaaccggccgaucguggacaucaacaucaaggacuacuccaucgugucguccuacgucugcagcgggcucgugggcgacacgccccgcaagaacgacuccucguccucgucccacugccuggaccccaacaacgaggagggcgggcacggggugaagggcugggccuucgacgacggcaacgacgucuggauggggcggaccaucagcgagaagcugcgcuccggcuacgagaccuucaaggugaucgagggguggucgaagcccaacuccaagcuccagaucaaccggcaggucaucguggaccgcggcaaccggagcggguacuccggcaucuucucgguggagagcaaguccugcaucaaccgcugcuucuacgucgagcugauccggggccgcaagcaggagaccgaggugcuguggaccucgaacuccaucguggucuucugcgggaccagcggcaccuacgggacgggcuccuggccggacggggccgacaucaaccucaugcccaucuga

SEQ ID NO: 17247 - RNA, 1410 nt, Artificial Sequence; identical to SEQ ID NO: 17132
  derived and/or modified CDS sequence (AUadapt) from InfluenzaA__ABD61395__NA

SEQ ID NO: 17248 - RNA, 1410 nt, Artificial Sequence; identical to SEQ ID NO: 17229
  derived and/or modified CDS sequence (AUadapt) from InfluenzaA__ABD61406__NA

SEQ ID NO: 17249 - RNA, 1413 nt, Artificial Sequence; identical to SEQ ID NO: 17230
  derived and/or modified CDS sequence (AUadapt) from InfluenzaA__ABD61521__NA

SEQ ID NO: 17250 - RNA, 1410 nt, Artificial Sequence
  derived and/or modified CDS sequence (AUadapt) from InfluenzaA__ABD61532__NA
augaaccccaaccagaagaucaucaccaucggcucggugucccugaccaucgccacgaucugcuuccucaugcagaucgccauccuggucaccaccgugacccugcacuucaagcaguacgagugcucguccccgcccaacaaccaggugaugcccugcgagcccaucaucaucgagcgcaacaucacggagaucgucuaccucaccaacaccaccaucgagaaggagaucugcccgaagcugguggaguaccggaacuggagcaagccccagugcaagaucacgggguucgcgcccuucuccaaggacaacucgauccgccuguccgccggcggggacaucugggugacccgggagcccuacgucagcugcgacccgggcaagugcuaccaguucgcccucgggcagggcaccacccugaacaacaagcacuccaacgacacgauccacgaccgcacccccuaccggacccugcucaugaacgagcugggcgugcccuuccaccuggggaccaagcaggucugcaucgccuggucguccagcuccugccacgacggcaaggccuggcuccacgugugcgugacggggcacgacaagaacgcgaccgccucguucaucuacgacggccgccugguggacuccaucgggagcugguccaagaacauccugcggacccaggagucggagugcgucugcaucaacgggaccugcacgguggugaugaccgacggcuccgccagcgagcgcgccgacaccaagauccucuucaucgaggagggcaagaucguccacaucucgccccuguccggcagcgcgcagcacguggaggagugcuccugcuacccgcgguaccccggggugcgcugcgucugccgggacaacuggaagggcucgaaccgccccaucguggacaucaacgugaaggacuacuccaucgucagcuccuacgugugcucgggccuggugggggacacgccccggaagaacgaccgcuccagcuccucguacugccggaacccgaacaacgagaagggcaaccacggggucaagggcugggccuucgacgacgggaacgacguguggaugggccgcaccaucggcgaggagcuccgguccggguacgagaccuucaaggucaucggcggguggagcacccccaacuccaagcugcagaucaaccgccaggugaucguggacucggagaaccgguccggcuacagcgggaucuucuccgucgagggcaagucgugcaucaaccgcugcuucuacguggagcugauccggggccgcgagcaggagacccgcgugugguggacgagcaacuccaucgucguguucugcgggaccucgggcaccuacgggaccggcuccuggcccgacggggccgacaucagccucaugcccaucuga

SEQ ID NO: 17251 - RNA, 1413 nt, Artificial Sequence
  derived and/or modified CDS sequence (AUadapt) from InfluenzaA__ABD61543__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucucgggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccucgaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgcgacaacuggcacgggucgaaccggcccugggucuccuucaaccagaaccuggacuaccagaucggcuacaucugcagcggcguguucggggacaacccccgccccaaggacggcgagggguccugcaacccggugacggucgacggcgcggacggggugaagggcuucucguacaaguacggcaacgggguguggaucggccggaccaaguccaaccgccugcggaagggguucgagaugaucugggaccccaacggcuggaccgacaccgacagcaacuucuccgucaagcaggacgugguggccaucacggacuggucgggguacagcggcaacuucguccagcaccccgagcucaccggccuggacugcauccgccccugcuucuggguggagcugguccgggggcucccgcgcgagaacaccaccaucuggacguccggcucguccaucagcuucugcggggugaacuccgacaccgccaacuggagcuggcccgacggcgccgagcugcccuucaccaucgacaaguga

SEQ ID NO: 17252 - RNA, 1413 nt, Artificial Sequence; identical to SEQ ID NO: 17230
  derived and/or modified CDS sequence (AUadapt) from InfluenzaA__ABD63066__NA

SEQ ID NO: 17253 - RNA, 1410 nt, Artificial Sequence; identical to SEQ ID NO: 16655
  derived and/or modified CDS sequence (AUadapt) from InfluenzaA__ABD77601__NA

SEQ ID NO: 17254 - RNA, 1410 nt, Artificial Sequence
  derived and/or modified CDS sequence (AUadapt) from InfluenzaA__ABD77612__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaugugccccaagcuggcggaguaccggaacuggcucaagccgcagugcaacaucaccggguucgcccccuucuccaaggacaacagcauccgccuguccgccggcggggacaucugggugacccgggagcccuacgugucgugcgaccccgacaagugcuaccaguucgcccugggccaggggaccacgcucaacaacggccacuccaacgacaccguccacgaccgcaccccguaccggacccugcugaugaacgagcucggcgugcccuuccaccuggggacgaagcaggucugcaucgccuggagcuccucguccugccacgacggcaaggcguggcugcacgugugcgugaccggggacgacgagaacgccaccgccucgaucaucuacaacggccgccucguggacuccaucgggagcugguccaagaagauccugcggacccaggagucggagugcgucugcaucaacggcacgugcaccguggugaugaccgacggcuccgccagcgggaaggcggacaccaagauccuguucaucaaggagggcaagaucguccacacguccucgcucucgggguccgcccagcacguggaggagugcagcugcuacccccgcuaccccggcgugcggugcgucugccgcgacaacuggaagggcuccaaccggccgaucguggacaucaacgugaaggacuacucgaucgucuccagcuacgugugcuccgggcuggugggcgacacgccccgcaagaacgacucguccucguccagccacugccuggaccccaacaacgaggagggcgggcacggggucaagggcugggccuucgacgacggcaacgacguguggauggggcggaccaucuccgagaagcuccgcucgggcuacgagaccuucaaggucaucgaggggugguccaaggccaacagcaagcugcagaucaaccgccaggugaucguggaccggggcaaccgguccggguacucgggcaucuucuccgucgagucgaagagcugcaucaaccgcugcuucuacguggagcugauccggggccgcaagcaggagaccgaggugcucuggaccuccaacucgaucgucguguucugcgggaccuccggcaccuacgggacgggcagcuggcccgacggggccgacaucaaccugaugccgaucuga

SEQ ID NO: 17255 - RNA, 1410 nt, Artificial Sequence
  derived and/or modified CDS sequence (AUadapt) from InfluenzaA__ABD77634__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaugugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccucguccucgugccacgacggcaaggcguggcugcacgugugcgugaccggggacgacgagaacgccaccgccuccaucaucuacaacggccgccugguggacagcaucggguccuggucgaagaagauccuccggacccaggaguccgagugcgucugcaucaacggcacgugcaccguggugaugaccgacggcagcgccuccgggaaggcggacaccaagauccuguucaucaaggagggcaagaucguccacacgucgucgcuguccgggagcgcccagcacguggaggagugcuccugcuacccccgcuaccccggcgugcggugcgucugccgcgacaacuggaagggcucgaaccggccgaucguggacaucaacgugaaggacuacuccaucgucagcuccuacgugugcucggggcucgugggcgacacgccccgcaagaacgacuccucguccagcucccacugccuggaccccaacaacgaggagggcgggcacggggucaagggcugggccuucgacgacggcaacgacguguggauggggcggaccaucucggagaagcugcgcuccggcuacgagaccuucaaggucaucgagggguggagcaaggccaacuccaagcuccagaucaaccgccaggugaucguggaccggggcaaccggucgggguacuccggcaucuucucggucgagagcaaguccugcaucaaccgcugcuucuacguggagcugauccggggccgcaagcaggagaccgaggugcuguggaccucgaacuccaucgucguguucugcgggaccagcggcaccuacgggacgggcuccuggcccgacggggccgacaucaaccucaugccgaucuga

SEQ ID NO: 17256 - RNA, 1410 nt, Artificial Sequence; identical to SEQ ID NO: 17255
  derived and/or modified CDS sequence (AUadapt) from InfluenzaA__ABD77645__NA

SEQ ID NO: 17257 - RNA, 1410 nt, Artificial Sequence; identical to SEQ ID NO: 17255
  derived and/or modified CDS sequence (AUadapt) from InfluenzaA__ABD77656__NA

SEQ ID NO: 17258 - RNA, 1410 nt, Artificial Sequence; identical to SEQ ID NO: 16528
  derived and/or modified CDS sequence (AUadapt) from InfluenzaA__ABD77700__NA

SEQ ID NO: 17259 - RNA, 1413 nt, Artificial Sequence; identical to SEQ ID NO: 17230
  derived and/or modified CDS sequence (AUadapt) from InfluenzaA__ABD77722__NA

SEQ ID NO: 17260 - RNA, 1413 nt, Artificial Sequence; identical to SEQ ID NO: 17230
  derived and/or modified CDS sequence (AUadapt) from InfluenzaA__ABD77733__NA

SEQ ID NO: 17261 - RNA, 1410 nt, Artificial Sequence
  derived and/or modified CDS sequence (AUadapt) from InfluenzaA__ABD77744__NA
augaaccccaaccagaagaucaucaccaucggcucggugucccugaccaucgccacgaucugcuuccucaugcagaucgucauccuggugaccaccgugacccugcacuucaagcaguacgagugcaacucgccgcccaacaaccaggucaugcucugcgagcccacgaucaucgagcgcaacaucaccgagaucguguaccugaccaacaccacgaucgagaaggagaucugccccaagcuggccgaguaccggaacugguccaagccgcagugcaacaucaccggguucgcgcccuucagcaaggacaacuccauccgccucucggccggcggggacaucugggugacccgggagcccuacgucuccugcgaccccgacaagugcuaccaguucgcccugggccaggggaccacgcugaacaacggccacagcaacgacaccgugcacgaccgcaccccguaccggacccuccugaugaacgagcugggcgugcccuuccaccucgggacgaagcaggucugcaucgccugguccucguccagcugccacgacggcaaggccuggcugcacgugugcgugaccggggacgacgagaacgcgaccgccuccuucaucuacaacggccgccuggucgacucgaucggguccuggagcaagaagauccuccggacccaggaguccgagugcgugugcaucaacggcacgugcaccguggucaugaccgacggcucggccuccgggaaggccgacaccaagauccuguucaucgaggagggcaagaucgugcacacgagccugcucucgggguccgcgcagcacguggaggagugcucgugcuacccccgcuaccccggcguccggugcgugugccgcgacaacuggaagggcuccaaccggccgaucguggacaucaacgucaaggacuacagcaucguguccucguacgugugcuccgggcuggucggcgacacgccccgcaagaacgacagcuccucguccagccacugccuggaccccaacaacgaggagggcgggcacggggugaagggcugggccuucgacgacggcaacgacgucuggauggggcggaccaucuccgagaagcuccgcucgggcuacgagaccuucaaggugaucgaggggugguccaagcccaacagcaagcugcagaucaaccgccaggugaucgucgaccggggcaaccgguccggguacucgggcaucuucuccguggagggcaagagcugcaucaaccgcugcuucuacguggagcugauccgggggcgcaagcaggagaccgagguccucuggaccucgaacuccaucgugguguucugcggcaccagcgggaccuacggcacgggguccuggccggacggcgccgacaucaaccugaugcccaucuga

SEQ ID NO: 17262 - RNA, 1410 nt, Artificial Sequence; identical to SEQ ID NO: 17255
  derived and/or modified CDS sequence (AUadapt) from InfluenzaA__ABD77755__NA

SEQ ID NO: 17263 - RNA, 1410 nt, Artificial Sequence; identical to SEQ ID NO: 17255
  derived and/or modified CDS sequence (AUadapt) from InfluenzaA__ABD77766__NA

SEQ ID NO: 17264 - RNA, 1410 nt, Artificial Sequence
  derived and/or modified CDS sequence (AUadapt) from InfluenzaA__ABD77777__NA
augaaccccaaccagaagaucaucaccaucggcucggugucccugaccaucgccacgaucugcuuccucaugcagaucgucauccuggugaccaccgugacccugcacuucaagcaguacgagugcaacucgccgcccaacaaccaggucaugcccugcgagcccacgaucaucgagcgcaacaucaccgagaucguguaccucaccaacaccacgaucgagaaggagaucugcccgaagcuggccgaguaccggaacugguccaagccccagugcaacaucaccggguucgcgcccuucagcaaggacaacuccauccgccugucggccggcggggacaucugggugacccgggagcccuacgucuccugcgacccggacaagugcuaccaguucgcccucggccaggggaccacgcugaacaacggccacagcaacgacaccgugcacgaccgcacccccuaccggacccugcucaugaacgagcugggcgugcccuuccaccuggggacgaagcaggucugcaucgccugguccucguccucgugccacgacggcaaggccuggcuccacgugugcgugaccggggacgacgagaacgcgaccgccuccuucaucuacaacggccgccuggucgacagcaucggguccuggucgaagaagauccugcggacccaggaguccgagugcgugugcaucaacggcacgugcaccguggucaugaccgacggcagcgccuccgggaaggccgacaccaagauccucuucaucgaggagggcaagaucgugcacacgucgcugcugagcggguccgcgcagcacguggaggagugcucgugcuacccccgcuacccgggcguccggugcgugugccgcgacaacuggaagggcuccaaccggcccaucguggacaucaacgucaaggacuacucgaucguguccagcuacgugugcuccgggcucgucggcgacacgccccgcaagaacgacucguccagcuccucgcacugccuggaccccaacaacgaggagggcgggcacggggugaagggcugggccuucgacgacggcaacgacgucuggauggggcggaccaucuccgagaagcugcgcucgggcuacgagaccuucaaggugaucgaggggugguccaagccgaacagcaagcuccagaucaaccgccaggugaucgucgaccggggcaaccgguccggguacucgggcaucuucuccguggagggcaagagcugcaucaaccgcugcuucuacguggagcugauccgggggcgcaagcaggagaccgagguccuguggaccucgaacuccaucgugguguucugcggcaccagcgggaccuacggcacgggguccuggcccgacggcgccgacaucaaccucaugcccaucuga

SEQ ID NO: 17265 - RNA, 1410 nt, Artificial Sequence; identical to SEQ ID NO: 17264
  derived and/or modified CDS sequence (AUadapt) from InfluenzaA__ABD77788__NA

SEQ ID NO: 17266 - RNA, 1362 nt, Artificial Sequence
  derived and/or modified CDS sequence (AUadapt) from InfluenzaA__ABD77799__NA
augaaucccaaccagaagaucaucaccaucggcucgaucugcaugguggucgggaucaucucccugauccuccagaucggcaacaucaucagcaucuggaucucccacagcauccagaccgggaaucagaaccacacgggcaucugcaaccaggggaucaucaccuacaacgugguggccggccaggacuccaccagcgucauccugaccggcaauuccagccugugcccgauccgcgggugggccauccacuccaaggacaacggcauccggaucgggagcaagggcgacguguucgugauccgcgagcccuuuaucuccugcagccaccucgagugccggacguucuuccugacccagggggcgcugcucaacgacaagcauuccaacggcaccgucaaggaccgcagccccuaccgggcccugauguccugccccgugggcgaggccccgucgcccuacaacucccgcuuugagagcguggccugguccgccagcgcgugccacgacgggaugggcuggcugaccaucgggaucagcggccccgacaacggcgccgucgccgugcucaaguauaacgggaucaucacggagaccaucaaguccuggcggaagaagauccugcgcacccaggagagcgagugcacgugcgugaacggcuccugcuucaccaucaugaccgacgggcccaguaacggccuggccuccuacaagaucuucaagaucgagaaggggaaggucaccaagagcaucgagcucaacgcgccgaacucccacuacgaggaguguagcugcuaccccgacaccggcaaggugaugugcgugugccgggacaacuggcauggcuccaaccgccccugggucagcuucgaccagaaccuggacuaccagaucggguacaucuguuccggcguguucggggacaacccccggccgaaggacggcacggggucgugcggccccguguccgccgacggcgccaacggggucaagggcuuuagcuaccgcuacgggaacggcguguggaucgggcggaccaaguccgacagcucccgccacggcuucgagaugaucugggaucccaacggcuggaccgagaccgacagccgguucuccgugcgccaggacgucguggccaugacggaccggagcggguacaguggcuccuucgugcagcaccccgagcugaccgggcucgacugcaugcgcccgugcuucugggucgagcugauccggggccgccccgaggaggagaccaucuggaccagcggcuccaucaucagcuuuugcggggugaacuccgacacggucgacuggagcuggcccgacggcgccgagcugcccuucaccaucgacaaguga

SEQ ID NO: 17267 - RNA, 1410 nt, Artificial Sequence
  derived and/or modified CDS sequence (AUadapt) from InfluenzaA__ABD77810__NA
augaaccccaaccagaagaucaucaccaucggcucgaucugcaugguggucgggaucaucucccugauccuccagaucggcaacaucgugagcaucuggaucucccacagcauccagaccgggaaccagaaccacacggggaccugcaaccaguccaucaucaccuacaagaacucgaccugggugaaccagacguacgucaacaucuccaacaccaacgugguggccggcaaggacaccaccagcgucauccuggccggcaacuccagccugugcccgauccgcggcugggcgaucuacuccaaggacaacggggugcggaucggcucgaagggggacguguucgucauccgcgagcccuucaucuccugcagccaccucgagugccggacguucuuccugacccagggcgcccugcucaacgacaagcacuccaacgggaccgugaaggaccgcagccccuaccgggcccugauguccugccccgugggcgaggccccgucgcccuacaacucccgcuucgagagcgucgccuggagcgcguccgccugccacgacggcaugggguggcugaccaucggcaucucggggcccgacgacggcgccguggccgugcucaaguacaacggcaucaucacggagaccaucaaguccuggcggaaggagauccugcgcacccaggagagcgagugcgucugcgugaacggguccugcuucaccaucaugacggacggccccagcgggggcccggcguccuacaagaucuucaagaucgagaaggggaaggugaccaagucgaucgagcuggacgcccccaacucccacuacgaggagugcagcugcuaccccgacaccuccaaggucaugugcgugugccgggacaacuggcacggcagcaaccgccccuggguguccuucgaccagaaccucgacuaccagaugggcuacaucugcucgggggucuucggcgacaacccgcggcccaaggacgggaagggcuccugcgggcccguguacguggacggcgccaacggcgucaagggguucagcuaccgcuacggcaacgggguguggaucggccggaccaaguccaacagcucccgccagggguucgagaugaucugggaccccaacggcuggacggagaccgacucgaacuucuucaccaagcaggacgucguggccgugaccgacuggagcggcuacuccgggagcuucguccagcacccggagcugacgggccuggacugcaugcggcccugcuucuggguggagcucauccgcgggcggcccaaggagaacaccaucuggaccuccggcucguccaucagcuucugcggcgugaacuccgacaccgucgacuggagcuggcccgacggggccgagcugccguucacgaucgacaaguga

SEQ ID NO: 17268 - RNA, 1410 nt, Artificial Sequence
  derived and/or modified CDS sequence (AUadapt) from InfluenzaA__ABD77832__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccgacaagugcuaccaguucgcccugggccaggggaccacgcugaacaaccgccacagcaacgacaccguccacgaccggaccccguaccgcacccuccugaugaacgagcugggcgugcccuuccaccucggcacgaagcaggucugcaucgccugguccucguccagcugccacgacgggaaggcguggcugcacgugugcgugaccggccacgacgagaacgccaccgccuccuucaucuacgggggccggcugguggacucgaucggguccuggagcaagaagauccuccgcacccaggaguccgagugcgucugcaucaacggcacgugcaccguggugaugaccgacggcucggccuccgggcgggcggacaccaagauccuguucaucgaggagggcaagaucguccacaucagcccccugucgggguccgcccagcacguggaggagugcagcugcuacccccgcuacuccggcgugcggugcgucugccgcgacaacuggaagggcucgaaccggccgaucguggacaucaacgugaaggacuacuccaucgucagcuccuacgugugcucggggcucgugggcgacacgccccgcaagaacgacuccagcuccucgucccacugccugaaccccaacaacgaggagggcgggcacggggucaagggcugggccuucgacgacggcaacgacguguggauggggcggaccaucagcgagaaguuccgcuccggcuacgagaccuucaaggucaucgggggcuggucgaagcccaacuccaagcugcagaucaaccgccaggugaucguggaccgggggaaccggagcggcuacuccggcaucuucucggucgagggcaagagcugcaucaaccgcugcuucuacguggagcucauccgggggcgcaagcaggagaccgaggugugguggacguccaacucgaucgucguguucugcgggaccuccggcaccuacgggaccggcagcuggccggacggcgccgacaucaaccugaugcccaucuga

SEQ ID NO: 17269 - RNA, 1410 nt, Artificial Sequence
  derived and/or modified CDS sequence (AUadapt) from InfluenzaA__ABD77876__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccgacaagugcuaccaguucgcccugggccaggggaccacgcugaacaaccgccacagcaacgacaccguccacgaccggaccccguaccgcacccuccugaugaacgagcugggcgugcccuuccaccucggcacgaagcaggucugcaucgccugguccucguccagcugccacgacgggaaggcguggcugcacgugugcgugaccggccacgacgagaacgccaccgccuccuucaucuacgacgggcggcugguggacucgaucggcuccuggucgaagaagauccuccgcacccaggaguccgagugcgucugcaucaacgggacgugcaccguggugaugaccgacggcagcgccuccggccgggcggacaccaagauccuguucaucgaggaggggaagaucguccacaucucgccccugagcggcuccgcccagcacguggaggagugcucgugcuacccccgcuacuccggggugcggugcgucugccgcgacaacuggaagggcagcaaccggccgaucguggacaucaacgugaaggacuacuccaucgucucguccuacgugugcagcggccucgugggggacacgccccgcaagaacgacuccucguccucgucccacugccugaaccccaacaacgaggagggcgggcacggcgucaaggggugggccuucgacgacggcaacgacguguggaugggccggaccaucagcgagaagcugcgcuccggguacgagaccuucaaggucaucgagggcuggucgaagcccaacuccaagcuccagaucaaccgccaggugaucguggaccgggggaaccggagcggcuacuccgggaucuucucggucgagggcaagagcugcaucaaccgcugcuucuacguggagcugauccggggccgcaagcaggagaccgaggugugguggacguccaacucgaucgucguguucugcgggaccuccggcaccuacgggaccggcagcuggccggacggggccgacaucaaccugaugcccaucuga

SEQ ID NO: 17270 - RNA, 1410 nt, Artificial Sequence; identical to SEQ ID NO: 16528
  derived and/or modified CDS sequence (AUadapt) from InfluenzaA__ABD77887__NA

SEQ ID NO: 17271 - RNA, 1410 nt, Artificial Sequence
  derived and/or modified CDS sequence (AUadapt) from InfluenzaA__ABD77898__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccgacaagugcuaccaguucgcccugggccaggggaccacgcugaacaaccgccacagcaacgacaccguccacgaccggaccccguaccgcacccuccugaugaacgagcugggcgugcccuuccaccucggcacgaagcaggucugcaucgccugguccucguccagcugccacgacgggaaggcguggcugcacgugugcgugaccggccacgacgagaacgccaccgccuccuucaucuacgacgggcggcugguggacucgaucggcuccuggucgaagaagauccuccgcacccaggaguccgagugcgucugcaucaacgggacgugcaccguggugaugaccgacggcagcgccuccggccgggcggacaccaagauccuguucaucgaggaggggaagaucauccacaucucgccccugagcggcuccgcccagcacgucgaggagugcucgugcuacccccgcuacccgggggugcggugcgugugccgcgacaacuggaagggcuccaaccggcccaucgucgacaucaacgugaaggacuacagcaucguguccucguacgucugcuccggccucgugggggacacgccccgcaagaacgacagcuccucguccucgcacugccugaaccccaacaacgaggagggcgggcacggcgugaaggggugggccuucgacgacggcuccgacgucuggaugggccggaccaucagcgagaagcugcgcuccggguacgagaccuucaaggugaucgagggcuggucgaagccgaacuccaagcuccagaucaaccggcaggucaucguggaccgcgggaaccggagcggcuacuccgggaucuucucgguggagggcaagagcugcaucaaccgcugcuucuacgucgagcugauccggggccgcaagcaggagaccgaggugugguggacguccaacucgaucguggucuucugcgggaccuccggcaccuacgggaccggcagcuggcccgacggggccgacaucaaccugaugcccaucuga

SEQ ID NO: 17272 - RNA, 1410 nt, Artificial Sequence
  derived and/or modified CDS sequence (AUadapt) from InfluenzaA__ABD77909__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccgacaagugcuaccaguucgcccugggccaggggaccacgcugaacaaccgccacagcaacgacaccguccacgaccggaccccguaccgcacccuccugaugaacgagcugggcgugcccuuccaccucggcacgaagcaggucugcaucgccugguccucguccagcugccacgacgggaaggcguggcugcacgugugcgugaccggccacgacgagaacgccaccgccuccuucaucuacgacgggcggcugguggacucgaucggcuccuggucgaagaagauccuccgcacccaggaguccgagugcgucugcaucaacgggacgugcaccguggugaugaccgacggcagcgccuccggccgggcggacaccaagauccuguucaucgaggaggggaagaucguccacaucucgccccugagcggcuccgcccagcacguggaggagugcucgugcuacccccgcuacccgggggugcggugcgucugccgcgacaacuggaagggcuccaaccggcccaucguggacaucaacgugaaggacuacagcaucgucuccucguacgugugcuccggccucgugggggacacgccccgcaagaacgacagcuccucguccucgcacugccugaaccccaacaacgaggagggcgggcacggcgucaaggggugggccuucgacgacggcaacgacguguggaugggccggaccaucuccgagaagcugcgcagcggguacgagaccuucaaggucaucgagggcugguccaagccgaacucgaagcuccagaucaaccgccaggugaucguggaccgggggaacuccagcggcuacuccgggaucuucucggucgagggcaagagcugcaucaaccggugcuucuacguggagcugauccgcggccggaagcaggagaccgaggugugguggacguccaacucgaucgucguguucugcgggaccuccggcaccuacgggaccggcagcuggcccgacggggccgacaucaaccugaugcccaucuga

SEQ ID NO: 17273 - RNA, 1413 nt, Artificial Sequence; identical to SEQ ID NO: 17230
  derived and/or modified CDS sequence (AUadapt) from InfluenzaA__ABD77920__NA

SEQ ID NO: 17274 - RNA, 1413 nt, Artificial Sequence; identical to SEQ ID NO: 17230
  derived and/or modified CDS sequence (AUadapt) from InfluenzaA__ABD77931__NA

SEQ ID NO: 17275 - RNA, 1413 nt, Artificial Sequence; identical to SEQ ID NO: 17230
  derived and/or modified CDS sequence (AUadapt) from InfluenzaA__ABD77942__NA

SEQ ID NO: 17276 - RNA, 1413 nt, Artificial Sequence
  derived and/or modified CDS sequence (AUadapt) from InfluenzaA__ABD77953__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagucggagugcgugugcgugaacggcuccugcuucaccaucaugacggacgggcccagcaacggcgccgccuccuacaagaucuucaagaucgagaaggggaaggucaccaagucgaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcucgggcguguucggggacaacccccgccccaaggacggcgagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccgacaccgacagcaacuucuccgucaagcaggacgugguggccaucacggacuggucgggguacagcggcuccuucguccagcaccccgagcucaccggccuggacugcauccgccccugcuuccugguggagcucguccgggggcugccgcgcgagaacaccaccaucuggacgucgggcuccagcaucuccuucugcggggugaacagcgacaccgccaacugguccuggcccgacggcgccgagcugcccuucaccaucgacaaguga

SEQ ID NO: 17277 - RNA, 1413 nt, Artificial Sequence
  derived and/or modified CDS sequence (AUadapt) from InfluenzaA__ABD77964__NA
augaaccccaaccagaagaucaucaccaucggcucgaucuccaucgccaucgggaucaucagccugaugcuccagaucggcaacaucaucuccaucugggccucgcacuccauccagacccgcagccagaaccacacggggaucugcaaccagcggaucaucaccuacgagaacuccaccugggugaaccacaccuacgucaacaucaacaacacgaacgugguggcgggcaaggacaagaccucggucacccuggccgggaacuccagccugugcuccaucagcggcugggccaucuacaccaaggacaacuccauccgcaucggcucgaagggggacguguucgugauccgggagccguucaucuccugcagccaccucgagugccgcacguucuuccugacccagggcgcccugcucaacgacaagcacuccaacgggaccgucaaggaccggucgcccuaccgcgcccugauguccugcccccugggcgaggcgcccagcccguacaacucgaaguucgaguccguggccuggagcgccuccgccugccacgacgggaugggcuggcucaccaucggcaucagcgggcccgacaacggcgcgguggccguccugaaguacaacgggaucaucacggagaccaucaaguccuggaagaagcggauccugcgcacccaggagucggagugcgugugcgugaacggcuccugcuucaccaucaugacggacggccccagcaacggggccgccuccuacaagaucuucaagaucgagaagggcaaggucaccaagucgaucgagcucaacgcccccaacuuccacuacgaggagugcuccugcuacccggacaccgggaccgugaugugcgugugccgggacaacuggcacggcagcaaccgccccugggucuccuucaaccagaaccuggacuaccagaucggguacaucugcucgggcguguucggcgacaacccccggcccaaggacggggagggcuccugcaacccggugacggucgacggggcggacggcgugaagggguucagcuacaaguacggcaacggcguguggaucgggcgcaccaaguccaaccggcugcgcaagggcuucgagaugaucugggaccccaacggguggaccgacaccgacagcaacuucuccgucaagcaggacgugguggccaucacggacuggucgggcuacagcggguccuucguccagcaccccgagcucaccggccuggacugcauccggcccugcuucuggguggagcugguccgcggccucccgcgggagaacaccaccaucuggacgucgggguccagcaucuccuucugcggcgugaacagcgacaccgccaacugguccuggcccgacggggccgagcugcccuucaccaucgacaaguga

SEQ ID NO: 17278 - RNA, 1413 nt, Artificial Sequence; identical to SEQ ID NO: 17230
  derived and/or modified CDS sequence (AUadapt) from InfluenzaA__ABD77975__NA

SEQ ID NO: 17279 - RNA, 1413 nt, Artificial Sequence; identical to SEQ ID NO: 17230
  derived and/or modified CDS sequence (AUadapt) from InfluenzaA__ABD77986__NA

SEQ ID NO: 17280 - RNA, 1413 nt, Artificial Sequence
  derived and/or modified CDS sequence (AUadapt) from InfluenzaA__ABD77997__NA
augaaccccaaccagaagaucaucaccaucggcucgaucuccaucgccaucgggauccugagccucaugcugcagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccucugcuccaucucgggcugggccaucuacaccaaggacaacuccauccggaucgggagcaagggcgacguguucgugauccgcgagccguucaucuccugcucgcaccuggagugccggacguucuuccugacccagggggcccuccugaacgacaagcacuccaacggcaccgucaaggaccgcagccccuaccgggcccugauguccugcccccucggggaggcgcccucgccguacaacagcaaguucgaguccguggccuggagcgccuccgccugccacgacggcaugggcuggcugaccaucgggaucucgggccccgacaacggggcgguggccguccugaaguacaacggcaucaucacggagaccaucaaguccuggaagaagcgcauccuccggacccaggagagcgagugcgugugcgugaacggcuccugcuucaccaucaugacggacgggcccucgaacggcgccgccuccuacaagaucuucaagaucgagaaggggaaggucaccaagagcaucgagcugaacgcccccaacuuccacuacgaggagugcuccugcuacccggacaccggcaccgugaugugcgugugccgcgacaacuggcacgggucgaaccggcccugggucuccuucaaccagaaccuggacuaccagaucggcuacaucugcagcggcguguucggggacaacccccgccccaaggacggcgagggguccugcaacccggugacggucgacggcgcggacggggugaagggcuucucguacaaguacggcaacgggguguggaucggccggaccaaguccaaccgccuccggaagggguucgagaugaucugggaccccaacggcuggaccgacaccgacaacaacuucagcgucaagcaggacgugguggccaucacggacugguccggguacucgggcagcuucguccagcaccccgagcugaccggccuggacugcauccgccccugcuucuggguggagcucguccgggggcugccgcgcgagaacaccaccaucuggacguccggcucguccaucagcuucugcggggugaacuccgacaccgccaacuggagcuggcccgacggcgccgagcugcccuucaccaucgacaaguga

SEQ ID NO: 17281 - RNA, 1413 nt, Artificial Sequence; identical to SEQ ID NO: 17230
  derived and/or modified CDS sequence (AUadapt) from InfluenzaA__ABD78008__NA

SEQ ID NO: 17282 - RNA, 1413 nt, Artificial Sequence; identical to SEQ ID NO: 17230
  derived and/or modified CDS sequence (AUadapt) from InfluenzaA__ABD78019__NA

SEQ ID NO: 17283 - RNA, 1413 nt, Artificial Sequence
  derived and/or modified CDS sequence (AUadapt) from InfluenzaA__ABD78030__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucucgggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaaccgcaccgucaaggaccggagccccuaccgcgcccugauguccugcccccugggcgaggcgcccucgccguacaacagcaaguucgaguccguggccuggagcgccuccgccugccacgacgggaugggcuggcucaccaucggcaucucggggcccgacaacggcgcgguggccguccugaaguacaacgggaucaucacggagaccaucaaguccuggaagaagcggauccugcgcacccaggagagcgagugcgugugcgugaacggcuccugcuucaccaucaugacggacggccccaacaacggggccgccucguacaagaucuucaagaucgagaagggcaaggucaccaaguccaucgagcucaacgcccccaacuuccacuacgaggagugcagcugcuacccggacaccgggaccgugaugugcgugugccgggacaacuggcacggcuccaaccgccccugggucucguucaaccagaaccuggacuaccagaucggguacaucugcuccggcguguucggcgacaacccccggcccaaggacggggagggcagcugcaacccggugacggucgacggggcggacggcgugaagggguucuccuacaaguacggcaacggcguguggaucgggcgcaccaagucgaaccggcugcgcaagggcuucgagaugaucugggaccccaacggguggaccgacaccgacuccaacuucagcgucaagcaggacgugguggccaucacggacugguccggcuacucggggagcuucguccagcaccccgagcucaccggccuggacugcauccggcccugcuucuggguggagcugguccgcggccucccgcgggagaacaccaccaucuggacguccgggucguccaucagcuucugcggcgugaacuccgacaccgccaacuggagcuggcccgacggggccgagcugcccuucaccaucgacaaguga

SEQ ID NO: 17284 - RNA, 1413 nt, Artificial Sequence
  derived and/or modified CDS sequence (AUadapt) from InfluenzaA__ABD78041__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacagcaaguucgaguccguggccuggucggccuccgccugccacgacggcaugggcuggcucaccaucgggaucagcggccccgacaacggggcgguggccguccugaaguacaacggcaucaucacggagaccaucaaguccuggaagaagcgcauccugcggacccaggagucggagugcgugugcgugaacggcuccugcuucaccaucaugacggacgggcccagcaacggcgccgccuccuacaagaucuucaagaucgagaaggggaaggucaccaagagcaucgagcucaacgcccccaacuuccacuacgaggagugcuccugcuacccggacaccucgaccgugaugugcgugugccgcgacaacuggcacggcuccaaccggcccugggucagcuucaaccagaaccuggacuaccagaucggguacaucugcuccggcguguucggcgacaacccccgccccaaggacggggagggcucgugcaacccggugacggucgacggggcggacggcgugaagggguucuccuacaaguacggcaacggcguguggaucgggcggaccaagagcaaccgccugcggaagggcuucgagaugaucugggaccccaacggguggaccgacaccgacuccaacuucagcgucaagcaggacgugguggccaucacggacuggucgggcuacuccgggagcuucguccagcaccccgagcucaccggccuggacugcauccgccccugcuucuggguggagcugguccggggccucccgcgcgagaacaccaccaucuggacguccgggucguccaucagcuucugcggcgugaacuccgacaccgccaacuggagcuggcccgacggggccgagcugcccuucaccaucgacaaguga

SEQ ID NO: 17285 - RNA, 1410 nt, Artificial Sequence; identical to SEQ ID NO: 17264
  derived and/or modified CDS sequence (AUadapt) from InfluenzaA__ABD78052__NA

SEQ ID NO: 17286 - RNA, 1413 nt, Artificial Sequence; identical to SEQ ID NO: 16798
  derived and/or modified CDS sequence (AUadapt) from InfluenzaA__ABD78063__NA

SEQ ID NO: 17287 - RNA, 1413 nt, Artificial Sequence; identical to SEQ ID NO: 16798
  derived and/or modified CDS sequence (AUadapt) from InfluenzaA__ABD78074__NA

SEQ ID NO: 17288 - RNA, 1413 nt, Artificial Sequence; identical to SEQ ID NO: 16798
  derived and/or modified CDS sequence (AUadapt) from InfluenzaA__ABD78085__NA

SEQ ID NO: 17289 - RNA, 1413 nt, Artificial Sequence; identical to SEQ ID NO: 16798
  derived and/or modified CDS sequence (AUadapt) from InfluenzaA__ABD78096__NA

SEQ ID NO: 17290 - RNA, 1410 nt, Artificial Sequence
  derived and/or modified CDS sequence (AUadapt) from InfluenzaA__ABD78118__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaugugccccaagcuggcggaguaccggaacugguccaagccgcagugcaagaucaccggguucgcccccuucagcaaggacaacuccauccgccucucggccggcggggacaucugggugacccgggagcccuacguguccugcgaccccgacaagugcuaccaguucgcccugggccaggggaccacgcugaacaaccgccacagcaacgacaccguccacgaccggaccccguaccgcacccuccugaugaacgagcugggcgugcccuuccaccucggcacgaagcaggucugcaucgccugguccucguccagcugccacgacgggaaggcguggcugcacgugugcgugaccggccacgacgagaacgccaccgccuccuucaucuacgacgggcggcugguggacucgaucggcuccuggagcaagaagauccuccgcacccaggaguccgagugcgucugcaucaacgggacgugcaccguggugaugaccgacggcucggccuccggccgggcggacaccaagauccuguucaucgaggaggggaagaucguccacaucagcccccugucgggcuccgcccagcacguggaggagugcagcugcuacccccgcuacuccggggugcggugcgucugccgcgacaacuggaagggcucgaaccggccgaucguggacaucaacgugaaggacuacuccaucgucagcuccuacgugugcucgggccucgugggggacacgccccgcaagaacgacuccagcuccucgucccacugccugaaccccaacaacgaggagggcgggcacggcgucaaggggugggccuucgacgacggcaacgacguguggaugggccggaccaucagcgagaaguuccgcuccggguacgagaccuucaaggucaucggcggguggucgaagcccaacuccaagcugcagaucaaccgccaggugaucguggaccggggcaaccggagcggguacuccggcaucuucucggucgagggcaagagcugcaucaaccgcugcuucuacguggagcucauccgggggcgcaagcaggagaccgaggugugguggacguccaacucgaucgucguguucugcggcaccuccgggaccuacggcaccgggagcuggccggacggcgccgacaucaaccugaugcccaucuga

SEQ ID NO: 17291 - RNA, 1410 nt, Artificial Sequence; identical to SEQ ID NO: 17290
  derived and/or modified CDS sequence (AUadapt) from InfluenzaA__ABD78129__NA

SEQ ID NO: 17292 - RNA, 1410 nt, Artificial Sequence; identical to SEQ ID NO: 16520
  derived and/or modified CDS sequence (AUadapt) from InfluenzaA__ABD79035__NA

SEQ ID NO: 17293 - RNA, 1353 nt, Artificial Sequence
  derived and/or modified CDS sequence (AUadapt) from InfluenzaA__ABD79115__NA
augaaucccaaccaaaagaucaucaccaucggcagcaucugcaugguggucgggaucaucucccugaucuuccagaucggcaacaucgugagcaucuggaucucccacagcaucaccgggacgugcaaccgcuccaucuacgugaauaucagcaacaccaacgucguggccggcaaggacaccaccuccgugauccucgccgggaacagcucccugugcccgauccggggcugggcgaucuacagcaaggacaacggcguccgcaucggguccaagggcgauguguucgugauccgggagcccuucaucagcugcucccaccuggagugccgcacguucuuccucacccagggggcccugcugaacgacaagcacagcaauggcaccgucaaggaccggucccccuaccgcacccucaugagcugccccgugggggaggccccgucccccuacaacagccgguucgaguccguggccuggagcgccagcgcgugccaugacggcaugggcuggcugacgaucgggaucuccggccccgacgacggggccgucgccgugcugaaguacaacggcaucaucaccggcaccaucaagagcuggcgcaaggagauccuccggacccaggaguccgagugcgugugcgucaacgggagcugcuuuacgaucaugaccgacggccccuccgggggcccggccagcuacaagaucuucaagaucgagaaggggaaagugaccaaguccaucgagcuggacgcgcccaacagccacuacgaggagugcuccugcuaccccgauaccagcaaggugaugugcgucugccgcgacaacuggcacggcuccaaccggcccugggugagcuucgaccagaaccuggauuaccagaugggcuacaucugcuccgggguguucggcgacaacccgcgccccaaggacgggaagggcagcugcgggcccgucuacguggacggcgccaauggcgugaagggguucuccuaccgguacggcaacggggucuggaucggccgcaccaagagcuccagcucccggcagggguucgagaugaucugggaccccaacggcuggacggagaccgacagcaacuuuuucaugaagcaggacguggucgccgugaccgacuggagcggcuacuccgggagcuucgugcagcacccggagcucacgggccuggacugcaugcgccccugcuuuugggucgagcugauccgggggcgccccaaggagaacaccaucuggaccuccggcagcuccaucagcuucugcggcgugaacuccgacaccguggacuggagcuggcccgacggggccgagcucccguucacgaucgacaaguga

SEQ ID NO: 17294 - RNA, 1410 nt, Artificial Sequence
  derived and/or modified CDS sequence (AUadapt) from InfluenzaA__ABD79126__NA
augaaccccaaccagaagaucaucaccaucggcucggugucccugaccaucacgaccaucugcuuccucaugcagaucgccauccuggucaucaccgugacccugcacuucaagcagugcgagugcaacagcccgcccaacaaccaggugaugcucugcgagcccacgaucaucgagcgcaacaucaccgagaucgucuaccugaccaacaccacgaucgagaaggagaucugccccaagcuggccgaguaccggaacugguccaagccgcagugcaagaucaccggguucgcgcccuucucgaaggacaacuccauccgccucagcgccggcggggacaucugggugacccgggagcccuacguguccugcgaccccggcaagugcuaccaguucgcccuggggcagggcaccacgcugaacaaccgccacucgaacgacaccguccacgaccggaccccguaccgcacccuccugaugaacgagcugggcgugcccuuccaccucgggacgaagcaggucugcaucgccugguccagcuccucgugccacgacggcaaggccuggcugcacgugugcgugaccgggcacaacgagaacgcgaccgccuccuucaucuacgacggccggcugguggacagcaucggguccuggucgaagaacauccuccgcacccaggaguccgagugcgucugcaucaacggcacgugcaccguggugaugaccgacggcagcgccuccgggcgggccgacaccaagauccuguucaucgaggagggcaagaucguccacaucucgccccugagcggguccgcgcagcacguggaggagugcucgugcuacccccgcuacccgggcgugcggugcgucugccgcgacaacuggaagggcuccaaccggcccaucguggacaucaacgugaaggacuacagcaucgucuccucguacgugugcuccgggcucgugggcgacacgccccgcaagaacgacagcuccucguccagcuacugccuggaccccaacaacgaggagggcgggcacggggucaagggcugggccuucgacgacggcaacgacguguggauggggcggaccaucuccgagaagcugcgcucgggcuacgagaccuucaaggucaucgggggcugguccaagccgaacagcaagcuccagaucaaccgccaggugaucguggacaaggggaaccgguccggcuacucgggcaucuucuccgucgagggcaagagcugcaucaaccggugcuucuacguggagcugauccgcgggcggaagcaggagaccgaggugugguggacgucgaacuccaucgucguguucugcgggaccagcggcaccuacgggaccggcuccuggcccgacggcgccgacaucaaccugaugcccaucuga

SEQ ID NO: 17295 - RNA, 1410 nt, Artificial Sequence; identical to SEQ ID NO: 17294
  derived and/or modified CDS sequence (AUadapt) from InfluenzaA__ABD79137__NA

SEQ ID NO: 17296 - RNA, 1410 nt, Artificial Sequence; identical to SEQ ID NO: 17294
  derived and/or modified CDS sequence (AUadapt) from InfluenzaA__ABD79148__NA

SEQ ID NO: 17297 - RNA, 1410 nt, Artificial Sequence; identical to SEQ ID NO: 17294
  derived and/or modified CDS sequence (AUadapt) from InfluenzaA__ABD79159__NA

SEQ ID NO: 17298 - RNA, 1410 nt, Artificial Sequence
  derived and/or modified CDS sequence (AUadapt) from InfluenzaA__ABD79170__NA
augaaccccaaccagaagaucaucaccaucggcucggugucccugaccaucacgaccaucugcuuccucaugcagaucgccauccuggucaucaccgugacccugcacuucaagcagugcgagugcaacagcccgcccaacaaccaggugaugcucugcgagcccacgaucaucgagcgcaacaucaccgagaucgucuaccugaccaacaccacgaucgagaaggagaucugccccaagcuggccgaguaccggaacugguccaagccgcagugcaagaucaccggguucgcgcccuucucgaaggacaacuccauccgccucagcgccggcggggacaucugggugacccgggagcccuacguguccugcgaccccggcaagugcuaccaguucgcccuggggcagggcaccacgcugaacaaccgccacucgaacaacaccguccacgaccggaccccguaccgcacccuccugaugaacgagcugggcgugcccuuccaccucgggacgaagcaggucugcaucgccugguccagcuccucgugccacgacggcaaggccuggcugcacgugugcgugaccgggcacaacgagaacgcgaccgccuccuucaucuacgacggccggcugguggacagcaucggguccuggucgaagaacauccuccgcacccaggaguccgagugcgucugcaucaacggcacgugcaccguggugaugaccgacggcagcgccuccgggcgggccgacaccaagauccuguucaucaaggagggcaagaucguccacgugucgccccugagcggguccgcgcagcacguggaggagugcucgugcuacccccgcuacccgggcguccggugcgugugccgcgacaacuggaagggcuccaaccggcccaucguggacaucaacgucaaggacuacagcaucguguccucguacgugugcuccgggcucgucggcgacacgccccgcaagaacgacagcuccucguccagcuacugccuggaccccaacaacgaggagggcgggcacggggugaagggcugggccuucgacgacggcaacgacgucuggauggggcggaccaucuccgagaagcugcgcucgggcuacgagaccuucaaggugaucgggggcugguccaagccgaacagcaagcuccagaucaaccgccaggugaucgucgacaaggggaaccgguccggcuacucgggcaucuucuccguggagggcaagagcugcaucaaccggugcuucuacguggagcugauccgcgggcggaagcaggagaccgaggucugguggacgucgaacuccaucgugguguucugcgggaccagcggcaccuacgggaccggcuccuggcccgacggcgccgacaucaaccugaugcccaucuga

SEQ ID NO: 17299 - RNA, 1410 nt, Artificial Sequence; identical to SEQ ID NO: 17294
  derived and/or modified CDS sequence (AUadapt) from InfluenzaA__ABD79181__NA

SEQ ID NO: 17300 - RNA, 1410 nt, Artificial Sequence; identical to SEQ ID NO: 17294
  derived and/or modified CDS sequence (AUadapt) from InfluenzaA__ABD79192__NA

SEQ ID NO: 17301 - RNA, 1410 nt, Artificial Sequence
  derived and/or modified CDS sequence (AUadapt) from InfluenzaA__ABD79203__NA
augaaccccaaccagaagaucaucaccaucggcucggugucccugaccaucacgaccaucugcuuccucaugcagaucgccauccuggucaucaccgugacccugcacuucaagcagugcgagugcaacucgccgcccaacaaccaggugaugcucugcgagcccacgaucaucgagcgcaacaucaccgagaucgucuaccugaccaacaccacgaucgagaaggagaagugccccaagcuggccgaguaccggaacugguccaagccgcagugcaagaucaccggguucgcgcccuucagcaaggacaacuccauccgccucucggccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccucguccagcugccacgacggcaaggccuggcugcacgugugcgugaccgggcacaacgagaacgcgaccgccuccuucaucuacgacggccggcugguggacucgaucggguccuggagcaagaacauccuccgcacccaggaguccgagugcgucugcaucaacggcacgugcaccguggugaugaccgacggcucggccuccgggcgggccgacaccaagauccuguucaucgaggagggcaagaucguccacaucagcccccugucgggguccgcgcagcacguggaggagugcucgugcuacccccgcuacccgggcgugcggugcgucugccgcgacaacuggaagggcuccaaccggcccaucguggacaucaacaugaaggacuacagcaucguguccucguacgucugcuccgggcucgugggcgacacgccccgcaagaacgacagcuccucguccagcuacugccuggaccccaacaacgaggagggcgggcacggggugaagggcugggccuucgacgacggcaacgacgucuggauggggcggaccaucuccgagaagcugcgcucgggcuacgagaccuucaaggugaucgggggcugguccaagccgaacagcaagcuccagaucaaccggcaggucaucguggacaaggggaaccgcuccggcuacucgggcaucuucuccguggagggcaagagcugcaucaaccggugcuucuacgucgagcugauccgcgggcggaagcaggagaccgaggugugguggacgucgaacuccaucguggucuucugcgggaccagcggcaccuacgggaccggcuccuggcccgacggcgccgacaucaaccugaugcccaucuga

SEQ ID NO: 17302 - RNA, 1410 nt, Artificial Sequence; identical to SEQ ID NO: 17294
  derived and/or modified CDS sequence (AUadapt) from InfluenzaA__ABD79214__NA

SEQ ID NO: 17303 - RNA, 1410 nt, Artificial Sequence
  derived and/or modified CDS sequence (AUadapt) from InfluenzaA__ABD79236__NA
augaaccccaaccagaagaucaucaccaucggcucggugucccugaccaucacgaccaucugcuuccucaugcagaucgccauccuggucaucaccgugacccugcacuucaagcagugcgagugcaacucgccgcccaacaaccaggugaugcucugcgagcccacgaucaucgagcgcaacaucaccgagaucgucuaccugaccaacaccacgaucgagaaggagaucugccccaagcuggccgaguaccggaacugguccaagccgcagugcaagaucaccggguucgcgcccuucagcaaggacaacuccauccgccucucggccggcggggacaucugggugacccgggagcccuacguguccugcgaccccggcaagugcuaccaguucgcccuggggcagggcaccacgcugaacaaccgccacagcaacaacaccgcccacgaccggaccccguaccgcacccuccugaugaacgagcugggcguccccuuccaccucgggacgaagcaggucugcaucgccugguccucguccagcugccacgacggcaaggcguggcugcacgugugcgugaccgggcacaacgagaacgccaccgccuccuucaucuacgacggccggcugguggacucgaucggguccuggagcaagaacauccuccgcacccaggaguccgagugcgugugcaucaacggcacgugcaccgucgugaugaccgacggcucggccuccgggcgggcggacaccaagauccuguucaucaaggagggcaagaucgugcacaucagcccccugucgggguccgcccagcacgucgaggagugcucgugcuacccccgcuacccgggcgugcggugcgugugccgcgacaacuggaagggcuccaaccggcccaucgucgacaucaacgugaaggacuacagcaucguguccucguacgucugcuccgggcucgugggcgacacgccccgcaagaacgacagcuccucguccagcuacugccuggaccccaacaacgaggagggcgggcacggggugaagggcugggccuucgacgacggcaacgacgucuggauggggcggaccaucuccgagaagcugcgcucgggcuacgagaccuucaaggugaucgggggcugguccaagccgaacagcaagcuccagaucaaccggcaggucaucguggacaaggggaaccgcuccggcuacucgggcaucuucuccguggagggcaagagcugcaucaaccggugcuucuacgucgagcugauccgcgggcggaagcaggagaccgaggugugguggacgucgaacuccaucguggucuucugcgggaccagcggcaccuacgggaccggcuccuggcccgacggcgccgacaucaaccugaugcccaucuga

SEQ ID NO: 17304 - RNA, 1410 nt, Artificial Sequence
  derived and/or modified CDS sequence (AUadapt) from InfluenzaA__ABD79247__NA
augaaccccaaccagaagaucaucaccaucggcucggugucccugaccaucacgaccaucugcuuccucaugcagaucgccauccuggucaucaccgugacccugcacuucaagcagugcgagugcaacccgccgcccaacaaccaggugaugcucugcgagcccacgaucaucgagcgcaacaucaccgagaucgucuaccugaccaacaccacgaucgagaaggagaucugccccaagcuggccgaguaccggaacuggucgaagccccagugcaagaucaccggguucgcgcccuucuccaaggacaacagcauccgccucuccgccggcggggacaucugggugacccgggagcccuacgugucgugcgacccgggcaagugcuaccaguucgcccuggggcagggcaccacgcugaacaaccgccacuccaacgacaccguccacgaccggacccccuaccgcacccuccugaugaacgagcugggcgugcccuuccaccucgggacgaagcaggucugcaucgccuggagcuccucguccugccacgacggcaaggccuggcugcacgugugcgugaccgggcacaacgagaacgcgaccgccagcuucaucuacgacggccggcugguggacuccaucgggucgugguccaagaacauccuccgcacccaggagagcgagugcgucugcaucaacggcacgugcaccguggugaugaccgacggcuccgccucggggcgggccgacaccaagauccuguucaucgaggagggcaagaucguccacaucagcccccuguccgggucggcgcagcacguggaggagugcuccugcuacccgcgcuaccccggcgugcggugcgucugccgcgacaacuggaagggcucgaaccggcccaucguggacaucaacgugaaggacuacuccaucgucagcuccuacgugugcucggggcucgugggcgacacgccccgcaagaacgacuccagcuccucguccuacugccuggacccgaacaacgaggagggcgggcacggggucaagggcugggccuucgacgacggcaacgacguguggauggggcggaccaucagcgagaagcugcgcuccggcuacgagaccuucaaggucaugggcggguggucgaagcccaacuccaagcuccagaucaaccgccaggugaucguggaccgggggaaccggagcggcuacuccggcaucuucucggucgaggggaaguccugcaucaaccgcugcuucuacguggagcugauccggggccgcaagcaggagaccgaggugugguggacgagcaacucgaucgucguguucugcgggaccuccggcaccuacgggaccggcagcuggcccgacggcgccgacaucaaccugaugcccaucuga

SEQ ID NO: 17305 - RNA, 1410 nt, Artificial Sequence; identical to SEQ ID NO: 16729
  derived and/or modified CDS sequence (AUadapt) from InfluenzaA__ABD94737__NA

SEQ ID NO: 17306 - RNA, 1410 nt, Artificial Sequence; identical to SEQ ID NO: 17114
  derived and/or modified CDS sequence (AUadapt) from InfluenzaA__ABD94748__NA

SEQ ID NO: 17307 - RNA, 1413 nt, Artificial Sequence; identical to SEQ ID NO: 17230
  derived and/or modified CDS sequence (AUadapt) from InfluenzaA__ABD94759__NA

SEQ ID NO: 17308 - RNA, 1410 nt, Artificial Sequence; identical to SEQ ID NO: 16463
  derived and/or modified CDS sequence (AUadapt) from InfluenzaA__ABD94770__NA

SEQ ID NO: 17309 - RNA, 1413 nt, Artificial Sequence; identical to SEQ ID NO: 16798
  derived and/or modified CDS sequence (AUadapt) from InfluenzaA__ABD94792__NA

SEQ ID NO: 17310 - RNA, 1413 nt, Artificial Sequence; identical to SEQ ID NO: 16798
  derived and/or modified CDS sequence (AUadapt) from InfluenzaA__ABD94803__NA

SEQ ID NO: 17311 - RNA, 1413 nt, Artificial Sequence; identical to SEQ ID NO: 16798
  derived and/or modified CDS sequence (AUadapt) from InfluenzaA__ABD94814__NA

SEQ ID NO: 17312 - RNA, 1410 nt, Artificial Sequence; identical to SEQ ID NO: 16975
  derived and/or modified CDS sequence (AUadapt) from InfluenzaA__ABD94825__NA

SEQ ID NO: 17313 - RNA, 1410 nt, Artificial Sequence
  derived and/or modified CDS sequence (AUadapt) from InfluenzaA__ABD94847__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccaagaucaucgagcgcaacaucacggagaucgucuaccugaccaacaccaccaucgagaaggagaucugccccaagcuggcggaguaccggaacugguccaagccgcagugcaagaucacgggguucgcccccuucagcaaggacaacuccauccgccucucggccggcggggacaucugggugacccgggagcccuacguguccugcgaccccgacaagugcuaccaguucgcccugggccaggggaccacccugaacaaccgccacagcaacgacacgguccacgaccggaccccguaccgcacccuccugaugaacgagcugggcgugcccuuccaccucggcaccaagcaggucugcaucgccugguccucguccagcugccacgacgggaaggcguggcugcacgugugcgugacgggccacgacgagaacgccaccgccuccuucaucuacgacgggcggcugguggacucgaucggcuccuggagcaagaagauccuccgcacccaggaguccgagugcgucugcaucaacgggaccugcacgguggugaugaccgacggcucggccuccggccgggcggucaccaagauccuguucaucgaggaggggaagaucgugcacaucagcccccugcucggcucggcccagcacguggaggagugcuccugcuacccccgcuacccggggguccggugcgugugccgcgacaacuggaagggcucgaaccggcccaucguggacaucaacgucaaggacuacuccaucgugagcuccuacgugugcucgggccuggucggggacacgccccgcaagaacgacuccagcuccucgucccacugccugaaccccaacaacgaggagggcgggcacggcgugaaggggugggccuucgacgacggcaacgacgucuggaugggccggaccaucagcgagaagcuccgcuccggguacgagaccuucaaggugaucgagggcuggucgaagccgaacuccaagcugcagaucaaccgccaggugaucgucgaccgggggaaccggagcggcuacuccgggaucuucucgguggagggcaaguccugcaucaaccgcugcuucuacguggagcugauccggggccgcaagcaggagaccgaggucugguggaccagcaacucgaucgugguguucugcgggacguccggcaccuacgggaccggcagcuggcccgacggggccgacaucaaccucaugcccaucuga

SEQ ID NO: 17314 - RNA, 1410 nt, Artificial Sequence; identical to SEQ ID NO: 16528
  derived and/or modified CDS sequence (AUadapt) from InfluenzaA__ABD94858__NA

SEQ ID NO: 17315 - RNA, 1410 nt, Artificial Sequence; identical to SEQ ID NO: 16528
  derived and/or modified CDS sequence (AUadapt) from InfluenzaA__ABD94880__NA

SEQ ID NO: 17316 - RNA, 1410 nt, Artificial Sequence
  derived and/or modified CDS sequence (AUadapt) from InfluenzaA__ABD94891__NA
augaaccccaaccagaagaucaucaccaucggcucggugucccugaccaucacgaccaucugcuuccucaugcagaucgccauccuggucaucaccgugacccugcacuucaagcagugcgagugcaacagcccgcccaacaaccaggugaugcucugcgagcccacgaucaucgagcgcaacaucaccgagaucgucuaccugaccaacaccacgaucgagaaggagaucugccccaagcuggccgaguaccggaacugguccaagccgcagugcaagaucaccggguucgcgcccuucucgaaggacaacuccauccgccucagcgccggcggggacaucugggugacccgggagcccuacguguccugcgaccccggcaagugcuaccaguucgcccuggggcagggcaccacgcugaacaaccgccacucgaacgacaccguccacgaccggaccccguaccgcacccuccugaugaacgagcugggcgugcccuuccaccucgggacgaagcaggucugcaucgccugguccagcuccucgugccacgacggcaaggccuggcugcacgugugcgugaccgggcacaacgagaacgcgaccgccuccuucaucuacgacggccggcugguggacagcaucggguccuggucgaagaacauccuccgcacccaggaguccgagugcgucugcaucaacggcacgugcaccguggugaugaccgacggcagcgccuccgggcgggccgacaccaagguccuguucaucgaggagggcaagaucgugcacaucucgcagcugagcggguccgcgcagcacguggaggagugcucgugcuacccccgcuaccccggcguccggugcgugugccgcgacaacuggaagggcuccaaccggccgaucguggacaucaacgucaaggacuacagcaucguguccucguacgugugcuccgggcucgucggcgacacgccccgcaagaacgacagcuccucguccagcuacugccuggaccccaacaacgaggagggcgggcacggggugaagggcugggccuucgacgacggcaacgacgucuggauggggcggaccaucuccgagaagcugcgcucgggcuacgagaccuucaaggugaucgggggcugguccaagcccaacagcaagcuccagaucaaccgccaggugaucgucgaccgggggaaccgguccggcuacucgggcaucuucuccguggagggcaagagcugcaucaaccgcugcuucuacguggagcugauccgggggcgcaagcaggagaccgaggucugguggacgucgaacuccaucgugguguucugcgggaccagcggcaccuacgggaccggcuccuggccggacggcgccgacaucaaccugaugcccaucuga

SEQ ID NO: 17317 - RNA, 1410 nt, Artificial Sequence; identical to SEQ ID NO: 17294
  derived and/or modified CDS sequence (AUadapt) from InfluenzaA__ABD94902__NA

SEQ ID NO: 17318 - RNA, 1410 nt, Artificial Sequence
  derived and/or modified CDS sequence (AUadapt) from InfluenzaA__ABD94924__NA
augaaccccaaccagaagaucaucaccaucggcucggugucccugaccaucgccacgaucugccuccugaugcagaucgccauccuggucaccaccgugacccuccacuucaagcaguacgagugcaacucgccgcccaacaaccaggugaugcugugcgagcccacgaucaucgagcgcaacaucaccgagaucgucuaccugaccaacaccacgaucgagaaggagaucugccccaagcucgcggaguaccggaacugguccaagccgcagugcaagaucaccggguucgcccccuucagcaaggacaacuccauccgccugucggccggcggggacaucugggugacccgggagcccuacguguccugcgaccccgacaagugcuaccaguucgcccugggccaggggaccacgcucaacaaccgccacucgaacgacaccguccacgaccggaccccguaccgcacccugcugaugaacgagcucggcgugcccuuccaccugggcacgaagcaggucugcaucgccugguccagcuccucgugccacgacgggaaggcguggcugcacgugugcgugaccggccacgacgagaacgccaccgccuccuucaucuacgacgggcggcucguggacagcaucggcuccuggucgaagaagauccugcgcacccaggaguccgagugcgucugcaucaacgggacgugcaccguggugaugaccgacggcucggccuccggccgggcggacaccaagauccuguucaucgaggaggggaagaucguccacaucagccagcuccugggcucggcccagcacguggaggagugcuccugcuacccccgcuaccccggggugcggugcgucugccgcgacaacuggaagggcucgaaccggccgaucguggacaucaacgugaaggacuacuccaucgucagcuccuacgugugcucgggccuggugggggacacgccccgcaagaacgacuccagcuccucgucccacugccucaaccccaacaacgaggagggcgggcacggcgucaaggggugggccuucgacgacggcaacgacguguggaugggccggaccaucucggagaagcugcgcuccggguacgagaccuucaaggucaucgagggcuggagcaagcccaacuccaagcugcagaucaaccgccaggugaucguggaccgggggaaccggucgggcuacuccgggaucuucucggucgagggcaaguccugcaucaaccgcugcuucuacguggagcucauccggggccgcaagcaggagaccgaggugugguggacgagcaacucgaucgucguguucugcgggaccuccggcaccuacgggaccggcagcuggccggacggggccgacaucaaccugaugcccaucuga

SEQ ID NO: 17319 - RNA, 1410 nt, Artificial Sequence
  derived and/or modified CDS sequence (AUadapt) from InfluenzaA__ABD94946__NA
augaaccccaaccagaagaucaucaccaucggcucggugucccugaccaucgccacgaucugcuuccucacccagaucgccauccuggucaccaccgugacgcugcacuucaagcaguacgagugcaacucgccgcccaacaaccaggugaugcucugcgagcccaccaucaucgagcgcaacaucaccgagaucgucuaccugaccaacacgaccaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggacgacccugaacaacggccacucgaacgacaccguccacgaccgcaccccguaccggacgcuccugaugaacgagcugggcgugcccuuccaccucgggaccaagcaggucugcaucgccugguccagcuccucgugccacgacggcaaggcguggcugcacgugugcgugaccggggacgacaagaacgccaccgccuccuucaucuacaacggccgccugguggacucgaucggguccuggagcaagaagauccuccggacgcaggaguccgagugcgucugcaucaacgggaccugcaccguggugaugaccgacggcucggccuccgggaaggcggacacgaagauccuguucaucgaggagggcaagaucguccacaccucgcugcucagcggguccgcccagcacguggaggagugcucgugcuacccccgcuaccccggcgugcggugcgucugccgcgacaacuggaagggcuccaaccggccgaucguggacaucaacgugaaggacuacucgaucgucuccagcuacgugugcuccgggcuggugggcgacacgccccgcaagaacgaccggucguccucgucccacugccuggaccccaacaacgaggagggcggccacggggucaagggcugggccuucgacgacggcaacgacguguggauggggcgcaccaucagcgagaagcuccgguccggcuacgagaccuucaaggucaucgagggguggucgaagcccaacuccaagcugcagaucaaccgccaggugaucguggaccgggacaaccgcucgggcuacuccgggaucuucagcgucgagggcaaguccugcaucaaccggugcuucuacguggagcugauccgcggccggaaccaggagaccgaggugcucuggaccucgaacucgaucgucguguucugcgggaccuccggcacguacgggaccggcagcuggccggacggggccgacaucaaccugaugcccaucuga

SEQ ID NO: 17320 - RNA, 1410 nt, Artificial Sequence
  derived and/or modified CDS sequence (AUadapt) from InfluenzaA__ABD94957__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggucguccagcuccugccacgacgggaaggccuggcuccacgugugcgugaccggcgacgacaagaacgcgaccgccucguucaucuacaacgggcgccugguggacuccaucgucagcugguccaagaagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcucgggccuggugggcgacacgccccgcaagaacgacuccagcuccucgucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggucgggguacuccggcaucuucagcgucgagucgaaguccugcaucaaccgcugcuucuacguggagcucauccgggggcgcaaggaggagaccgaggugcuguggaccagcaacuccaucgucguguucugcggcaccagcggcacguacgggaccggcuccuggccggacggggccgacaucaaccugaugcccaucuga

SEQ ID NO: 17321 - RNA, 1413 nt, Artificial Sequence; identical to SEQ ID NO: 17230
  derived and/or modified CDS sequence (AUadapt) from InfluenzaA__ABD94968__NA

SEQ ID NO: 17322 - RNA, 1413 nt, Artificial Sequence; identical to SEQ ID NO: 17230
  derived and/or modified CDS sequence (AUadapt) from InfluenzaA__ABD94990__NA

SEQ ID NO: 17323 - RNA, 1413 nt, Artificial Sequence
  derived and/or modified CDS sequence (AUadapt) from InfluenzaA__ABD95001__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacauccacaacacgaacgugguggcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagucggagugcgugugcgugaacggcuccugcuucaccaucaugacggacgggcccagcaacggcgccgccuccuacaagaucuucaagaucgagaaggggaaggucaccaagucgaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcucgggcguguucggggacaacccccgccccaaggacggcgagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccgacaccgacagcaacuucuccaugaagcaggacgucguggccaucacggacuggucgggguacagcggcuccuucgugcagcaccccgagcucaccggccuggacugcauccgccccugcuucugggucgagcuggugcgggggcucccgcgcgagaacaccaccaucuggacgucgggcuccagcaucuccuucugcggggucaacagcgacaccgccaacugguccuggcccgacggcgccgagcugcccuucaccaucgacaaguga

SEQ ID NO: 17324 - RNA, 1413 nt, Artificial Sequence
  derived and/or modified CDS sequence (AUadapt) from InfluenzaA__ABD95012__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagucggagugcgugugcgugaacggcuccugcuucaccaucaugacggacgggcccagcaacggcgccgccuccuacaagaucuucaagaucgagaaggggaaggucaccaagucgaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcucgggcguguucggggacaacccccgccccaaggacggcgagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccaacaccgacagcaacuucuccgucaagcaggacgugguggccaucacggacuggucgggguacagcggcuccuucguccagcaccccgagcucaccggccuggacugcauccgccccugcuucuggguggagcugguccgggggcucccgcgcgagaacaccaccaucuggacgucgggcuccagcaucuccuucugcggggugaacagcgacaccgccaacugguccuggcccgacggcgccgagcugcccuucaccaucgacaaguga

SEQ ID NO: 17325 - RNA, 1413 nt, Artificial Sequence; identical to SEQ ID NO: 17230
  derived and/or modified CDS sequence (AUadapt) from InfluenzaA__ABD95023__NA

SEQ ID NO: 17326 - RNA, 1413 nt, Artificial Sequence
  derived and/or modified CDS sequence (AUadapt) from InfluenzaA__ABD95034__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagucggagugcgugugcgugaacggcuccugcuucaccaucaugacggacgggcccagcaacggcgccgccuccuacaagaucuucaagaucgagaaggggaaggucaccaagucgaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcucgggcguguucggggacaacccccgccccaaggacggcgagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccgacaccgacagcaacuucuccgucaagcaggacgugguggccaucacggacuggucgggguacagcggcuccuucauccagcaccccgagcucaccggccuggacugcauccgccccugcuucugggucgagcuggugcgggggcucccgcgcgagaacaccaccaucuggacgucgggcuccagcaucuccuucugcggggucaacagcgacaccgccaacugguccuggcccgacggcgccgagcugcccuucaccaucgacaaguga

SEQ ID NO: 17327 - RNA, 1413 nt, Artificial Sequence
  derived and/or modified CDS sequence (AUadapt) from InfluenzaA__ABD95056__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcgugugcaaccagcgcaucaucaccuacgagaacuccaccugggucaaccacaccuacgugaacaucaacaacacgaacgugaucgcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcagauccugcgcacccaggagucggagugcgugugcgugaacggcuccugcuucaccaucaugacggacgggcccagcaacggcgccgccuccuacaagaucuucaagaucgagaaggggaagaucaccaagucgaucgagcucaacgcccccaacuuccacuacgaggagugcuccugcuacccggacaccggcaccgucaugugcgugugccgggacaacuggcacgggagcaaccgccccuggguguccuucaaccagaaccuggacuaccagaucggcuacaucugcucgggcgucuucggggacaacccccggcccaaggacggcgagggguccugcaacccggugacgguggacggcgcgaacggggucaagggcuucagcuacaaguacggcaacgggguguggaucggccgcaccaaguccaaccggcugcgcaagggguucgagaugaucugggaccccaacggcuggaccgacaccgacagcgacuucuccgugaagcaggacgucguggccaucacggacuggucgggguacagcggcuccuucgugcagcaccccgagcucaccggccugaacugcauccggcccugcuucugggucgagcuggugcgcgggcucccgaaggagaacaccaccaucuggacgucgggcuccagcaucuccuucugcggggucaacagcgacaccgccaacugguccuggcccgacggcgccgagcugcccuucaccaucgacaaguga

SEQ ID NO: 17328 - RNA, 1413 nt, Artificial Sequence; identical to SEQ ID NO: 16798
  derived and/or modified CDS sequence (AUadapt) from InfluenzaA__ABD95067__NA

SEQ ID NO: 17329 - RNA, 1413 nt, Artificial Sequence; identical to SEQ ID NO: 16798
  derived and/or modified CDS sequence (AUadapt) from InfluenzaA__ABD95078__NA

SEQ ID NO: 17330 - RNA, 1413 nt, Artificial Sequence; identical to SEQ ID NO: 17327
  derived and/or modified CDS sequence (AUadapt) from InfluenzaA__ABD95089__NA

SEQ ID NO: 17331 - RNA, 1413 nt, Artificial Sequence; identical to SEQ ID NO: 16798
  derived and/or modified CDS sequence (AUadapt) from InfluenzaA__ABD95100__NA

SEQ ID NO: 17332 - RNA, 1413 nt, Artificial Sequence
  derived and/or modified CDS sequence (AUadapt) from InfluenzaA__ABD95111__NA
augaaccccaaccagaagaucaucaccaucggcucgaucuccaucgccaucgggaugaucagccugaugcuccagaucggcaacaucaucuccaucugggccucgcacuccauccagaccgggagccagaaccacacgggcgugugcaaccagcgcaucaucaccuacgagaacuccaccugggucaaccacaccuacgugaacaucaacaacacgaacgugaucgcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcagauccugcgcacccaggagucggagugcgugugcgugaacggcuccugcuucaccaucaugacggacgggcccagcaacggcgccgccuccuacaagaucuucaagaucgagaaggggaaggucaccaagucgaucgagcucaacgcccccaacuuccacuacgaggagugcuccugcuacccggacaccggcaccgugaugugcgugugccgggacaacuggcacgggagcaaccgccccugggucuccuucaaccagaaccuggacuaccagaucggcuacaucugcucgggcguguucggggacaacccccggcccaaggacggcgagggguccugcaacccggugacggucgacggcgcgaacggggugaagggcuucagcuacaaguacggcaacgggguguggaucggccgcaccaaguccaaccggcugcgcaagggguucgagaugaucugggaccccaacggcuggaccgacaccgacagcgacuucuccgucaagcaggacgugguggccaucacggacuggucgggguacagcggcuccuucguccagcaccccgagcucaccggccuggacugcauccggcccugcuucuggguggagcugguccgcgggcucccgaaggagaacaccaccaucuggacgucgggcuccagcaucuccuucugcggggugaacagcgacaccgccaacugguccuggcccgacggcgccgagcugcccuucaccaucgacaaguga

SEQ ID NO: 17333 - RNA, 1413 nt, Artificial Sequence; identical to SEQ ID NO: 17332
  derived and/or modified CDS sequence (AUadapt) from InfluenzaA__ABD95122__NA

SEQ ID NO: 17334 - RNA, 1413 nt, Artificial Sequence; identical to SEQ ID NO: 16798
  derived and/or modified CDS sequence (AUadapt) from InfluenzaA__ABD95144__NA

SEQ ID NO: 17335 - RNA, 1413 nt, Artificial Sequence; identical to SEQ ID NO: 16798
  derived and/or modified CDS sequence (AUadapt) from InfluenzaA__ABD95155__NA

SEQ ID NO: 17336 - RNA, 1413 nt, Artificial Sequence
  derived and/or modified CDS sequence (AUadapt) from InfluenzaA__ABD95166__NA
augaaccccaaccagaagaucaucaccaucggcucgaucuccaucgccaucgggaugaucagccugaugcuccagaucggcaacaucaucuccaucugggccucgcacuccauccagaccgggagccagaaccacacgggcgugugcaaccagcgcaucaucaccuacgagaacuccaccugggucaaccacaccuacgugaacaucaacaacacgaacgugaucgcggagaaggacaagaccucggucacccuggccgggaacuccagccugugcuccaucagcggcugggccaucuacaccaaggacaacuccauccggaucggcucgaagggggacguguucgugauccgcgagccguucaucuccugcagccaccucgagugccggacguucuuccugacccagggcgcccugcucaacgacaagcacuccaacgggaccgucaaggaccgcucgcccuaccgggcccugauguccugcccccugggcgaggcgcccagcccguacaacucgaaguucgaguccguggccuggagcgccuccgccugccacgacgggaugggcuggcucaccaucggcaucagcgggcccgacaacggcgcgguggccguccugaaguacaacgggaucaucacggagaccaucaaguccuggaagaagcagauccugcgcacccaggagucggagugcgugugcgugaacggcuccugcuucaccaucaugacggacggccccagcaacggggccgccuccuacaagaucuucaagaucgagaagggcaaggucaccaagucgaucgagcucaacgcccccaacuuccacuacgaggagugcuccugcuacccggacaccgggaccgugaugugcgugugccgggacaacuggcacggcagcaaccgccccugggucuccuucaaccagaaccuggacuaccagaucggguacaucugcucgggcguguucggcgacaacccccggcccaaggacggggagggcuccugcaacccggugacggucgacggggcgaacggcgugaagggguucagcuacaaguacggcaacggcguguggaucgggcgcaccaaguccaaccggcugcgcaagggcuucgagaugaucugggaccccaacggguggaccgacaccgacagcgacuucuccgucaagcaggacgugguggccaucacggacuggucgggcuacagcggguccuucguccagcaccccgagcucaccggccuggacugcauccggcccugcuucuggguggagcugguccgcggccucccgaaggagaacaccaccaucuggacgucgggguccagcaucuccuucugcggcgugaacagcgacaccgccaacugguccuggcccgacggggccgagcugcccuucaccaucgacaaguga

SEQ ID NO: 17337 - RNA, 1413 nt, Artificial Sequence; identical to SEQ ID NO: 17327
  derived and/or modified CDS sequence (AUadapt) from InfluenzaA__ABD95177__NA

SEQ ID NO: 17338 - RNA, 1413 nt, Artificial Sequence
  derived and/or modified CDS sequence (AUadapt) from InfluenzaA__ABD95188__NA
augaaccccaaccagaagaucaucaccaucggcucgaucuccaccacgaucgggaucaucagccugaugcuccagaucggcaacaucaucuccaucugggccucgcacuccauccagaccgggagccagaaccacaccggcgugugcaaccagcgcaucaucaccuacgagaacuccacgugggucaaccacaccuacgugaacaucaacaacaccaacgugaucgccgggaaggacaagaccucggucacgcuggcgggcaacuccagccugugcuccaucucgggcugggccaucuacaccaaggacaacuccauccggaucgggagcaagggcgacguguucgugauccgcgagccguucaucuccugcucgcaccucgagugccggaccuucuuccugacccagggggcccugcucaacgacaagcacuccaacggcacggucaaggaccgcagccccuaccgggcccugauguccugcccccugggggaggcccccucgccguacaacagcaaguucgaguccguggcguggagcgccuccgccugccacgacggcaugggcuggcucaccaucgggaucucgggccccgacaacggggccguggcgguccugaaguacaacggcaucaucaccgagaccaucaaguccuggaagaagcagauccugcgcacgcaggagagcgagugcgugugcgugaacggcuccugcuucaccaucaugaccgacgggcccucgaacggcgccgccuccuacaagaucuucaagaucgagaaggggaaggucaccaagagcaucgagcucaacgcccccaacuuccacuacgaggagugcuccugcuacccggacacgggcaccgugaugugcgugugccgggacaacuggcacgggucgaaccgccccugggucuccuucaaccagaaccuggacuaccagaucggcuacaucugcagcggcguguucggggacaacccccggcccaaggacggcgagggguccugcaacccggugaccgucgacggcgccaacggggugaagggcuucucguacaaguacggcaacgggguguggaucggccgcaccaaguccaaccggcugcgcaagggguucgagaugaucugggaccccaacggcuggacggacaccgacagcgacuucuccgucaagcaggacgugguggcgaucaccgacuggucgggguacagcggcuccuucguccagcaccccgagcucaccggccuggacugcauccggcccugcuucuggguggagcugguccgcgggcucccgaaggagaacacgaccaucuggaccucgggcuccagcaucuccuucugcggggugaacagcgacaccgccaacugguccuggcccgacggcgccgagcugcccuucacgaucgacaaguga

SEQ ID NO: 17339 - RNA, 1413 nt, Artificial Sequence; identical to SEQ ID NO: 17327
  derived and/or modified CDS sequence (AUadapt) from InfluenzaA__ABD95199__NA

SEQ ID NO: 17340 - RNA, 1413 nt, Artificial Sequence; identical to SEQ ID NO: 16817
  derived and/or modified CDS sequence (AUadapt) from InfluenzaA__ABD95210__NA

SEQ ID NO: 17341 - RNA, 1413 nt, Artificial Sequence
  derived and/or modified CDS sequence (AUadapt) from InfluenzaA__ABD95221__NA
augaaccccaaccagaagaucaucaccaucggcucgaucuccaucgccaucgggaugaucagccugaugcuccagaucggcaacaucaucuccaucugggccucgcacuccauccagaccgggagccagaaccacacgggcgugugcaaccagcgcaucaucaccuacgagaacuccaccugggucaaccacaccuacgugaacaucaacaacacgaacgugaucgcggggaaggacaagaccucggucacccuggccggcaacuccagccugugcuccaucucgggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggucggccuccgccugccacgacggcaugggcuggcucaccaucgggaucagcggccccgacaacggggcgguggccguccugaaguacaacggcaucaucacggagaccaucaaguccuggaagaagcagauccugcgcacccaggagucggagugcgugugcgugaacggcuccugcuucaccaucaugacggacgggcccagcaacggcgccgccuccuacaagaucuucaagaucgagaaggggaaggucaccaagucgaucgagcucaacgcccccaacucccacuacgaggagugcagcugcuacccggacaccggcaccgugaugugcgugugccgggacaacuggcacggguccaaccgccccugggucucguucaaccagaaccuggacuaccagaucggcuacaucugcuccggcguguucggggacaacccccggcccaaggacggcgaggggagcugcaacccggugacggucgacggcgcgaacggggugaagggcuucuccuacaaguacggcaacgggguguggaucggccgcaccaagucgaaccggcugcgcaagggguucgagaugaucugggaccccaacggcuggaccgacaccgacuccgacuucagcgucaagcaggacgugguggccaucacggacuggucgggguacuccggcagcuucguccagcaccccgagcucaccggccuggacugcauccggcccugcuucuggguggagcugguccgcgggcucccgaaggagaacaccaccaucuggacguccggcucguccaucagcuucugcggggugaacuccgacaccgccaacuggagcuggcccgacggcgccgagcugcccuucaccaucgacaaguga

SEQ ID NO: 17342 - RNA, 1413 nt, Artificial Sequence; identical to SEQ ID NO: 17332
  derived and/or modified CDS sequence (AUadapt) from InfluenzaA__ABD95232__NA

SEQ ID NO: 17343 - RNA, 1413 nt, Artificial Sequence; identical to SEQ ID NO: 16798
  derived and/or modified CDS sequence (AUadapt) from InfluenzaA__ABD95243__NA

SEQ ID NO: 17344 - RNA, 1413 nt, Artificial Sequence; identical to SEQ ID NO: 17332
  derived and/or modified CDS sequence (AUadapt) from InfluenzaA__ABD95254__NA

SEQ ID NO: 17345 - RNA, 1413 nt, Artificial Sequence; identical to SEQ ID NO: 16817
  derived and/or modified CDS sequence (AUadapt) from InfluenzaA__ABD95265__NA

SEQ ID NO: 17346 - RNA, 1413 nt, Artificial Sequence; identical to SEQ ID NO: 16798
  derived and/or modified CDS sequence (AUadapt) from InfluenzaA__ABD95276__NA

SEQ ID NO: 17347 - RNA, 1413 nt, Artificial Sequence
  derived and/or modified CDS sequence (AUadapt) from InfluenzaA__ABD95287__NA
augaaccccaaccagaagaucaucaccaucggcucgaucuccguggccaucgggaucaucagccugaugcuccagaucggcaacaucaucuccaucugggccucgcacuccauccagaccgggagccagaaccacacgggcgucugcaaccagcgcaucaucaccuacgagaacuccaccugggugaaccacaccuacgugaacaucaacaacacgaacgucaucgcggggaaggacaagaccucggugacccuggccggcaacuccagccugugcuccaucagcggcugggccaucuacaccaaggacaacuccauccggaucgggucgaagggcgacguguucgucauccgcgagccguucaucuccugcagccaccucgagugccggacguucuuccugacccagggggcccugcucaacgacaagcacuccaacggcaccgugaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcggucgccgugcugaaguacaacggcaucaucacggagaccaucaaguccuggaagaagcagauccugcgcacccaggagucggagugcgugugcgucaacggcuccugcuucaccaucaugacggacgggcccagcaacggcgccgccuccuacaagaucuucaagaucgagaaggggaaggugaccaagucgaucgagcucaacgcccccaacuuccacuacgaggagugcuccugcuacccggacaccggcaccgugaugugcgucugccgggacaacuggcacgggagcaaccgccccuggguguccuucaaccagaaccuggacuaccagaucggcuacaucugcucgggcguguucggggacaacccccggcccaaggacggcgagggguccugcaacccggucacgguggacggcgcgaacggggugaagggcuucagcuacaaguacggcaacggggucuggaucggccgcaccaaguccaaccggcugcgcaagggguucgagaugaucugggaccccaacggcuggaccgacaccgacagcgacuucuccgugaagcaggacguggucgccaucacggacuggucgggguacagcggcuccuucgugcagcaccccgagcucaccggccuggacugcauccggcccugcuucugggucgagcuggugcgcgggcucccgaaggagaacaccaccaucuggacgucgggcuccagcaucuccuucugcggggugaacagcgacaccgccaacugguccuggcccgacggcgccgagcugcccuucaccaucgacaaguga

SEQ ID NO: 17348 - RNA, 1413 nt, Artificial Sequence; identical to SEQ ID NO: 16798
  derived and/or modified CDS sequence (AUadapt) from InfluenzaA__ABD95298__NA

SEQ ID NO: 17349 - RNA, 1413 nt, Artificial Sequence
  derived and/or modified CDS sequence (AUadapt) from InfluenzaA__ABD95309__NA
augaaccccaaccagaagaucaucaccaucggcucgaucuccaucgccaucgggaugaucagccugaugcuccagaucggcaacaucaucuccaucugggccucgcacuccauccagaccgggagccagaaccacacgggcgugugcaaccagcgcaucaucaccuacgagaacuccaccugggucaaccacaccuacgugaacaucaacaacacgaacgugaucgcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcagauccugcgcacccaggagucggagugcgugugcgugaacggcuccugcuucaccaucaugacggacgggcccagcaacggcgccgccuccuacaagaucuucaagaucgagaaggggaaggucaccaagucgaucgagcucaacgcccccaacuuccacuacgaggagugcuccugcuacccggacaccggcaccgugaugugcgugugccgggacaacuggcacgggagcaaccgccccugggucuccuucaaccagaaccuggacuaccagaucggcuacaucugcucgggcguguucggggacaacccccggcccaaggacggcgagggguccugcaacccggugacggucgacggcgcgaacggggugaagggcuucagcuacaaguacggcaacgggguguggaucggccgcaccaagugcaaccggcugcgcaagggguucgagaugaucugggaccccaacggcuggaccgacaccgacuccgacuucagcgucaagcaggacgugguggccaucacggacugguccggguacucgggcagcuucguccagcaccccgagcucaccggccuggacugcauccggcccugcuucuggguggagcugguccgcgggcucccgaaggagaacaccaccaucuggacguccggcucguccaucagcuucugcggggugaacuccgacaccgccaacuggagcuggcccgacggcgccgagcugcccuucaccaucgacaaguga

SEQ ID NO: 17350 - RNA, 1413 nt, Artificial Sequence; identical to SEQ ID NO: 16798
  derived and/or modified CDS sequence (AUadapt) from InfluenzaA__ABD95320__NA

SEQ ID NO: 17351 - RNA, 1413 nt, Artificial Sequence; identical to SEQ ID NO: 17327
  derived and/or modified CDS sequence (AUadapt) from InfluenzaA__ABD95331__NA

SEQ ID NO: 17352 - RNA, 1413 nt, Artificial Sequence
  derived and/or modified CDS sequence (AUadapt) from InfluenzaA__ABD95342__NA
augaaccccaaccagaagaucaucaccaucggcucgaucugcauggccaucgggaucaucucccugauccuccagaucggcaacaucaucagcaucugggugucccacucgauccagaccgggucccagaaccacacgggcaucugcaaccagcgcaucaucaccuacgagaacagcaccugggucaaccagaccuacgugaacaucaacaacacgaacguggucgccgggaaggacaccaccuccgugacccuggcgggcaacucgucccugugcccggugcggggcugggccaucuacagcaaggacaacuccauccgcaucgggagcaagggcgacgucuucgugauccgggagcccuucaucuccugcucgcaccucgagugccgcacguucuuccugacccagggggcccugcucaacgacaagcacuccaacggcaccgugaaggaccggagccccuaccgcgcccugauguccugccccaucggggaggccccgucgcccuacaacucccgguucgagagcgucgcguggucggccuccgccugccacgacggcaugggcuggcugaccaucgggaucagcggccccgacgacggggccguggcggugcucaaguacaacggcaucaucacggagaccaucaaguccuggcgcaagcggauccugcgcacccaggagagcgagugcgucugcaucaacggcuccugcuucaccaucaugacggacgggcccucgaacggcccggccuccuaccggaucuucaagaucgagaaggggaagaucaccaagagcaucgagcuggacgcccccaacucccacuacgaggagugcucgugcuaccccgacaccggcaccgugaugugcgugugccgcgacaacuggcacggguccaaccggcccugggucagcuucaaccagaaccucgacuaccagaucggcuacaucugcuccggcguguucggggacaacccgcgccccaaggacggcaaggggucgugcggccccgugacggucgacggggccgacggcgugaagggcuucuccuaccgguacgggaacggcguguggaucgggcgcaccaagagcaacuccagccggaagggcuucgagaugaucugggaccccaacggguggaccgacaccgacuccaacuuccuggucaagcaggacgugguggccaugacggacuggucgggcuacagcggcuccuucguccagcacccggagcugaccgggcucgacugcaugcgccccugcuucuggguggagcugauccggggccgcccccgggagaagaccaccaucuggacgucgggguccagcaucuccuucugcggcgucaacagcgacaccgugaacugguccuggcccgacggcgcggagcugccguucaccaucgacaaguga

SEQ ID NO: 17353 - RNA, 1413 nt, Artificial Sequence
  derived and/or modified CDS sequence (AUadapt) from InfluenzaA__ABD95353__NA
augaaccccaaccagaagaucaucaccaucggcucgaucugcauggccaucgggaucaucucccugauccuccagaucggcaacaucaucagcaucugggugucccacucgauccagaccgggucccagaaccacacgggcaucugcaaccagcgcaucaucaccuacgagaacagcaccugggucaaccagaccuacgugaacaucuccaacacgaacguggucgccgggaaggacaccaccucgaugacccuggcgggcaacuccagccugugcccgauccggggcugggccaucuacuccaaggacaacagcauccgcaucggguccaagggcgacguguucgugauccgggagcccuucaucucgugcucccaccucgagugccgcacguucuuccugacccagggggcccugcucaacgacaagcacagcaacggcaccgucaaggaccggucccccuaccgcgcccugaugucgugccccaucggggaggccccgucccccuacaacagccgguucgagagcguggcgugguccgccucggccugccacgacggcaugggcuggcugaccaucgggaucuccggccccgacgacggggccguggcgguccucaaguacaacggcaucaucacggagaccaucaagagcuggcgcaagcagauccugcggacccaggaguccgagugcgugugcgugaacggcucgugcuucaccaucaugacggacgggcccuccgacggcccggccagcuaccgcaucuucaagaucgagaaggggaagaucaccaaguccaucgagcuggacgcccccaacagccacuacgaggagugcuccugcuaccccgacaccggcaccgucaugugcgugugccgggacaacuggcacgggucgaaccgccccuggguguccuucaaccagaaccucgacuaccagaucggcuacaucugcagcggcgucuucggggacaacccgcggcccaaggacggcaagggguccugcgaccccgugaacguggacggcgccgacggggucaagggcuucucguaccgcuacggcaacgggguguggaucggccggacgaaguccaacagcucccgcaagggguucgagaugaucugggaccccaacggcuggaccgacaccgacagcaacuuccuggugaagcaggacgucguggccaugaccgacuggucgggguacuccggcagcuucgugcagcacccggagcugacgggccucgacugcaugcggcccugcuucugggucgagcugauccgcgggcggccccgcgagaagaccaccaucuggaccuccggcucguccaucagcuucugcggggugaacuccgacacggucaacuggagcuggcccgacggcgcggagcugccguucaccaucgacaaguga

SEQ ID NO: 17354 - RNA, 1413 nt, Artificial Sequence; identical to SEQ ID NO: 17230
  derived and/or modified CDS sequence (AUadapt) from InfluenzaA__ABE11660__NA

SEQ ID NO: 17355 - RNA, 1413 nt, Artificial Sequence
  derived and/or modified CDS sequence (AUadapt) from InfluenzaA__ABE11671__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcgugugcaaccagcgcaucaucaccuacgagaacuccaccugggucaaccacaccuacgugaacaucaacaacacgaacguggucgcggggaaggacaagaccucggugacccuggccggcaacuccagccugugcuccaucagcggcugggccaucuacaccaaggacaacuccauccggaucgggucgaagggcgacguguucgucauccgcgagccguucaucuccugcagccaccucgagugccggacguucuuccugacccagggggcccugcucaacgacaagcacuccaacggcaccgugaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcggucgccgugcugaaguacaacggcaucaucacggagaccaucaaguccuggaagaagcagauccugcgcacccaggagucggagugcgugugcgucaacggcuccugcuucaccaucaugacggacgggcccagcaacggcgccgccuccuacaagaucuucaagaucgagaaggggaaggugaacaagucgaucgagcucaacgcccccaacuuccacuacgaggagugcuccugcuacccggacaccggcaccgugaugugcgucugccgggacaacuggcacgggagcaaccgccccuggguguccuucaaccagaaccuggacuaccagaucggcuacaucugcucgggcguguucggggacaacccccggcccaaggacggcgagggguccugcaacccggucaccguggacggcgcgaacggggugaagggcuucagcuacaaguacggcaacggggucuggaucggccgcacgaaguccaaccggcugcgcaagggguucgagaugaucugggaccccaacggcuggaccgacaccgacagcgacuucuccgugaagcaggacguggucgccaucaccgacuggucgggguacagcggcuccuucgugcagcaccccgagcucacgggccuggacugcauccggcccugcuucugggucgagcuggugcgcgggcucccgcgggagaacaccaccaucuggaccucgggcuccagcaucuccuucugcggggugaacagcgacacggccaacugguccuggcccgacggcgccgagcugcccuucaccaucgacaaguga

SEQ ID NO: 17356 - RNA, 1413 nt, Artificial Sequence
  derived and/or modified CDS sequence (AUadapt) from InfluenzaA__ABE11682__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcgggggaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagucggagugcgugugcgugaacggcuccugcuucaccaucaugacggacgggcccagcaacggcgccgccuccuacaagaucuucaagaucgagaaggggaaggucaccaagucgaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcucgggcguguucggggacaacccccgccccaaggacggcgagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccgacaccgacagcgacuucuccgucaagcaggacgugguggccaucacggacuggucgggguacagcggcuccuucguccagcaccccgagcucaccggccuggacugcauccgccccugcuucuggguggagcugguccgggggcucccgcgcgagaacaccaccaucuggacgucgggcuccagcaucuccuucugcggggugaacagcgacaccgccaacugguccuggcccgacggcgccgagcugcccuucaccaucgacaaguga

SEQ ID NO: 17357 - RNA, 1413 nt, Artificial Sequence; identical to SEQ ID NO: 16798
  derived and/or modified CDS sequence (AUadapt) from InfluenzaA__ABE11693__NA

SEQ ID NO: 17358 - RNA, 1413 nt, Artificial Sequence; identical to SEQ ID NO: 16798
  derived and/or modified CDS sequence (AUadapt) from InfluenzaA__ABE11704__NA

SEQ ID NO: 17359 - RNA, 1413 nt, Artificial Sequence; identical to SEQ ID NO: 16798
  derived and/or modified CDS sequence (AUadapt) from InfluenzaA__ABE11715__NA

SEQ ID NO: 17360 - RNA, 1413 nt, Artificial Sequence; identical to SEQ ID NO: 17327
  derived and/or modified CDS sequence (AUadapt) from InfluenzaA__ABE11726__NA

SEQ ID NO: 17361 - RNA, 1413 nt, Artificial Sequence; identical to SEQ ID NO: 17332
  derived and/or modified CDS sequence (AUadapt) from InfluenzaA__ABE11737__NA

SEQ ID NO: 17362 - RNA, 1413 nt, Artificial Sequence; identical to SEQ ID NO: 16798
  derived and/or modified CDS sequence (AUadapt) from InfluenzaA__ABE11815__NA

SEQ ID NO: 17363 - RNA, 1413 nt, Artificial Sequence; identical to SEQ ID NO: 17327
  derived and/or modified CDS sequence (AUadapt) from InfluenzaA__ABE11826__NA

SEQ ID NO: 17364 - RNA, 1413 nt, Artificial Sequence; identical to SEQ ID NO: 17327
  derived and/or modified CDS sequence (AUadapt) from InfluenzaA__ABE11837__NA

SEQ ID NO: 17365 - RNA, 1413 nt, Artificial Sequence; identical to SEQ ID NO: 17327
  derived and/or modified CDS sequence (AUadapt) from InfluenzaA__ABE11848__NA

SEQ ID NO: 17366 - RNA, 1413 nt, Artificial Sequence; identical to SEQ ID NO: 17332
  derived and/or modified CDS sequence (AUadapt) from InfluenzaA__ABE11859__NA

SEQ ID NO: 17367 - RNA, 1413 nt, Artificial Sequence
  derived and/or modified CDS sequence (AUadapt) from InfluenzaA__ABE11903__NA
augaaccccaaccagaagaucaucaccaucggcucgaucuccauggccaucgggaucaucagccugauccuccagaucggcaacaucaucuccaucugggccucgcacuccauccagaccgggagccagaacuacacgggcaucugcaaccagcgcaucaucaccuacgagaacuccaccugggugaaccagaccuacgucaacaucaacaacacgaacgugguggcggggaaggacaagaccucgaugacccuggccggcaacuccagccugugcccgauccggggcugggccaucuacaccaaggacaacuccauccgcaucgggucgaagggcgacgucuucgugauccgggagcccuucaucuccugcagccaccucgagugccgcacguucuuccugacccagggggcccugcucaacgacaagcacuccaacggcaccgugaaggaccggucgcccuaccgcgcccugauguccugcccccugggggaggcgccgagccccuacaacucccgguucgagucggucgccuggagcgccuccgccugccacgacggccucggcuggcugaccaucgggaucucgggccccgacaacggggcgguggccgugcugaaguacaacggcaucaucacggagaccaucaaguccuggaagaagcagauccuccgcacccaggagagcgagugcgucugcgugaacggcuccugcuucaccaucaugacggacgggcccucgaacggcgccgccuccuaccggaucuucaagaucgagaaggggcgcgugaccaagagcaucgagcuggacgccccgaacuaccacuacgaggagugcuccugcuaccccgacaccggcaccgucaugugcgugugccgggacaacuggcacgggucgaaccgccccuggguguccuucaaccagaaccuggacuaccagaucggcuacaucugcagcggcgucuucggggacaacccccggccgaaggacggcgagggguccugcaaccccgugacgguggacggcgcggacggggucaagggcuucucguaccgcuacggcaacgggguguggaucggccggaccaaguccaaccgccuccggaagggguucgagaugaucugggaccccaacggcuggaccgacaccgacagcgacuucuccaugaagcaggacguggucgccaugacggacuggucgggguacuccggcagcuucgugcagcaccccgagcugaccggccuggacugcaugcgcccgugcuucuggguggagcucguccgggggcugccccgcgagaacaccaccaucuggacgucgggcuccagcaucuccuucugcggggugaacagcgagaccgccaacugguccuggcccgacggcgccgagcugcccuucaccaucgacaaguga

SEQ ID NO: 17368 - RNA, 1413 nt, Artificial Sequence
  derived and/or modified CDS sequence (AUadapt) from InfluenzaA__ABE11925__NA
augaaccccaaccagaagaucaucaccaucggcucgaucuccaucgccaucgggaucaucucgcugauccuccagaucggcaacaucaucuccaucugggccagccacuccauccagaccgggucgcagaaccacacgggcaucugcaaccagcgcaucaucaccuacgagaacuccaccugggugaaccagaccuacgucaacaucaacaacacgaacgugguggcggggaaggacaagaccagcaugacccuggccggcaacuccucgcugugcccgauccggggcugggccaucuacaccaaggacaacuccauccgcaucgggagcaagggcgacgucuucgugauccgggagcccuucaucuccugcucgcaccucgagugccgcacguucuuccugacccagggggcccugcucaacgacaagcacuccaacggcaccgugaaggaccggucgcccuaccgcgcccugauguccugcccccugggggaggcgccgagccccuacaacucccgguucgagucggucgccuggagcgccuccgccugccacgacggccucggcuggcugaccaucgggaucucgggccccgacaacggggcgguggccgugcugaaguacaacggcaucaucacggagaccaucaaguccuggaagaagcgcauccuccggacccaggagagcgagugcgucugcaugaacggcuccugcuucaccaucaugacggacgggcccucgaacggcgccgccuccuaccgcaucuucaagaucgagaaggggaaggugaccaagagcaucgagcuggacgccccgaacuaccacuacgaggagugcuccugcuaccccgacaccggcaccgugaugugcgucugccgggacaacuggcacgggucgaaccgccccuggguguccuucaaccagaaccuggacuaccagaucggcuacaucugcucgggcguguucggggacaacccccggccgaaggacggcgagggguccugcaaccccgucacggcggacggcgccgacggggugaagggcuucagcuaccgcuacggcaacgggguguggaucggccggaccaaguccaaccgccuccggaagggguucgagaugaucugggaccccaacggcuggaccgacaccgacucggacuucuccaugaagcaggacaucgucgccaugacggacuggagcggguacuccggcucguucgugcagcaccccgagcugaccggccuggacugcaugcgcccgugcuucuggguggagcucguccgggggcugccccgcgagaacaccaccaucuggacgagcggcuccucgaucuccuucugcggggugaacagcgacaccgccaacugguccuggcccgacggcgccgagcugcccuucaccaucgacaaguga

SEQ ID NO: 17369 - RNA, 1413 nt, Artificial Sequence
  derived and/or modified CDS sequence (AUadapt) from InfluenzaA__ABE11952__NA
augaaccccaaccagaagaucaucaccaucggcucgaucuccauggccaucgggaucaucagccugauccuccagaucggcaacaucaucuccaucugggccucgcacuccauccagaccgggagccagaacuacacgggcaucugcaaccagcgcaucaucaccuacgagaacuccaccugggugaaccagaccuacgucaacaucaacaacacgaacgugguggcggggaaggacaagaccucgaugacccuggccggcaacuccagccugugcccgauccggggcugggccaucuacaccaaggacaacuccauccgcaucgggucgaagggcgacgucuucgugauccgggagcccuucaucuccugcagccaccucgagugccgcacguucuuccugacccagggggcccugcucaacgacaagcacuccaacggcaccgugaaggaccggucgcccuaccgcgcccugauguccugcccccugggggaggcgccgagccccuacaacucccgguucgagucggucgccuggagcgccuccgccugccacgacggccucggcuggcugaccaucgggaucucgggccccgacaacggggcgguggccgugcugaaguacaacggcaucaucacggagaccaucaaguccuggaagaagcagauccuccgcacccaggagagcgagugcgucugcgugaacggcuccugcuucaccaucaugacggacgggcccucgaacggcgccgccuccuaccggaucuucaagaucgagaaggggcgcgugaccaagagcaucgagcuggacgccccgaacuaccacuacgaggagugcuccugcuaccccgacaccggcaccgucaugugcgugugccgggacaacuggcacgggucgaaccgccccuggguguccuucaaccagaaccuggacuaccagaucggcuacaucugcagcggcgucuucggggacaacccccggccgaaggacggcgagggguccugcaaccccgugacgguggacggcgcggacggggucaagggcuucucguaccgcuacggcaacgggguguggaucggccggaccaaguccaaccgccuccggaagggguucgagaugaucugggaccccaacggcuggaccgacaccgacagcgacuucuccaugaagcaggacguggucgccaugacggacuggucgggguacuccggcagcuucgugcagcaccccgagcugaccggccuggacugcaugcgcccgugcuucuggguggagcucguccgggggcugccccgcgagaacaccaccaucuggacgucgggcuccagcaucuccuucugcggggugaacagcgagaccgccgacugguccuggcccgacggcgccgagcugcccuucaccaucgacaaguga

SEQ ID NO: 17370 - RNA, 1413 nt, Artificial Sequence
  derived and/or modified CDS sequence (AUadapt) from InfluenzaA__ABE12035__NA
augaaccccaaccagaagaucaucaccaucggcucgaucuccaucgccaucgggaucaucucgcugauccuccagaucggcaacaucaucuccaucugggccagccacuccauccagaccgggucgcagaaccacacgggcaucugcaaccagcgcaucaucaccuacgagaacuccaccugggugaaccagaccuacgucaacaucaacaacacgaacgugguggcggggaaggacaagaccagcaugacccuggccggcaacuccucgcugugcccgauccggggcugggccaucuacaccaaggacaacuccauccgcaucgggagcaagggcgacgucuucgugauccgggagcccuucaucuccugcucgcaccucgagugccgcacguucuuccugacccagggggcccugcucaacgacaagcacuccaacggcaccgugaaggaccggagccccuaccgcgcccugauguccugcccccugggggaggcgccgucgcccuacaacucccgguucgagagcgucgccuggucggccuccgccugccacgacggccucggcuggcugaccaucgggaucagcggccccgacaacggggcgguggccgugcugaaguacaacggcaucaucacggagaccaucaaguccuggaagaagcgcauccuccggacccaggagucggagugcgucugcaugaacggcuccugcuucaccaucaugacggacgggcccagcaacggcgccgccuccuaccgcaucuucaagaucgagaaggggcgggugaccaagucgaucgagcuggacgccccgaacuaccacuacgaggagugcuccugcuaccccgacaccggcaccgugaugugcgucugccgcgacaacuggcacgggagcaaccggcccuggguguccuucaaccagaaccuggacuaccagaucggcuacaucugcucgggcguguucggggacaacccccgcccgaaggacggcgagggguccugcaaccccgucacgguggacggcgcggacggggugaagggcuucagcuaccgguacggcaacggggucuggaucggccgcaccaaguccaaccggcuccgcaagggguucgagaugaucugggaccccaacggcuggaccgacaccgacucggacuucuccaugaagcaggacaucguggccaugacggacuggagcggguacuccggcucguucgugcagcaccccgagcugaccggccuggacugcaugcggccgugcuucugggucgagcucgugcgcgggcugccccgggagaacaccaccaucuggacgagcggcuccucgaucuccuucugcggggugaacagcgacaccgccaacugguccuggcccgacggcgccgagcugcccuucaccaucgacaaguga

SEQ ID NO: 17371 - RNA, 1410 nt, Artificial Sequence; identical to SEQ ID NO: 17132
  derived and/or modified CDS sequence (AUadapt) from InfluenzaA__ABE12094__NA

SEQ ID NO: 17372 - RNA, 1410 nt, Artificial Sequence; identical to SEQ ID NO: 17264
  derived and/or modified CDS sequence (AUadapt) from InfluenzaA__ABE12126__NA

SEQ ID NO: 17373 - RNA, 1413 nt, Artificial Sequence; identical to SEQ ID NO: 16798
  derived and/or modified CDS sequence (AUadapt) from InfluenzaA__ABE12263__NA

SEQ ID NO: 17374 - RNA, 1410 nt, Artificial Sequence
  derived and/or modified CDS sequence (AUadapt) from InfluenzaA__ABE12626__NA
augaaccccaaccagaagaucaucaccaucggcucggugucccugaccaucgccacgaucugcuuccucaugcagaucgccauccuggucaccaccgugacccugcacuucaagcaguacgagugcgacucgccggcgaacaaccaggugaugcccugcgagcccaucaucaucgagcgcaacaucacggagaucgucuaccucaccaacaccaccaucgagaaggagaucugccccaagcugguggaguaccggaagugguccaagccgcagugcaagaucacgggguucgcccccuucagcaaggacaacuccauccgccugucggccggcggggacaucugggugacccgggagcccuacgucuccugcgaccccggcaagugcuaccaguucgcccucgggcagggcaccacccuggacaacaagcacucgaacgacacgauccacgaccgcaucccgcaccggacccugcucaugaacgagcugggcgugcccuuccaccuggggacccgccaggugugcaucgccugguccagcuccucgugccacgacggcaaggcguggcuccacgucugcgugaccggggacgacaagaacgccacggccuccuucaucuacgacggccggcugguggacucgaucggguccuggagccagaacauccugcgcacccaggaguccgagugcgucugcaucaacgggaccugcaccguggugaugacggacggcucggccuccggccgggcggacacccgcauccucuucaucgaggagggcaagaucguccacaucucgccccugagcggguccgcccagcacguggaggagugcucgugcuacccccgguacccgggcgugcgcugcaucugccgggacaacuggaagggcuccaaccgccccgucguggacaucaacgugaaggacuacagcaucgacuccucguacgucugcuccgggcuggugggcgacacgccccggaacaacgaccgcucguccaacagcuacugccggaaccccaacaacgagcgcgggaaccacggcgugaaggggugggccuucgacgacggcaacgacgucuggaugggccggaccaucuccaaggacucgcgcuccggguacgagaccuucaaggugaucggcggguggucgaccccgaacuccaagagccagaucaaccggcaggucaucguggacuccgacaaccgcucgggcuacuccgggaucuucucgguggagggcaagagcugcaucaaccgcugcuucuacgucgagcucauccggggccgcgagcaggagacccgggugugguggaccuccaacucgaucguggucuucugcgggacguccggcaccuacgggaccggcagcuggcccgacggggccgacaucaaccugaugcccaucuga

SEQ ID NO: 17375 - RNA, 1410 nt, Artificial Sequence
  derived and/or modified CDS sequence (AUadapt) from InfluenzaA__ABE12650__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccgacaagugcuaccaguucgcccugggccaggggaccacgcugaacaaccgccacagcaacgacaccguccacgaccggaccccguaccgcacccuccugaugaacgagcugggcgugcccuuccaccucggcacgaagcaggucugcaucgccugguccucguccucgugccacgacgggaaggcguggcugcacgugugcgugaccggccacgacgagaacgccaccgccuccuucaucuacgacgggcggcugguggacagcaucggcuccuggucgaagaagauccuccgcacccaggaguccgagugcgucugcaucaacgggacgugcaccguggugaugaccgacggcagcgccuccggccgggcggacaccaagauccuguucaucaaggaggggaagaucguccacaucucgccccugcucggcagcgcccagcacguggaggagugcuccugcuacccccgcuacccgggggugcggugcgucugccgcgacaacuggaagggcucgaaccggcccaucguggacaucaacgugaaggacuacuccaucgucucguccuacgugugcagcggccuggugggggacacgccccgcaagaacgacuccucguccagcucccacugccugaaccccaacaacgaggagggcgggcacggcgucaaggggugggccuucgacgacggcaacgacguguggaugggccggaccaucucggagaagcuccgcuccggguacgagaccuucaaggucaucgagggcuggucgaagccgaacuccaagcugcagaucaaccgccaggugaucguggaccgggggaaccggagcggcuacuccgggaucuucucggucgagggcaaguccugcaucaaccgcugcuucuacguggagcugauccggggccgcaagcaggagaccgaggugugguggacgagcaacucgaucgucguguucugcgggaccuccggcaccuacgggaccggcagcuggcccgacggggccgacaucaaccucaugcccaucuga

SEQ ID NO: 17376 - RNA, 1410 nt, Artificial Sequence
  derived and/or modified CDS sequence (AUadapt) from InfluenzaA__ABE13095__NA
augaaccccaaccagaagaucaucaccaucggcucggugucccugaccaucacgaccaucugcuuccucaugcagaucgccauccuggucaucaccgugacccugcacuucaagcagugcgagugcaacucgccgcccaacaaccaggugaugcucugcgagcccacgaucaucgagcgcaacaucaccgagaucgucuaccugaccaacaccacgaucgagaaggagaucugccccaagcuggccgaguaccggaacugguccaagccgcagugcaagaucaccggguucgcgcccuucagcaaggacaacuccauccgccucucggccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccucguccagcugccacgacggcaaggccuggcugcacgugugcgugaccgggcacaacgagaacgcgaccgccuccuucaucuacgacggccggcugguggacucgaucggguccuggagcaagaacauccuccgcacccaggaguccgagugcgucugcaucaacggcacgugcaccguggugaugaccgacggcucggccuccgggcgggccgacaccaagauccuguucaucgaggagggcaagaucguccacaucagcccccugucgggguccgcgcagcacguggaggagugcucgugcuacccccgcuacccgggcgugcggugcgucugccgcgacaacuggaagggcuccaaccggcccaucguggacaucaacgugaaggacuacagcaucgucuccucguacgugugcuccgggcucgugggcgacacgccccgcaagaacgacgggagcuccucguccuacugccuggaccccaacaacgaggagggcgggcacggcgucaagggcugggccuucgacgacgggaacgacguguggaugggccggaccaucagcgagaagcugcgcuccggguacgagaccuucaaggucaucggcggguggucgaagccgaacuccaagcuccagaucaaccgccaggugaucguggacaagggcaaccggagcggcuacuccgggaucuucucggucgagggcaaguccugcaucaaccggugcuucuacguggagcugauccgcgggcggaagcaggagaccgaggugugguggacgagcaacucgaucgucguguucugcggcaccuccgggaccuacggcaccggcagcuggcccgacggggccgacaucaaccugaugcccaucuga

SEQ ID NO: 17377 - RNA, 1410 nt, Artificial Sequence; identical to SEQ ID NO: 16528
  derived and/or modified CDS sequence (AUadapt) from InfluenzaA__ABE13332__NA

SEQ ID NO: 17378 - RNA, 1410 nt, Artificial Sequence; identical to SEQ ID NO: 16528
  derived and/or modified CDS sequence (AUadapt) from InfluenzaA__ABE13558__NA

SEQ ID NO: 17379 - RNA, 1410 nt, Artificial Sequence
  derived and/or modified CDS sequence (AUadapt) from InfluenzaA__ABE13642__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggcagggcaccacgcugaacaaccgccacagcaacgacaccguccacgagcggaccccguaccgcacccuccugaugaacgagcugggcgugcccuuccaccucgggacgaagcaggucugcaucgccugguccucguccucgugccacgacggcaaggcguggcugcacgugugcgugaccgggcacgacgagaacgccaccgccuccuucaucuacaacggccggcugguggacagcaucggguccuggucgaagaacauccuccgcacccaggaguccgagugcgucugcaucaacggcacgugcaccguggugaugaccgacggcagcgccuccgggcgggcggacaccaagauccuguucaucgaggagggcaagaucguccacaucucgccccugagcggguccgcccagcacguggaggagugcucgugcuacccccgcuacccgggcgugcggugcgucugccgcgacaacuggaagggcuccaaccggcccaucguggacaucaacgugaaggacuacucgaucgucuccagcuacgugugcuccgggcucgugggcgacacgccccgcaagaacgacucguccagcuccucgcacugccugaaccccaacaacgaggagggcgggcacggggucaagggcugggccuucgacgacggcaacgacguguggauggggcggaccaucuccgagaagcugcgcucgggcuacgagaccuucaaggucaucgggggcugguccaagccgaacagcaagcuccagaucaaccgccaggugaucguggaccgggggaaccgguccggcuacucgggcaucuucuccgucgagggcaagagcugcaucaaccgcugcuucuacguggagcugauccgggggcgcaagcaggagaccgaggugugguggacgucgaacuccaucgucguguucugcgggaccagcggcaccuacgggaccggcuccuggcccgacggcgccgacaucaaccugaugcccaucuga

SEQ ID NO: 17380 - RNA, 1410 nt, Artificial Sequence
  derived and/or modified CDS sequence (AUadapt) from InfluenzaA__ABE13668__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccucguccucgugccacgacggcaaggcguggcugcacgugugcgugaccgggcacgacgagaacgccaccgccuccuucaucuacgacggccggcugguggacagcaucggguccuggucgaagaacauccuccgcacccaggaguccgagugcgucugcaucaacggcacgugcaccguggugaugaccgacggcagcgccuccgggcgggcggacaccaagauccuguucaucgaggagggcaagaucguccacaucucgccccugagcggguccgcccagcacguggaggagugcucgugcuacccccgcuacccgggcgugcggugcgucugccgcgacaacuggaagggcuccaaccggcccaucguggacaucaacgugaaggacuacucgaucgucuccagcuacgugugcuccgggcucgugggcgacacgccccgcaagaacgacucguccagcuccucgcacugccugaaccccaacaacgaggagggcgggcacggggucaagggcugggccuucgacgacggcaacgacguguggauggggcggaccaucuccgagaagcugcgcucgggcuacgagaccuucaaggucaucgggggcugguccaagccgaacagcaagcuccagaucaaccgccaggugaucguggaccgggggaaccgguccggcuacucgggcaucuucuccgucgagggcaagagcugcaucaaccgcugcuucuacguggagcugauccgggggcgcaagcaggagaccgaggugugguggacgucgaacuccaucgucguguucugcgggaccagcggcaccuacgggaccggcuccuggcccgacggcgccgacaucaaccugaugcccaucuga

SEQ ID NO: 17381 - RNA, 1410 nt, Artificial Sequence
  derived and/or modified CDS sequence (AUadapt) from InfluenzaA__ABE13836__NA
augaaccccaaccagaagaucaucaccaucggcucggugucccugaccaucgccacgaucugcuuccucaugcagaucgccauccuggucaccaccgugacccugcacuucaagcaguacgagugcaacucgcucccgaacaaccaggugaugcugugcgagcccacgaucaucgagcgcaacaucaccgagaucgucuaccugaccaacaccacgaucgagaaggagaucugccccaagcucgcggaguaccggaacugguccaagccccagugcaagaucaccggguucgccccguucagcaaggacaacuccauccgccugucggccggcggggacaucugggugacccgggagcccuacguguccugcgaccccggcaagugcuaccaguucgcccuggggcagggcaccacgcucaacaaccgccacagcaacgacaccguccacgaccggacccccuaccgcacccugcugaugaacgagcucggcgugccguuccaccuggggacgaagcaggucugcaucgccugguccucguccagcugccacgacggcaaggcguggcugcacgugugcgugaccgggcacgacgagaacgccaccgccuccuucaucuacgacggccggcucguggacucgaucggguccuggagcaagaacauccugcgcacccaggaguccgagugcgucugcaucaacggcacgugcaccguggugaugaccgacggcucggccuccgggcgggcggacaccaagauccuguucaucgaggagggcaagaucguccacaucagcccccucucgggguccgcccagcacguggaggagugcucgugcuacccccgcuaccccggcgugcggugcgucugccgcgacaacuggaagggcuccaaccggccgaucguggacaucaacgugaaggacuacagcaucgucuccucguacgugugcuccgggcuggugggcgacacgccccgcaagaacgacagcuccucguccagccacugccugaaccccaacaacgaggagggcgggcacggggucaagggcugggccuucgacgacggcaacgacguguggauggggcggaccaucuccgagaagcuccgcucgggcuacgagaccuucaaggucaucgggggcugguccaagcccaacagcaagcugcagaucaaccgccaggugaucguggaccgggggaaccgguccggcuacucgggcaucuucuccgucgagggcaagagcugcaucaaccgcugcuucuacguggagcugauccgggggcgcaagcaggagaccgaggugugguggacgucgaacuccaucgucguguucugcgggaccagcggcaccuacgggaccggcuccuggccggacggcgccgacaucaaccucaugcccaucuga

SEQ ID NO: 17382 - RNA, 1410 nt, Artificial Sequence
  derived and/or modified CDS sequence (AUadapt) from InfluenzaA__ABE14033__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccucguccagcugccacgacggcaaggcguggcugcacgugugcgugaccgggcacgacgagaacgccaccgccuccuucaucuacgacggccggcugguggacucgaucggguccuggagcaagaacauccuccgcacccaggaguccgagugcgucugcaucaacggcacgugcaccguggugaugaccgacggcucggccuccgggcgggcggacaccaagauccuguucaucgaggagggcaagaucguccacaucagcccccugucgggguccgcccagcacguggaggagugcucgugcuacccccgcuacccgggcgugcggugcgucugccgcgacaacuggaagggcuccaaccggcccaucguggacaucaacgugaaggacuacagcaucgucuccucguacgugugcuccgggcucgugggcgacacgccccgcaagaacgacagcuccucguccagcuacugccugaaccccaacaacgaggagggcgggcacggggucaagggcugggccuucgacgacggcaacgacguguggauggggcggaccaucuccgagaagcugcgcucgggcuacgagaccuucaaggucaucgggggcugguccaagccgaacagcaagcuccagaucaaccgccaggugaucguggaccgggggaaccgguccggcuacucgggcaucuucuccgucgagggcaagagcugcaucaaccgcugcuucuacguggagcugauccgggggcgcaagcaggagaccgaggugugguggacgucgaacuccaucgucguguucugcgggaccagcggcaccuacgggaccggcuccuggcccgacggcgccgacaucaaccugaugcccaucuga

SEQ ID NO: 17383 - RNA, 1410 nt, Artificial Sequence
  derived and/or modified CDS sequence (AUadapt) from InfluenzaA__ABE14055__NA
augaaccccaaccagaagaucaucaccaucggcucggugucccugaccaucgccacgaucugcuuccucaugcagaucgccauccuggucaccaccgugacccugcacuucaagcaguacgagugcaacagcccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucucgaaggacaacuccauccgccucagcgccggcggggacaucugggugacccgggagcccuacguguccugcgaccccgacaagugcuaccaguucgcccugggccaggggaccacgcugaacaaccgccacucgaacgacaccguccacgaccggaccccguaccgcacccuccugaugaacgagcugggcgugcccuuccaccucggcacgaagcaggucugcaucgccugguccagcuccucgugccacgacgggaaggcguggcugcacgugugcgugaccggccacgacgagaacgccaccgccuccuucaucuacgacgggcggcugguggacagcaucuccucgugguccaagaacauccuccgcacccaggagagcgagugcgucugcaucaacggcacgugcaccguggugaugaccgacggguccucgagcggccgggccgacaccaagauccuguucaucgaggagggcaagaucguccacaucucgccccuguccggguccgcgcagcacguggaggagugcagcugcuacccccgcuacccgggcgugcggugcgucugccgcgacaacuggaagggguccaaccggcccaucguggacaucaacgugaaggacuacucgaucgucuccagcuacgugugcuccggccucgugggcgacacgccccgcaagaacgacucguccagcuccucguacugccugaaccccaacaacgaggagggcgggcacggggucaagggcugggccuucgacgacgggaacgacguguggaugggccggaccaucuccgagaagcugcgcagcggcuacgagaccuucaaggucaucgggggcugguccaagccgaacucgaagcuccagaucaaccgccaggugaucguggaccgggggaaccgguccggcuacagcgggaucuucucggucgagggcaaguccugcgugaaccgcugcuucuacguggagcugauccggggccgcaagcaggagaccgaggucugguggacgagcaacuccaucgugguguucugcgggaccagcggcaccuacgggaccggcuccuggcccgacggggccgacaucaaccugaugcccaucuga

SEQ ID NO: 17384 - RNA, 1410 nt, Artificial Sequence
  derived and/or modified CDS sequence (AUadapt) from InfluenzaA__ABE14857__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaccaccgagaucgucuaccugaccaacacgaccaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggcagggcacgacccugaacaaccgccacagcaacgacaccguccacgaccggaccccguaccgcacgcuccugaugaacgagcugggcgugcccuuccaccucgggaccaagcaggucugcaucgccugguccucguccucgugccacgacggcaaggcguggcugcacgugugcgugaccgggcacgacgagaacgccaccgccuccuucaucuacgacggccggcugguggacagcaucggguccuggucgaagaacauccuccgcacgcaggaguccgagugcgucugcaucaacgggaccugcaccguggugaugaccgacggcagcgccuccgggcgggcggacacgaagauccuguucaucgaggagggcaagaucguccacaucucgccccugagcggguccgcccagcacguggaggagugcucgugcuacccccgcuacccgggcgugcggugcgucugccgcgacaacuggaagggcuccaaccggcccaucguggacaucaacgugaaggacuacucgaucgucuccagcuacgugugcuccgggcucgugggcgacacgccccgcaagaacgacucguccagcuccucguacugccugaaccccaacaacgaggagggcggccacggggucaagggcugggccuucgacgacggcaacgacguguggauggggcggaccaucuccgagaagcugcgcucgggcuacgagaccuucaaggucaucgggggcugguccaagccgaacagcaagcuccagaucaaccgccaggugaucguggaccgggggaaccgguccggcuacucgggcaucuucuccgucgagggcaagagcugcaucaaccgcugcuucuacguggagcugauccgggggcgcaagcaggagaccgaggugugguggaccucgaacuccaucgucguguucugcgggaccagcggcaccuacgggacgggcuccuggcccgacggcgccgacaucaaccugaugcccaucuga

SEQ ID NO: 17385 - RNA, 1410 nt, Artificial Sequence; identical to SEQ ID NO: 17382
  derived and/or modified CDS sequence (AUadapt) from InfluenzaA__ABE15594__NA

SEQ ID NO: 17386 - RNA, 1413 nt, Artificial Sequence
  derived and/or modified CDS sequence (AUadapt) from InfluenzaA__ABE26994__NA
augaaccccaaccagaagaucaucaccaucggcucgaucuccaucgccaucgggaucaucagccugauccuccagaucggcaacaucaucuccaucugggccucgcacuccauccagaccgggagccagaaccacacgggcaucugcaaccagcgcaucaucaccuacgagaacuccaccugggugaaccagaccuacgucaacaucaacaacacgaacgugguggcggggaaggacaagaccucgaugacccuggccggcaacuccagccugugcccgauccggggcugggccaucuacaccaaggacaacuccauccgcaucgggucgaagggcgacgucuucgugauccgggagcccuucaucuccugcagccaccucgagugccgcacguucuuccugacccagggggcccugcucaacgacaagcacuccaacggcaccgugaaggaccggucgcccuaccgcgcccugauguccugcccccugggggaggcgccgagccccuacaacucccgguucgagucggucgccuggagcgccuccgccugccacgacggccucggcuggcugaccaucgggaucucgggccccgacaacggggcgguggccgugcugaaguacaacggcaucaucacggagaccaucaaguccuggaagaagcgcauccuccggacccaggagagcgagugcgucugcaugaacggcuccugcuucaccaucaugacggacgggcccucgaacggcgccgccuccuaccgcaucuucaagaucgagaaggggcgggugaccaagagcaucgagcuggacgccccgaacuaccacuacgaggagugcuccugcuaccccgacaccggcaccgugaugugcgucugccgcgacaacuggcacucguccaaccggcccugggugagcuucaaccagaaccuggacuaccagaucggguacaucugcuccggcguguucggcgacaacccccgcccgaaggacggggagggcucgugcaaccccgucacgguggacggggcggacggcgugaagggguucuccuaccgguacggcaacggcgucuggaucgggcgcaccaagagcaaccggcuccgcaagggcuucgagaugaucugggaccccaacggguggaccgacaccgacuccgacuucucgaugaagcaggacaucguggccaugacggacugguccggcuacagcgggucguucgugcagcaccccgagcugaccggccuggacugcaugcggccgugcuucugggucgagcucgugcgcggccugccccgggagaacaccaccaucuggacguccgggagcuccaucucguucugcggcgugaacuccgacaccgccaacuggagcuggcccgacggggccgagcugcccuucaccaucgacaaguga

SEQ ID NO: 17387 - RNA, 1350 nt, Artificial Sequence
  derived and/or modified CDS sequence (AUadapt) from InfluenzaA__ABE97641__NA
augaaucccaaccagaagaucaucaccaucggcucgaucugcauggugaucgggaucaucucccugaugcuccagaucggcaacaugaucagcaucugggucucccacagcauccagaccuggaaccagcaucaggccgaguccaucagcaacacgaacccgcugaccgagaaggccguggcguccgugacccuggccgggaacagcucccucugccccauccgcggcugggccguccacagcaaggauaacuccauccggaucgggagcaagggcgacguguucgugauccgcgagcccuucaucuccugcagccaccuggagugucggaccuucuuccugacgcagggcgcccuccugaacgacaagcacuccaacgggaccgucaaggaccgcagcccccaucggacccugauguccugcccggugggcgaggcccccagccccuacaacucccgcuucgagagcguggcguggagcgccuccgccugccaugacgggaccagcuggcucacgaucggcaucuccgggcccgacaacggcgccgucgcggugcugaaguacaacggcaucaucaccgacaccaucaagagcuggcggaauaacauccugcgcacccaggaguccgagugcgccugcgugaacgggucgugcuucacggucaugaccgacggcccguccaaugggcaggccagcuacaagaucuucaagauggagaagggcaagguggugaaguccgucgagcucgacgcccccaacuaccacuacgaggaguguagcugcuaccccgacgccggcgagaucacgugcgugugccgggacaacuggcauggguccaaccgccccuggaucagcuucaaccagaaccuggaguaccagaucggcuacaucugcuccgggguguuuggcgacaacccgcggcccaacgacgggaccggcagcugcggccccaugucccccaacggggcguacggcgucaagggguuuagcuucaaguacggcaacgggguguggaucggccgcaccaaguccaccaacagccgguccggcuucgagaugaucugggacccgaauggguggaucggcaccgacagcagcuucuccgugaagcaggacaucgucgccaucaccgacuggagcggguacuccggcaguuucgugcagcaccccgagcugacggggcucgacugcauccgccccugcuucuggguggagcugauccggggccgccccaaggaguccaccaucuggaccagcggcuccagcaucuccuuuugcggggucaacagcgacaucguguccuggagcuggccggacggcgccgagcugcccuucaccaucgacaaguga

SEQ ID NO: 17388 - RNA, 1350 nt, Artificial Sequence
  derived and/or modified CDS sequence (AUadapt) from InfluenzaA__ABE97642__NA
augaaucccaaccagaagaucaucaccaucggcagcaucugcauggugaucgggauggucucccugaugcuccagaucggcaacaugaucagcaucuggcugucccacagcauccagaccgggaaucagcaccaggccgaguccaucagcaacaacaaccugcucacggagaacgccguggcguccgugacccuggccggcaacaguucccugugcccgauccgcgggugggccguccacagcaaggacaacuccauccggaucggcagcaagggcgacguguuugugauccgcgagcccuucaucuccugcagccaccucgagugccggaccuucuuccugacccagggggcccugcucaaugacaagcacuccaacggcacggucaaggaccgcagcccccaccggacccugauguccugccccgugggggaggccccgagucccuacaacucccgcuucgagagcguggcguggagcgccuccgccugccacgauggcaucagcuggcugaccaucgggaucuccggccccgacaacggcgccgucgcggugcucaaguacaacgggaucaucaccgacacgaucaagagcuggcggaauaacauccugcgcacccaggaguccgagugcgccugcgugaacggcagcugcuucaccgucaugaccgaugggcccuccaacggccaggccagcuacaagaucuucaagauggagaagggcaagguggugaaguccgucgagcuggacgccccgaacuaccauuacgaggagugcagcugcuaccccgacgccggggagaucacgugcgugugucgggacaacuggcacggcuccaaccgccccugggugagcuucaaccagaaucucgaguaccagaucggguacaucugcuccggcgucuucggggacaacccccggccgaacgauggcaccggcagcugcgggcccaugucccccaacggcgcguacggggugaagggcuucagcuucaaguaugggaacggcguguggaucggccgcaccaaguccaccaacagccgguccggguucgagaugaucugggaccccaacggcuggacggggaccgacaguagcuucuccgucaagcaggacaucguggccaucaccgacuggagcggcuacuccgggagcuuugugcagcacccggagcugaccggccuggacugcauccgccccugcuucugggucgagcucauccggggccgccccaaggaguccacgaucuggaccagcggguccagcaucuccuuuugcggcgugaacggggacaccgucagcugguccuggcccgacggcgccgagcugccguucaucaucgacaaguga

SEQ ID NO: 17389 - RNA, 1350 nt, Artificial Sequence
  derived and/or modified CDS sequence (AUadapt) from InfluenzaA__ABE97644__NA
augaaucccaaccagaagaucaucaccaucggcagcaucugcauggugaucgggaucgucucccugaugcuccagaucggcaacaugaucagcaucugggugucccauagcauccagaccgggaaccagcaccaggccgaguccaucagcaacacgaacccgcugaccgagaaggccguggcguccgucacccuggccggcaauagcucccucugccccauccgcgggugggccgugcacagcaaggacaacaauauccggaucggcuccaagggcgacguguucgucauccgcgagcccuucaucagcugcucccaccuggagugucggaccuucuuccugacgcagggggcccuccugaacgacaagcacaguaacggcaccgugaaggaccgcagcccccaccggacccugauguccugcccggugggggaggcccccucccccuacaauagccgcuucgaguccgucgcguggagcgccagcgccugccacgauggcaccuccuggcucacgaucgggaucagcggccccgacaacggcgccguggcggugcugaaguacaacgggaucaucaccgacaccaucaaguccuggcggaauaacauccugcgcacccaggagagcgagugcgccugcgucaacggcuccuguuucacggugaugaccgacgggccgagcaacggccaggccuccuacaagaucuucaagauggagaagggcaagguggucaagaguguggagcucgacgcccccaacuaccacuacgaggagugcuccuguuaccccgacgccggggagaucacgugcgugugccgggacaacuggcauggcagcaaccgccccugggucuccuucaaccagaaccuggaguaucagaucggguacaucugcagcggcguguucggggacaacccgcggcccaaugacggcaccggcuccugcgggcccaugagccccaacggcgcguacggggugaagggcuucuccuuuaaguacgggaacggcgucuggaucggccgcaccaagagcaccaacucccggagcggguucgagaugaucugggauccgaacggcuggaccgggaccgacuccagcuucagcgugaagcaggauaucguggcccugacggacugguccggcuacagcggguccuucguccagcaccccgagcucaccggccuggacuguauccgccccugcuucuggguggagcugauccggggccgccccaaggagagcaccaucuggaccuccgggagcuccaucagcuucuguggcgucaacuccgacacggugagcugguccuggccggacggggccgagcuccccuucaccaucgacaaguga

SEQ ID NO: 17390 - RNA, 1350 nt, Artificial Sequence
  derived and/or modified CDS sequence (AUadapt) from InfluenzaA__ABE97645__NA
augaaucccaaccaaaagaucaucaccaucggcagcaucugcauggugaucgggaccgucucccugaugcuccagaucggcaacaugaucagcaucugggugucccauagcauccagacggggaaccagcaccaggccgagccgaccuccagcaccaacccccugaccgagaaggccguggcguccgucacgcuggccggcaauagcucccucugccccauccgcgggugggccauccacagcaaggacaauuccauccggaucggcagcaagggcgacguguucgugauccgcgagcccuucaucuccugcagucaccuggagugccggaccuucuuccugacccagggggcccuccugaacgauaagcacuccaacggcaccgucaaggaccgcagcccgcaccggacgcugauguccugucccgugggggaggcccccagccccuacaacucccgcuucgaaagcguggcguggagugccuccgccugccacgacggcaccagcuggcucaccaucgggaucuccggcccggacaauggcgccgucgcggugcugaaguacaacgggaucaucaccgacacgaucaagagcuggcggaacaauauccugcgcacccaggaguccgagugcgccugcgugaacggcagcugcuuuaccgucaugaccgacgggcccuccaacggccaggccagcuacaagaucuucaagauggagaagggcaagguggugaaguccgucgagcucgaugcccccaacuaccacuacgaggagugcaguugcuaccccgacgccggggagaucacgugcgugugccgggauaacuggcacggcuccaaccgcccgugggugagcuucaaucaaaaccuggaguaccagaucggguacaucugcuccggcgucuucggggauaacccccggcccaacgacggcaccggcagcugcgggcccauguccccgaauggcgcguacggggugaagggcuucgccuucaaguacgggaacggcguguggaucggccgcaccaagaguaccaacucccggagcggguucgagaugaucugggaccccaacggcuggacggggcccgauuccagcuucagcgucaagcaggacaucguggccaucaccgacugguccggcuauagcggguccuucgugcagcaccccgagcugaccggccucgacugcauccgcccguguuucugggucgagcugauccggggccgccccaaggagagcaccaucuggacguccgggagcuccaucagcuucuguggcgugaacuccgacaccgucagcugguccuggcccgacggggccgagcugcccuucaccaucgacaaguga

SEQ ID NO: 17391 - RNA, 1350 nt, Artificial Sequence
  derived and/or modified CDS sequence (AUadapt) from InfluenzaA__ABE97646__NA
augaaucccaaccagaagaucaucaccaucggcucgaucugcauggugaucgggaucgucucccugaugcuccagaucggcaacaugaucagcaucugggugucccauagcauccagaccgagaaccagcaccaggccgaguccaucagcaacacgaacccgcccaccgagaaggccguggcguccgucacccuggccgggaauagcucccugugccccauccgcggcugggccgugcacagcaaggacaacuccauccggaucgggaguaagggcgacguguucgucauccgcgagcccuucaucuccugcagccaccucgagugucggaccuucuuccugacgcagggcgcccugcucaacgacaagcacuccaaugggaccgugaaggaccgcagcccgcaccggacccugauguccugccccgugggcgaggcccccagccccuacaauucccgcuucgagagcgucgcguggagcgccuccgccugccacgacgggaccaguuggcugacgaucggcaucuccgggccggacaacggcgccguggcggugcucaaguacaacggcaucaucaccgacaccaucaagagcuggcggaauaacacccugcgcacgcaggaguccgagugcgccugcgucaacgggagcuguuucaccgugaugaccgacggccccuccaacgggcaggccagcuacaagaucuucaagauggagaagggcaagguggucaaguccguggagcuggaugcccccaacuaccacuacgaggagugcagcuguuaccccgacgccggcgagaucacgugcgugugccgggacaacuggcauggguccaaccgcccgugggucagcuucaaccagaaccucgaguaucagaucggcuacaucugcuccgggguguucggcgacaacccccggcccaacgaugggaccggcagcugcggccccauguccccgaacggggcguacggcgugaagggguucagcuuuaaguacggcaacggggucuggaucggccgcaccaaguccaccaacagccgguccggcuucgagaugaucugggaccccaauggguggaccggcacggacagcagcuucuccgugaagcaggacaucgugaguaucaccgacugguccggguacagcggcuccuucguccagcaccccgagcugaccgggcuggacuguauccgccccugcuucuggguggagcucauccggggccgcccgaaggagagcaccaucuggacguccggcagcuccaucagcuucuguggggucaacuccgacaccgugagcugguccuggcccgacggcgccgagcugcccuucaccaucgacaaguga

SEQ ID NO: 17392 - RNA, 1350 nt, Artificial Sequence
  derived and/or modified CDS sequence (AUadapt) from InfluenzaA__ABE97647__NA
augaaucccaaccagaagaucaucaccaucggcagcaucugcauggugaucgggaucgucucccugaugcuccagaucggcaacaugaucagcaucugggugucccauagcauccagaccgggaaccagcaccgcgccgaguccaucagcaacacgaacccgcugaccgagaaggccguggcguccgucacccuggccggcaauagcucccucugccccauccgggggugggccgugcacagcaaggacaacaauauccgcaucggcuccaagggcgacguguucgucauccgggagcccuucaucagcugcucccaccuggagugucgcaccuucuuccugacgcagggggcccuccugaacgacaagcacaguaacggcaccgugaaggaccggagcccccaccgcacccugauguccugcccggugggggaggcccccucccccuacaauagccgguucgaguccgucgcguggagcgccagcgccugccacgauggcaccuccuggcucacgaucgggaucagcggccccgacaacggcgccguggcggugcugaaguacaacgggaucaucaccgacaccaucaaguccuggcgcaauaacauccugcggacccaggagagcgagugcgccugcgucaacggcuccuguuucacggugaugaccgacgggccgagcaacggccaggccuccuacaagaucuucaagauggagaagggcaagguggucaagaguguggagcucgacgcccccaacuaccacuacgaggagugcuccuguuaccccgacgccggggagaucacgugcgugugccgcgacaacuggcauggcagcaaccggcccugggucuccuucaaccagaaccuggaguaucagaucggguacaucugcagcggcguguucggggacaacccgcgccccaaugacggcaccggcuccugcgggcccaugagccccaacggcgcguacggggugaagggcuucuccuuuaaguacgggaacggcgucuggaucggccggaccaagagcaccaacucccgcagcggguucgagaugaucugggauccgaacggcuggaccgggaccgacuccagcuucagcgugaagcaggauaucguggccaucacggacugguccggcuacagcggguccuucguccagcaccccgagcugaccggccucgacuguauccggcccugcuucuggguggagcugauccgcggccggcccaaggagagcaccaucuggaccuccgggagcuccaucagcuucuguggcgucaacuccgacacggugagcugguccuggccggacggggccgagcugcccuucaccaucgacaaguga

SEQ ID NO: 17393 - RNA, 1350 nt, Artificial Sequence
  derived and/or modified CDS sequence (AUadapt) from InfluenzaA__ABE97649__NA
augaaucccaaccagaagaucaucaccaucggcagcaucugcauggugaucgggaucgucucccugaugcuccagaucggcaacaugaucagcaucugggugucccauagcauccagaccgggaaccagcaccaggccgaguccaucagcaacacgaacccgcugaccgagaaggccguggcguccgucacccuggccggcaauagcucccucugccccauccgcgggugggccgugcacagcaaggacaacuccauccggaucggcaguaagggcgacguguucgucauccgcgagcccuucaucuccugcagccaccuggagugucggaccuucuuccugacgcagggggcccuccugaacgacaagcacuccaauggcaccgugaaggaccgcagcccccaccggacccugauguccugcccggugggggaggcccccagccccuacaauucccgcuucgagagcgucgcguggagcgccuccgccugccacgacggcaccaguuggcucacgaucgggaucuccggccccgacaacggcgccguggcggugcugaaguacaacgggaucaucaccgacaccaucaagagcuggcggaauaacauccugcgcacccaggaguccgagugcgccugcgucaacggcagcuguuucacggugaugaccgacgggccguccaacggccaggccagcuacaagaucuucaagauggagaagggcaagguggucaaguccguggagcucgaugcccccaacuaccacuacgaggagugcagcuguuaccccgacgccggggagaucacgugcgugugccgggacaacuggcauggcuccaaccgccccugggucagcuucaaccagaaccuggaguaucagaucggguacaucugcuccggcguguucggggacaacccgcggcccaacgauggcaccggcagcugcgggcccaugucccccaacggcgcguacggggugaagggcuucagcuuuaaguacgggaacggcgucuggaucggccgcaccaaguccaccaacagccgguccggguucgagaugaucugggacccgaauggcuggaccgggaccgacagcagcuucuccgugaagcaggacaucguggccaucacggauuggagcggcuacuccgggagcuucguccagcaccccgagcugaccggccucgacuguauccgccccugcuucuggguggagcugauccggggccgccccaaggaguccaccaucuggaccagcggguccagcaucuccuucugcggcgucaauagcgacacgguguccuggagcuggccggacggggccgagcugcccuucaccaucgacaaguga

SEQ ID NO: 17394 - RNA, 1350 nt, Artificial Sequence; identical to SEQ ID NO: 17393
  derived and/or modified CDS sequence (AUadapt) from InfluenzaA__ABE97651__NA

SEQ ID NO: 17395 - RNA, 1350 nt, Artificial Sequence; identical to SEQ ID NO: 17393
  derived and/or modified CDS sequence (AUadapt) from InfluenzaA__ABE97653__NA

SEQ ID NO: 17396 - RNA, 1350 nt, Artificial Sequence; identical to SEQ ID NO: 17393
  derived and/or modified CDS sequence (AUadapt) from InfluenzaA__ABE97654__NA

SEQ ID NO: 17397 - RNA, 1350 nt, Artificial Sequence
  derived and/or modified CDS sequence (AUadapt) from InfluenzaA__ABE97655__NA
augaaucccaaccaaaagaucaucaccaucggcagcaucugcauggccaucgggaucgugucccugaugcuccagaucggcaacaugaucagcaucugggucucccauagcauccagaccgggaaccagcaccaggccgaguccacgagcaacaccaauccgcugaccgagaaggcgguggccuccgugacccuggccggcaacagcucccucugccccauccgcgggugggccauccacagcaaggauaacuccauccggaucggcagcaagggcgacgucuucgugauccgcgagcccuucaucuccuguagccaccuggagugccggacguucuuccugacccagggggcccuccugaaugacaagcacuccaacggcaccgugaaggaccgcagcccccaucggacccugauguccugcccggucggggaggcgcccagccccuacaacucccgcuucgagaguguggccuggagcgccuccgccugccacgacggcacgagcuggcucaccaucgggaucuccggccccgauaacggcgcgguggccguccugaaguacaacgggaucaucaccgacaccaucaagagcuggcggaauaacauccugcgcacgcaggaguccgagugcgccugcgugaacggcagcuguuucaccgugaugaccgacgggccguccaacggccaggccagcuacaagaucuucaagauggagaagggcaaggucgugaaguccguggagcucgaugcccccaacuaccacuacgaggagugcaguugcuaccccgacgcgggggagaucacgugcgucugccgggauaacuggcacggcuccaaccgccccugggugagcuucaaucagaaccuggaguaccagaucggguacaucugcuccggcguguucggggauaacccgcggcccaacgacggcaccggcagcugcgggcccaugucccccaauggcgccuacggggucaagggcuucgccuucaaguacgggaacggcguguggaucggccgcaccaagaguaccaacucccggagcggguucgagaugaucugggacccgaacggcuggaccgggcccgauuccagcuucagcgugaagcaggacaucgucgccaucacggacugguccggcuauagcggguccuucgugcagcaccccgagcugaccggccucgacugcauccgccccuguuucuggguggagcugauccggggccgcccgaaggagagcaccaucuggaccuccgggagcuccaucagcuucuguggcgucaacuccgacacggugagcugguccuggcccgacggggccgagcugcccuucaccaucgacaaguga

SEQ ID NO: 17398 - RNA, 1350 nt, Artificial Sequence
  derived and/or modified CDS sequence (AUadapt) from InfluenzaA__ABE97657__NA
augaaucccaaccaaaagaucaucaccaucggcagcaucugcauggugaucgggaccgucucccuggugcuccagaucggcaacaugaucagcaucugggugucccauagcauccagacggggaaccagcaccaggccgaguccaucagcaacaccaacccgcugaccgagaaggccgucgcguccgugacccuggccggcaauagcucccucugccccauccgcgggugggccgugcacagcaaggacaacuccauccggaucggcaguaagggcgacgucuucgugauccgcgagcccuucaucuccugcagccaccuggagugucggacguucuuccugacccagggggcccuccugaacgacaagcacuccaauggcaccgugaaggaccgcagcccccaccggacccugauguccugcccggucggggaggcccccagccccuacaauucccgcuucgagagcguggcguggagcgccuccgccugccacgacggcacgaguuggcucaccaucgggaucuccggccccgacaacggcgccguggcgguccugaaguacaacgggaucaucaccgacaccaucaagagcuggcgggauaacauccugcgcacgcaggaguccgagugcgccugcgugaacggcagcuguuucaccgugaugaccgacgggccguccaacggccaggccagcuacaagaucuucaaaauggagaagggcaaggucgugaaguccguggagcucgaugcccccaacuaccacuacgaggagugcagcuguuaccccgacgccggggagaucacgugcgucugccgggacaacuggcauggcuccaaccgccccugggugagcuucaaccagaaccuggaguaucagaucggguacaucugcuccggcguguucggggacaacccgcggcccaacgauggcaccggcagcugcgggcccauguccagcaacggcgcguacggggucaagggcuucuccuuuaaguacgggaacggcguguggaucggccgcaccaagagcaccaacucccggagcggguucgagaugaucugggaucccaacggcuggaccgggacggacagcuccuucagcgugaagcaggauaucgucgccaucaccgacugguccggcuacagcggguccuucgugcagcacccggagcugaccggccucgacuguauccgccccugcuucugggucgagcugauccggggccgccccaaggagagcaccaucuggacguccgggagcuccaucagcuucuguggcgugaacuccgacaccgugagcugguccuggcccgacggggccgagcugccguucaccaucgacaaguga

SEQ ID NO: 17399 - RNA, 1350 nt, Artificial Sequence
  derived and/or modified CDS sequence (AUadapt) from InfluenzaA__ABE97658__NA
augaaucccaaccagaagaucaucaccaucggcucgaucugcauggugaucgggaccaucucccugaugcuccagaucggcaacaugaucagcaucugggucucccacaguauccagacggggaaccagcaccagaccgaguccaucagcaacaccaacccgcugaccgagaaggccguggccuccgugacgcuggcgggcaacaguucccucugcagcauccgcgggugggccguccacuccaaggacaacagcauccggaucggcuccaagggcgauguguucgugauccgcgagcccuucaucagcugcucccaccuggagugccggaccuuuuuccugacccagggggcccuccugaacgacaagcacagcaacggcaccgucaaggaucgcagcccccaccggacgcugaugagcugccccgugggggaggccccgucccccuacaacagucgcuucgagagcguggccugguccgcgagcgccugccacgacggcaccuccuggcucaccaucgggaucagcggccccgauaacggcgccgucgccgugcugaaguacaacgggaucaucaccgacacgaucaaguccuggcgggacaacauccugcgcacccaggagagugagugcgcgugcgugaacggcuccugcuucaccgucaugaccgacgggcccaguaacggccaggccuccuacaagaucuucaagauggagaagggcaagguggugaaguccgucgagcucgacgccccgaacuaccauuacgaggagugcuccugcuaccccgacgccggggagaucacgugcgugugucgggacaacuggcacggcagcaaccgccccuggguguccuucaaucagaaccuggaguaccagaucggguacaucugcagcggcgucuucggggacaauccccggccgaacgacggcaccggcuccugcgggcccaugagcuccaacggcgcccacggggugaagggcuuuagcuucaaguacgggaacggcguguggaucggccgcaccaaguccaccaacagccggaguggguucgagaugaucugggaccccaacggcuggacggggaccgacuccagcuucuccgucaagcaggauaucguggcgaucaccgacuggagcggcuacuccgggagcuucgugcagcaccccgagcugaccggccucgauugcauccgcccgugcuucugggucgagcugauccggggccgccccaaggaguccacgaucuggaccagcggguccagcaucuccuucuguggcgugaacagcgacaccgucuccuggagcuggcccgacggggccgagcugcccuucaccaucgacaaguga

SEQ ID NO: 17400 - RNA, 1350 nt, Artificial Sequence
  derived and/or modified CDS sequence (AUadapt) from InfluenzaA__ABE97659__NA
augaaucccaaccagaagaucaucaccaucggcagcaucugcauggugaucgggaucgucucccugaugcuccagaucggcaacaugaucagcaucugggugucccacaguauccagaccgggaaccagcaccaggccgaguccaucagcaacacgaacccgcugaccgagaaggccguggcguccgucacccuggccggcaacaguucccucugccccauccgcgggugggccgugcacagcaaggacaacuccauccggaucggcagcaagggcgauguguucgucauccgcgagcccuucaucuccugcagccaccuggagugccggaccuuuuuccugacgcagggggcccuccugaacgacaagcacuccaacgagaccgugaaggaccgcaguccccaccggacccugauguccugcccggugggcgaggcccccagccccuacaacucccgcuucgagagugucgcguggagcgccuccgccugccacgacgggaccagcuggcucacgaucggcaucuccgggcccgacaauggcgccguggcggugcugaaguacaacggcaucaucaccgacaccaucaagagcuggcgggacaacauccugcgcacccaggaguccgagugugccugcgucaacgggagcugcuucacggugaugaccgacggcccguccaaugggcaggccagcuacaagaucuucaagauggagaagggcaagguggucaaguccguggagcucgacgcccccaacuaccacuaugaggagugcagcugcuaccccgacgccggcgagaucacgugcgugugucgggacaacuggcacggguccaaccgccccugggucagcuucaaucagaaccuggaguaccagaucggcuacaucugcuccgggguguucggcgacaauccgcggcccaacgacgggaccggcagcugcggccccauguccagcaacggggcguauggcgugaagggguucuccuucaaguacggcaacggggucuggaucggccgcaccaagagcaccaacucccggaguggcuucgagaugaucugggaccccaacggguggaccggcaccgacagcuccuucagugugaagcaggacaucguggccaucacggacugguccggguacagcggcuccuucguccagcacccggagcugaccgggcucgauugcauccgccccugcuucuggguggagcugauccggggccgccccaaggagagcaccaucuggaccuccggcagcuccaucagcuuuugcggggucaacuccgacacggugagcugguccuggcccgacggcgccgagcugccguucaccaucgacaaguga

SEQ ID NO: 17401 - RNA, 1350 nt, Artificial Sequence
  derived and/or modified CDS sequence (AUadapt) from InfluenzaA__ABE97660__NA
augaaucccaaccagaagaucaucaccaucggcagcaucugcauggugaucgggaccaucucccugaugcuccagaucggcaacaugaucagcaucugggucucccauagcauccagacggggaaccagcaccaggccgaguccaucagcaacaccaauccgcugaccgagaaggccguggcguccgugacccuggccggcaacagcucccucugccccauccgcgggugggccguccacagcaaggacaauuccauccggaucggcagcaagggcgacguguucgugauccgcgagcccuucaucuccugcagucaccuggagugccggacguucuuccugacccagggggcccuccugaacgacaagcauuccaacggcaccgucaaggaccgcagcccccaccggacccugauguccugcccggugggggaggcccccagucccuacaacucccgcuucgagagcguggcguggagcgccuccgccugccaugacggcacgagcuggcucaccaucgggaucuccggccccgacaacggcgccgucgcggugcugaaguacaaugggaucaucaccgacaccaucaagagcuggcgggacaacauccugcgcacgcaggaguccgagugcgccugugugaacggcagcugcuucaccgucaugaccgacgggccguccaacggccaggccaguuacaagaucuucaagauggagaagggcaagguggugaaguccgucgagcucgacgcccccaacuaccauuacgaggagugcagcugcuaccccgacgccggggagaucacgugugugugccgggacaacuggcacggcuccaaccgccccugggugaguuucaaccagaaccuggaguaccagaucggguacaucugcuccggcgucuuuggggacaacccgcggcccaacgacggcaccggcagcugugggcccauguccagcaacggcgcgcacggggugaagggcuucuccuucaaguaugggaacggcguguggaucggccgcaccaagagcaccaacucccggagcggguucgagaugaucugggaccccaauggcuggaccgggacggacagcuccuucagcgucaagcaggacaucguggccaucaccgauugguccggcuacagcggguccuucgugcagcacccggagcugaccggccucgacugcauccgccccuguuucugggucgagcugauccggggccgccccaaggagagcaccaucuggacguccgggagcuccaucagcuucuguggcgugaacuccgacaccgucagcugguccuggcccgacggggccgagcugccguucaccaucgacaaguga

SEQ ID NO: 17402 - RNA, 1350 nt, Artificial Sequence
  derived and/or modified CDS sequence (AUadapt) from InfluenzaA__ABE97661__NA
augaaucccaaccagaagaucaucaccaucggcagcaucugcauggugaucgggaccaucucccugaugcuccagaucggcaacaugaucagcaucugggucucccauagcauccagacggggaaccagcaccagaccgaguccaucagcaacaccaauccgcugaccgagaaggccguggccuccgugacgcuggcgggcaacagcucccucugccccauccgcgggugggccguccacagcaaggauaacuccauccggaucggcagcaagggcgacguguucgugauccgcgagcccuucaucuccuguagccaccuggagugccggaccuucuuccugacccagggggcccuccugaaugacaagcacuccaacggcaccgucaaggaccgcagcccccaucggacgcugauguccugcccggugggggaggcccccagccccuacaacucccgcuucgagaguguggccuggagcgcguccgccugccacgacggcaccagcuggcucaccaucgggaucuccggccccgacaauggcgccgucgccgugcugaaguacaacgggaucaucaccgacacgaucaagagcuggcgggacaauauccugcgcacccaggaguccgagugcgcgugcgugaacggcagcugcuuuaccgucaugaccgacgggccguccaacggccaggccagcuacaagaucuucaagauggagaagggcaagguggugaaguccgucgagcucgaugcccccaacuaccacuacgaggagugcaguugcuaccccgacgccggggagaucacgugcgugugccgggauaacuggcacggcuccaaccgccccugggugagcuucaaucagaaccuggaguaccagaucggguacaucugcuccggcgucuucggggacaauccgcggcccaacgacggcaccggcagcugcgggcccauguccagcaauggcgcccacggggugaagggcuucuccuucaaguacgggaacggcguguggaucggccgcaccaagaguaccaacucccggagcggguucgagaugaucugggaccccaacggcuggacggggaccgauagcuccuucagcgucaagcaggacaucguggcgaccaccgacugguccggcuauagcggguccuucgugcagcacccggagcugacgggccucgacugcauccgccccuguuucugggucgagcugauccggggccgccccaaggagagcaccguguggaccuccgggagcuccaucagcuucuguggcgucaacuccgacaccgugagcugguccuggcccgacggggccgagcugccguucacgaucgacaaguga

SEQ ID NO: 17403 - RNA, 1350 nt, Artificial Sequence
  derived and/or modified CDS sequence (AUadapt) from InfluenzaA__ABE97662__NA
augaaucccaaccaaaagaucaucaccaucggcagcaucugcauggugaucgggaucgucucccugaugcuccagaucggcaacaugaucagcaucugggugucccauagcauccagaccgggaaccagcaccaggccgaguccaucagcaacacgaacccgcugaccgagaaggccguggcguccgucacccuggccggcaauagcucccucugccccauccgcgggugggccgugcacagcaaggacaacuccauccggaucggcaguaagggcgacguguucgucauccgcgagcccuucaucuccugcagccaccuggagugucggaccuucuuccugacgcagggggcccuccugaacgacaagcacuccaauggcaccgugaaggaccgcagcccccaccggacccugauguccugcccggugggggaggcccccagccccuacaauucccgcuucgagagcgucgcguggagcgccuccgccugccacgacggcaccaguuggcucacgaucgggaucuccggccccgacaacggcgccguggcggugcugaaguacaacgggaucaucaccgacaccaucaagagcuggcggaauaacauccugcgcacccaggaguccgagugcgccugcgucaacggcagcuguuucacggugaugaccgacgggccguccaacggccaggccagcuacaagaucuucaagaugcggaagggcaagguggucaaguccguggagcucgaugcccccaacuaccacuacgaggagugcagcuguuaccccgacgccggggagaucacgugcgugugccgcgacaacuggcauggcuccaaccggcccugggucagcuucaaccagaaccuggaguaucagaucggguacaucugcuccggcguguucggggacaacccgcgccccaacgauggcaccggcagcugcgggcccaugucccccaacggcgcguacggggugaagggcuucagcuuuaaguacgggaacggcgucuggaucggccggaccaaguccaccaacagccgcuccggguucgagaugaucugggacccgaauggcuggaccgggaccgacagcagcuucuccgugaagcaggacaucguggccaucacggauuggagcggcuacuccgggagcuucguccagcaccccgagcugaccggccucgacuguauccggcccugcuucuggguggagcugauccgcggccggcccaaggaguccaccaucuggaccagcggguccagcaucuccuucugcggcgucaauagcgacacgguguccuggagcuggccggacggggccgagcugcccuucaccaucgacaaguga

SEQ ID NO: 17404 - RNA, 1350 nt, Artificial Sequence
  derived and/or modified CDS sequence (AUadapt) from InfluenzaA__ABE97663__NA
augaaucccaaccagaagaucaucaccaucggcagcaucugcauggugaccgggaucgucucccugaugcuccagaucggcaacaugaucagcaucugggugucccacaguauccacacggggaaccagcaccaggccgagccgaucuccaacaccaacuuccugaccgagaaggccguggcgagugucaagcuggccggcaacuccagccucugccccaucaacgggugggccguguacuccaaggacaauagcauccgcaucggcuccaagggcgacguguucgucauccgggagcccuucaucagcugcucccaucuggagugccgcaccuucuuccugacgcagggggcccuccugaacgacaagcacagcaauggcaccgugaaggaccggagcccccaccgcacccugauguccugcccggugggggaggcccccucccccuacaacagucgguucgaguccgucgcguggagcgccagcgccugccacgacggcaccuccuggcucacgaucgggaucaguggccccgacaacggcgccguggcggugcugaaguacaacgggaucaucaccgacaccaucaaguccuggcgcaacaauauccugcggacccaggagagcgagugcgccugcgucaacggcuccugcuucacggugaugaccgaugggccgagcaacggccaggccucccacaagaucuucaagauggagaagggcaagguggucaagagcguggagcucgacgcccccaacuaucacuacgaggagugcuccugcuaccccgacgccggggagaucacgugugugugccgcgacaacuggcacggcagcaaccggcccugggucuccuuuaaccagaaccuggaguaccagaucggguacaucugcagcggcguguuuggggacaacccgcgccccaacgacggcaccggcuccugcgggcccgugagcuccaauggcgcguacggggucaagggcuucagcuuccgguacgggaacggcguguggaucggccgcaccaaguccaccaacagucgguccggguucgagaugaucugggaccccaacggcuggaccgagaccgacagcagcuuuuccgugaagcaggacaucgucgccaucacggacuggagcggguacuccggcagcuucgugcagcauccggagcugaccgggcucgacugcauccgccccugcuucugggucgagcugauccggggccgccccaaggaguccaccaucuggaccagcggcuccagcaucuccuuuugcggggugaacagcgacacggugggcugguccuggcccgacggggccgagcugccguucaccaucgacaaguga

SEQ ID NO: 17405 - RNA, 1350 nt, Artificial Sequence
  derived and/or modified CDS sequence (AUadapt) from InfluenzaA__ABE97665__NA
augaaucccaaccagaagaucaucaccaucggcucgaucugcauggugaccgggaucgucucccugaugcuccaggugggcaacaugaucagcaucugggugucccacaguauccacacggggaaccagcaccaggccgagccgaucuccaacaccaacuuccugaccgagaaggccgucgcgagcgugaagcuggccggcaauuccagccucugccccaucaacgggugggccguguacuccaaggacaacagcauccgcaucggcuccaagggcgaugucuucgugauccgggagcccuucaucagcugcucccaccuggagugccgcaccuuuuuccugacgcacggggcccuccugaacgacaagcacagcaacggcaccgugaaggaucggagcccccaccgcacccugaugagcugcccggucggggaggcccccucccccuacaacagccgguuugaguccguggcguggagcgccagcgccugccacgacggcaccuccuggcucacgaucgggaucagcggccccgauaacggcgccguggcgguccugaaguacaacgggaucaucaccgacaccaucaaguccuggcgcaacaacauccugcggacccaggagagcgagugugccugcgugaacggcuccugcuucacggugaugaccgacgggccgagcaacggccaggccucccauaagaucuucaagauggagaagggcaaggucgugaaguccguggagcucgacgcccccaacuaccacuacgaggaguguuccugcuaccccgacgccggggagaucacgugcgucugccgcgacaacuggcauggcagcaaccggcccuggguguccuucaaccagaaccuggaguaccagaucggguacaucuguagcggcguguucggggacaacccgcgccccaacgacggcaccggcuccugugggcccgucagcuccaacggcgcguacggggugaagggcuucagcuucaaguacgggaauggcguguggaucggccggaccaaguccaccaacagccgcuccggguucgagaugaucugggaccccaacggcuggaccgagaccgacagcaguuucuccgucaagcaggacaucguggccaucacggacuggagcggguacuccggcagcuuuguccagcacccggagcugaccgggcucgacugcauccggcccugcuucuggguggagcugauccgcggccggcccaaggaguccaccaucuggaccagcggcuccagcaucuccuuuugcggggugaacagcgacacggucggcugguccuggcccgacggggccgagcugccguucaccaucgacaaguga

SEQ ID NO: 17406 - RNA, 1350 nt, Artificial Sequence
  derived and/or modified CDS sequence (AUadapt) from InfluenzaA__ABE97666__NA
augaaucccaaccagaagaucaucaccaucggcucgaucugcauggugaccgggaucgucucccugaugcuccagaucggcaacaugaucagcaucugggugucccacaguauccacacggggaaccagcaccaguccgagccgaucagcaacaccaacuuccugaccgagaaggccguggccuccgucaagcuggcgggcaauagcccccucugccccaucaacgggugggccguguacuccaaggacaacaguauccgcaucggcuccaagggcgacguguucgucauccgggagcccuucaucagcugcucccaccuggagugccgcaccuuuuuccugacgcagggggcccuccugaacgacaagcacagcaacggcaccgugaaggaccgguccccgcaucgcacccugaugagcugccccgugggggaggcccccucccccuacaacagccgguucgaguccgucgccuggagugcgagcgccugccacgacggcaccuccuggcucacgaucgggaucagcggcccggacaacggcgccguggccgugcugaaguauaacgggaucaucaccgacaccaucaaguccuggcgcaacaacauccugcggacccaggagagcgagugcgcgugugucaacggcuccugcuucacggugaugaccgacgggcccagcaacggccaggccucccacaagaucuuuaagauggagaagggcaagguggucaagagcguggagcucgacgcccccaacuaccacuacgaggagugcuccuguuaccccgacgccggggagaucacgugcgugugccgcgacaacuggcauggcagcaaccggccgugggucuccuucaaccagaaccuggaguaccagaucggguacaucuguagcggcguguucggggacagcccccgccccaacgacggcaccggcuccugugggcccguguccagcaacggcgccuacggggucaagggcuucuccuucaaguacgggaacggcguguggaucggccggaccaagaguaccaacucccgcagcggguucgagaugaucugggacccgaacggcuggaccgagaccgacagcuccuuuagcgugaagcaggacaucgucgcgaucacggacugguccggguacagcggcuccuucgugcagcaucccgagcugaccgggcucgacugcauccggcccugcuucugggucgagcugauccgcggccggcccaaggagagcaccaucuggaccuccggcagcuccaucagcuuuugcggggugaacuccgacacggugggcuggagcuggccggacggggccgagcugcccuucaccaucgacaaguga

SEQ ID NO: 17407 - RNA, 1350 nt, Artificial Sequence
  derived and/or modified CDS sequence (AUadapt) from InfluenzaA__ABE97667__NA
augaaucccaaccagaagaucaucaccaucggcucgaucugcauggugaccgggaucgucucccugaugcuccagaucggcaacaugaucagcaucugggggucccacagcauccacacgggcaaucagcaccaguccgagccgaucagcaacaccaacuuccugaccgagaaggccguggccuccgugaagcuggcggggaacagcucccucugccccaucaauggcugggccgucuacagcaaggacaacuccauccgcaucggcagcaagggggacguguucgugauccgggagcccuucaucuccuguucgcaccuggagugccgcaccuucuuccugacgcagggcgcccuccugaacgacaagcacuccaaugggaccgucaaggaccggagcccccaccgcacccugauguccugcccggugggcgaggcccccagccccuacaacucccgguucgagagcguggccuggagugcguccgccugccacgacgggaccagcuggcucacgaucggcaucuccggccccgacaacggggccgucgccguggugaaguacaacggcaucaucaccgauaccaucaagagcuggcgcaacaacauccugcggacccaggaguccgagugcgcgugcgucaacgggucgugcuuuacggugaugaccgacggcccguccaacggccaggccagccacaagaucuucaagauggagaaggggaagguggucaaguccguggagcuggacgcccccaacuaccauuacgaggagugcagcugcuaccccgacgccggcaagaucacgugcgugugccgcgauaacuggcacggguccaaccggcccugggucagcuucaaccagaaccucgaguaccagaucggcuacaucuguuccgggguguucggcgacaacccgcgccccaacgacggcaccgggagcugcggccccguguccagcaauggggccuacggcgucaagggguucuccuucaaguacggcaacggcguguggaucgggcggaccaagagcaccaacucccgcucgggcuuugagaugaucugggaccccaacggguggaccgagaccgacagcuccuucagcgugaagcaggacaucgucgcgaucacggacugguccggcuauagcggguccuucgugcagcacccggagcugaccggccuggacugcauccggcccugcuucugggucgagcucauccgcggccggcccaaggagagcaccaucuggaccuccgggaguuccaucagcuucugcggcgugaacuccgacaucgugggguggagcuggcccgacggcgccgagcugccguucacgaucgacaaguga

SEQ ID NO: 17408 - RNA, 1350 nt, Artificial Sequence
  derived and/or modified CDS sequence (AUadapt) from InfluenzaA__ABE97669__NA
augaaucccaaccagaagaucaucaccaucggcucgaucugcauggugaccgggaucgucucccugaugcuccagaucggcaacaugaucagcaucugggugucccacagcauccauacggggaaccagcaccaguccgagccgaucagcaacaccaacuuccugaccgagaaggccguggccuccgucaagcuggcgggcaacagcucccucugucccaucaacgggugggccguguacagcaaggacaacuccauccgcaucggcagcaagggcgacguguuugucauccgggagcccuucaucuccugcagccaccuggagugccgcaccuucuuccugacgcagggggcccuccugaacgauaagcacuccaacggcaccgugaaggaccggagcccccaccgcacccugauguccugcccggugggggaggcccccucgcccuacaauucccgguucgagagcgucgccuggagcgcguccgccugccacgacggcaccagcuggcucacgaucgggaucuccggccccgauaacggcgccguggccguggucaaguacaacgggaucaucaccgacaccaucaagagcuggcgcaacaacauccugcggacccaggaguccgagugcgcgugugugaacggcagcugcuucacggugaugaccgacgggccguccaacggccaggccagccacaagaucuuuaagauggagaagggcaaggucgugaaguccguggagcuggacgcccccaacuaccacuacgaggagugcagcuguuaccccgacgccggggagaucacgugcgucugccgcgacaacuggcacggcuccaaccggcccugggugaguuucaaccagaaccucgaguaccagaucggguacaucugcuccggcguguucggggauaacccgcgccccaacgacggcaccggcagcugcgggcccgucuccucgaacggcgccuacggggugaagggcuuuuccuucaaguacgggaacggcguguggaucggccggaccaagagcaccaacucccgcagcggguucgagaugaucugggaccccaauggcuggaccgagaccgacagcuccuucagcgucaagcaggacaucguggcgaucacggacugguccggguacaguggcuccuucguccagcacccggagcugaccgggcuggacugcauccggcccugcuucuggguggagcucauccgcggccggcccaaggagagcaccaucuggaccuccggcagcuccaucaguuucugcggggugaacuccgacacggucggcuggagcuggcccgacggggccgagcugccguucaccaucgacaaguga

SEQ ID NO: 17409 - RNA, 1350 nt, Artificial Sequence
  derived and/or modified CDS sequence (AUadapt) from InfluenzaA__ABE97670__NA
augaaucccaaccagaagaucaucaccaucggcucgaucugcauggugaccgggaucgucucccugaugcuccagaucggcaacaugaucagcaucugggugucccacagcauccacacggggaaucagcaccaguccgagccgaucagcaacaccaacuuccugaccgagaaggccguggccuccgucaagcuggcgggcaacagcucccucugccccaucaaugggugggccguguacagcaaggacaacuccauccgcaucggcagcaagggcgacguguucgucauccgggagcccuucaucuccuguucgcaccuggagugccgcaccuucuuccugacgcagggggcccuccugaacgacaagcacuccaauggcaccgugaaggaccggagcccccaccgcacccugauguccugcccggugggggaggcccccagccccuacaacucccgguucgagagcgucgccuggagugcguccgccugccacgacggcaccagcuggcucacgaucgggaucuccggccccgacaacggcgccguggccguggucaaguacaacgggaucaucaccgauaccaucaagagcuggcgcaacaacauccugcggacccaggaguccgagugcgcgugcgugaacggcucgugcuuuacggugaugaccgacgggccguccaacggccaggccagccacaagaucuucaagauggagaagggcaaggucgugaaguccguggagcuggacacccccaacuaccauuacgaggagugcagcugcuaccccgacgccggggagaucacgugcgucugccgcgauaacuggcacggcuccaaccggcccugggugagcuucaaccagaaccucgaguaccagaucggguacaucuguuccggcguguucggggacaacccgcgccccaacgacggcaccggcagcugcgggcccgucuccagcaauggcgccuacggggugaagggcuucuccuucaaguacgggaacggcguguggaucggccggaccaagagcaccaacucccgcucgggguuugagaugaucugggaccccaacggcuggaccgagacggacagcuccuucagcgucaagcaggacaucguggccaucaccgacugguccggguauagcggcuccuucguccagcacccggagcugaccgggcuggacugcauccggcccugcuucuggguggagcucauccgcggccggcccaaggagagcaccaucuggacguccggcaguuccaucagcuucugcggggugaacuccgacaccgucggcuggagcuggcccgacggggcggagcugccguucaccaucgacaaguga

SEQ ID NO: 17410 - RNA, 1350 nt, Artificial Sequence
  derived and/or modified CDS sequence (AUadapt) from InfluenzaA__ABE97671__NA
augaaucccaaccagaagaucaucaccaucggcucgaucugcauggugaccgggaucgucucccugaugcuccagaucggcaacaugaucagcaucugggugucccacagcauccauacggggaaccagcaccaggccgagccgaucuccaacaccaacuuccugaccgagaaggccguggcgagcgucaagcuggccggcaacuccagucucugccccaucaacgggugggccguguacuccaaggacaacagcauccgcaucggcuccaagggcgacguguuugucauccgggagcccuucaucagcugcucccaccuggagugccgcaccuucuuccugacgcagggggcccuccugaaugacaagcacagcaacggcaccgugaaggaccggagcccccaccgcacccugauguccuguccggugggggaggcccccucccccuacaacagccgguucgaguccgucgcguggagcgccagcgccugccaugacggcaccuccuggcucacgaucgggaucagcggccccgacaacggcgccguggcggugcugaaguacaacgggaucaucaccgacaccaucaaguccuggcgcaauaacauccugcggacccaggagagcgagugcgccugcgucaacggcuccugcuucacggugaugaccgaugggccgucgaacggccaggccucccacaagaucuucaagauggagaagggcaagguggucaagagcguggagcucgacgcccccaacuaucacuacgaggagugcuccugcuaccccgacgccggggagaucacgugcgugugucgcgacaacuggcacggcagcaaccggcccugggucuccuucaaccagaaucuggaguaccagaucggguacaucugcagcggcguguucggggacaacccgcgccccaaugacggcaccggcuccugcgggcccgugagcuccaacggcgcguacggggucaagggcuucagcuuuaaguacgggaacggcguguggaucggccggaccaaguccaccaacagccgcuccggguucgagaugaucugggaccccaacggcuggaccgagaccgauagcagcuucuccgugaagcaggacaucgucgccaucacggacuggagcggguacuccggcaguuucgugcagcacccggagcugaccgggcucgacugcauccggcccugcuucugggucgagcugauccgcggccggcccaaggaguccaccaucuggaccagcggcuccaguaucuccuucugcggggugaacagcgacacggugggcugguccuggcccgacggggccgagcugccguucaccaucgacaaguga

SEQ ID NO: 17411 - RNA, 1350 nt, Artificial Sequence
  derived and/or modified CDS sequence (AUadapt) from InfluenzaA__ABE97672__NA
augaaucccaaccagaagaucaucaccaucggcucgaucugcauggugaccgggaucgucucccugaugcuccagaucggcaacaugaucagcaucugggugucccacagcauccauacggggaaccagcaccaggccgagccgaucuccaacaccaacuuccugaccgagaaggcccuggcgagcgugaagcucgccggcaacuccagucugugccccaucaacgggugggccgucuacuccaaggacaacagcauccgcaucggcuccaagggcgacguguuugugauccgggagcccuucaucagcugcucccaccuggagugccgcaccuucuuccucacgcagggggcccugcugaaugacaagcacagcaacggcaccgucaaggaccggagcccccaccgcacccucaugaguugcccggugggggaggcccccucccccuacaacagccgguucgaguccguggcguggagcgccagcgccugucacgacggcaccuccuggcugacgaucgggaucagcggccccgacaacggcgccgucgcggugcugaaguacaacgggaucaucaccgauaccaucaaguccuggcgcaacaacauccuccggacccaggagucggagugcgccugcgugaacggcuccugcuuuacggucaugaccgacgggccgagcaacggccaggccucccacaagaucuucaagauggagaagggcaagguggugaaguccgucgagcuggacgcccccaacuaucacuacgaggagugcuccugcuaccccgacgccggggagaucacgugcgugugucgcgacaacuggcacggcagcaaccggcccuggguguccuucaaccagaaucuggaguaccagaucggguacaucugcagcggcgucuucggggacaacccgcgccccaaugacggcaccggcuccugcgggcccgugagcuccaacggcgcguacggggugaagggcuucagcuuuaaguacgggaacggcgucuggaucggccggaccaaguccaccaacagccgcuccggguucgagaugaucugggaccccaacggcuggaccgagaccgauagcagcuucuccgugaagcaggacaucguggccaucacggacuggagcggguacuccggcaguuucguccagcacccggagcucaccgggcuggacugcauccggcccugcuucuggguggagcugauccgcggccggcccaaggaguccaccaucuggaccagcggcuccaguaucuccuucugcggggucaacagcgacacggugggcugguccuggcccgacggggccgagcucccguucaccaucgacaaguga

SEQ ID NO: 17412 - RNA, 1350 nt, Artificial Sequence
  derived and/or modified CDS sequence (AUadapt) from InfluenzaA__ABE97675__NA
augaaucccaaccagaagaucaucaccaucggcucgaucugcauggugaccgggaucgucucccugaugcuccaggugggcaacaugaucagcaucugggugucccacagcauccauacggggaaccagcaccaggccgagccgaucuccaacaccaacuuccugaucgagaaggccgucgcgagcgugaagcuggccggcaacuccagucucugccccaucaacgggugggccguguacuccaaggacaacagcauccgcaucggcuccaagggcgacgucuuugugauccgggagcccuucaucagcugcucccaccuggagugccgcaccuucuuccugacccagggggcccuccugaaugacaagcacagcaacggcacggugaaggaccggagcccccaccgcacccugaugaguugcccggucggggaggcccccucccccuacaacagccgguucgaguccguggcguggagcgccagcgccugucacgacggcaccuccuggcucaccaucgggaucagcggccccgacaacggcgccguggcgguccugaaguacaacgggaucaucacggauaccaucaaguccuggcgcaacaacauccugcggacccaggagagcgagugcgccugcgugaacggcuccugcuuuaccgugaugacggacgggccgagcaacggccaggccucccacaagaucuucaagaucgagaagggcaaggucgugaaguccguggagcucgacgcccccaacuaccauuacgaggagugcuccugcuaccccgacgccggggagaucacgugcgucugccgcgauaacuggcacggcagcaaccggcccuggguguccuucaaccagaaccuggaguaucagaucggguacaucugcagcggcguguucggggacaacccgcgccccaacgauggcaccggcuccugcgggcccgucagcuccaacggcgcguacggggugaagggcuucagcuucaaguaugggaacggcguguggaucggccggaccaaguccaccaacagccgcuccggguucgagaugaucugggaccccaacggcuggagcgagaccgauagcuccuucagcgucaagcaggacaucguggccaucaccgacugguccggguacagcggcuccuuuguccagcacccggagcugaccgggcucgacugcauccggcccugcuucuggguggagcugauccgcggccggcccaaggagagcacgaucuggaccuccggcagcuccaucaguuucugcggggugaacuccgacaccgucggcuggagcuggcccgacggggccgagcugccguucaccaucgacaaguga

SEQ ID NO: 17413 - RNA, 1350 nt, Artificial Sequence
  derived and/or modified CDS sequence (AUadapt) from InfluenzaA__ABE97676__NA
augaaucccaaccagaagaucaucaccaucggcucgaucugcauggugaccgggaucgucucccugaugcuccagaucggcaacaugaucagcaucugggugucccacagcauccauacggggaaccagcaccaggccgagccgaucuccaacaccaacuuccugaccgagaaggccguggcgagcgucaagcuggccggcaacuccagccucugucccaucaacgggugggccguguacuccaaggacaacagcauccgcaucggcuccaagggcgacguguucgucauccgggagcccuuuaucagcugcucccaccuggagugccgcaccuucuuccugacgcagggggcccuccugaacgacaagcauagcaacggcaccgugaaggaccggagcccccaccgcacccugauguccugcccggugggggaggcccccucccccuacaacagucgguucgaguccgucgcguggagcgccagcgccugccacgacggcaccuccuggcucacgaucgggaucagcggccccgauaacggcgccguggcggugcugaaguacaacgggaucaucaccgacaccaucaaguccuggcgcaacaacauccugcggacccaggagagcgagugcgccugugucaacggcuccugcuucacggugaugaccgacgggccgagcaacggccaggccucccacaagaucuucaagauggagaagggcaagguggucaagaguguggagcucgacgcccccaacuaccacuacgaggagugcuccugcuaucccgacgccggggagaucacgugcgugugccgcgacaacuggcacggcagcaaccggcccugggucuccuuuaaccagaaccuggaguaccagaucggguacaucugcagcggcguguucggggauaacccgcgccccaacgacggcaccggcuccugcgggcccgugucguccaacggcgcguacggggucaagggcuucaguuucaaguacgggaacggcguguggaucggccggaccaaguccaccaacagccgcuccggguucgagaugaucugggaccccaacggcuggaccgagaccgauagcagcuucuccgugaagcaggacaucgucgccaucaacgacuggagcggguauuccggcagcuucgugcagcacccggagcugacggggcucgacugcauccggcccugcuucugggucgagcugauccgcggccggcccaaggaguccaccaucuggaccagcggcuccaguaucuccuucugcggggugaacagcgacaccgugggcugguccuggcccgacggggccgagcugccguucacgaucgacaaguga

SEQ ID NO: 17414 - RNA, 1350 nt, Artificial Sequence
  derived and/or modified CDS sequence (AUadapt) from InfluenzaA__ABE97677__NA
augaaucccaaccagaagaucaucaccaucggcucgaucugcauggugaccgggaucgucucccugaugcuccagaucggcaacaucaucagcaucugggugcgccacuccauccacacggggaaucagcaccagagcgagccgaucuccaacaccaacuuccugaccgagaaggccguggccagcgucaagcuggcgggcaacuccagucucugccccaucaacgggugggccguguacuccaaggacaacagcauccggaucggcuccaagggcgacguguuugucauccgcgagcccuucaucagcugcucccaccuggagugccggaccuucuuccugacgcagggggcccuccugaaugacaagcacagcaacggcaccgugaaggaccgcagcccccaccggacccugaugaguugcccggugggggaggcccccucccccuacaacagccgcuucgaguccgucgccuggagcgcgagcgccugucacgacggcaccuccuggcucacgaucgggaucagcggccccgacaacggcgccguggccguggucaaguacaacgggaucaucaccgauaccaucaaguccuggcggaacaacauccugcgcacccaggagucggagugcgcgugcgugaacggcuccugcuuuacggugaugaccgacgggccgagcaacggccaggccucccacaagaucuucaagauggagaagggcaaggucgugaaguccguggagcuggacgcccccaacuaucacuacgaggagugcuccugcuaccccgacgccggggagaucacgugcgucugucgggacaacuggcacggcagcaaccgccccuggguguccuucaaccagaaucucgaguaccagaucggguacaucugcagcggcguguucggggacaacccgcggcccaaugacggcaccggcuccugcgggcccgucagcuccaacggcgccuacggggugaagggcuucagcuuuaaguacgggaacggcguguggaucggccgcaccaaguccaccaacagccgguccggguucgagaugaucugggaccccaacggcuggaccgagaccgauagcagcuucuccgucaagcaggacaucguggcgaucacggacuggagcggguacuccggcaguuucguccagcacccggagcugaccgggcuggacugcauccgccccugcuucuggguggagcucauccggggccgccccaaggaguccaccaucuggaccagcggcuccaguaucuccuucugcggggugaacagcgacacggucggcugguccuggcccgacggggccgagcugccguucaccaucgacaaguga

SEQ ID NO: 17415 - RNA, 1350 nt, Artificial Sequence
  derived and/or modified CDS sequence (AUadapt) from InfluenzaA__ABE97679__NA
augaaucccaaccagaagaucaucaccaucggcucgaucugcauggugaccgggaucgucucccugaugcuccagaucggcaacaugaucagcaucugggugcgccacuccauccacacggggaaucagcaccagagcgagccgaucuccaacaccaacuuccugaccgagaaggccguggccagcgucaagcuggcgggcaacuccagucucugccccaucaacgggugggccguguacuccaaggacaacagcauccggaucggcuccaagggcgacguguuugucauccgcgagcccuucaucagcugcucccaccuggagugccggaccuucuuccugacgcagggggcccuccugaaugacaagcacagcaacggcaccgugaaggaccgcagcccccaccggacccugaugaguugcccggugggggaggcccccucccccuacaacagccgcuucgaguccgucgccuggagcgcgagcgccugucacgacggcaccuccuggcucacgaucgggaucagcggccccgacaacggcgccguggccguggucaaguacaacgggaucaucaccgauaccaucaaguccuggcggaacaacauccugcgcacccaggagucggagugcgcgugcgugaacggcuccugcuuuacggugaugaccgacgggccgagcaacggccaggccucccacaagaucuucaagauggagaagggcaaggucgugaaguccguggagcuggacgcccccaacuaucacuacgaggagugcuccugcuaccccgacgccggggagaucacgugcgucugucgggacaacuggcacggcagcaaccgccccuggguguccuucaaccagaaucucgaguaccagaucggguacaucugcagcggcguguucggggacaacccgcggcccaaugacggcaccggcuccugcgggcccgucagcuccaacggcgccuacggggugaagggcuucagcuuuaaguacgggaacggcguguggaucggccgcaccaaguccaccaacagccgguccggguucgagaugaucugggaccccaacggcuggaccgagaccgauagcagcuucuccgucaagcaggacaucguggcgaucacggacuggagcggguacuccggcaguuucguccagcacccggagcugaccgggcuggacugcauccgccccugcuucuggguggagcucauccggggccgccccaaggaguccaccaucuggaccagcggcuccaguaucuccuucugcggggugaacagcgacacggucggcugguccuggcccgacggggccgagcugccguucaccaucgacaaguga

SEQ ID NO: 17416 - RNA, 1350 nt, Artificial Sequence; identical to SEQ ID NO: 17408
  derived and/or modified CDS sequence (AUadapt) from InfluenzaA__ABE97680__NA

SEQ ID NO: 17417 - RNA, 1350 nt, Artificial Sequence; identical to SEQ ID NO: 17408
  derived and/or modified CDS sequence (AUadapt) from InfluenzaA__ABE97681__NA

SEQ ID NO: 17418 - RNA, 1350 nt, Artificial Sequence; identical to SEQ ID NO: 17408
  derived and/or modified CDS sequence (AUadapt) from InfluenzaA__ABE97682__NA

SEQ ID NO: 17419 - RNA, 1350 nt, Artificial Sequence
  derived and/or modified CDS sequence (AUadapt) from InfluenzaA__ABE97684__NA
augaaucccaaccagaagaucaucaccaucggcucgaucugcauggugaccgggaucgucucccugaugcuccagaucggcaacaugaucagcaucugggugucccacaguauccacacggggaaccagcaccaggccgagccgaucuccaacaccaacuuccugaccgagaaggccguggcgagcgucaagcuggccggcaauuccagccucugccccaucaacgggugggccguguacuccaaggacaacaguauccgcaucggcuccaagggcgacguguucgucauccgggagcccuucaucagcugcucccaccuggagugccgcaccuuuuuccugacgcagggggcccuccugaacgacaagcacagcaacggcaccgugaaggaucggagcccccaccgcacccugauguccugcccggugggggaggcccccucccccuacaacagccgguucgaguccgucgcguggagugccagcgccugccacgacggcaccuccuggcucacgaucgggaucagcggccccgacaauggcgccguggcggugcugaaguacaacgggaucaucaccgacaccaucaaguccuggcgcaacaacauccugcggacccaggagagcgagugcgccugugucaacggcuccugcuucacggugaugaccgacgggccgagcaacggccaggccucccacaagaucuuuaagauggagaagggcaagguggucaagagcguggagcucgacgcccccaacuaccacuacgaggaguguuccugcuaccccgacgccggggagaucacgugcgugugccgcgacaacuggcauggcagcaaccggcccugggucuccuucaaccagaaccuggaguaccagaucggguauaucugcagcggcguguucggggacaacccgcgccccaacgacggcaccggcuccugugggcccgugagcuccaacggcgcguacggggucaagggcuucagcuucaaguaugggaacggcguguggaucggccggaccaaguccaccaacagccgcuccggguucgagaugaucugggaccccaacggcuggaccgagaccgacaguagcuucuccgugaagcaggacaucgucgccaucacggacuggagcggguacuccggcaguuucgugcagcacccggagcugaccgggcucgacugcauccggcccugcuucugggucgagcugauccgcggccggcccaaggaguccaccaucuggaccagcggcuccaguaucuccuucugcggggugaacagcggcacgguggggugguccuggcccgacggcgccgagcugccguucaccaucgacaaguga

SEQ ID NO: 17420 - RNA, 1350 nt, Artificial Sequence
  derived and/or modified CDS sequence (AUadapt) from InfluenzaA__ABE97685__NA
augaaucccaaccagaagaucaucaccaucggcucgaucugcauggugaccgggaucgucucccugaugcuccagaucggcaacaugaucagcaucugggugucccacaguauccacacggggaaccagcaccaggccgagccgaucuccaacaccaacuuccugaccgagaaggccguggcgagcgucaagcuggccggcaauuccagccucugccccaucaacgggugggccguguacuccaaggacaacaguauccgcaucggcuccaagggcgacguguucgucauccgggagcccuucaucagcugcucccaccuggagugccgcaccuuuuuccugacgcagggggcccuccugaacgacaagcacagcaacggcaccgugaaggaccggaguccccaccgcacccugauguccugcccggugggggaggcccccucccccuacaacagccgguucgaguccgucgcguggagugccagcgccugccacgacggcaccuccuggcucacgaucgggaucagcggccccgacaacggcgccguggcggugcugaaguauaacgggaucaucaccgacaccaucaaguccuggcgcaacaacauccugcggacccaggagagcgagugcgccugugucaacggcuccugcuucacggugaugaccgacgggccgucgaacggccaggccucccacaagaucuuuaagauggagaagggcaagguggucaagagcguggagcucgacgcccccaacuaccacuacgaggagugcuccuguuaccccgacgccggggagaucacgugcgugugccgcgacaacuggcauggcagcaaccggcccugggucuccuucaaccagaaccuggaguaccagaucggguacaucuguagcggcguguucggggacaacccgcgccccaacgacggcaccggcuccugugggcccgugagcuccaacggcgcguacggggucaagggcuucagcuucaaguacgggaauggcguguggaucggccggaccaaguccaccaacagccgcuccggguucgagaugaucugggaccccaacggcuggaccgagaccgacagcaguuucuccgugaagcaggacaucgucgccaucacggacuggagcggguacuccggcagcuuugugcagcacccggagcugaccgggcucgacugcauccggcccugcuucugggucgagcugauccgcggccggcccaaggaguccaccaucuggaccagcggcuccagcaucuccuuuugcggggugaacagcgacacgggcgggugguccuggcccgacggcgccgagcugccguucaccaucgacaaguga

SEQ ID NO: 17421 - RNA, 1350 nt, Artificial Sequence; identical to SEQ ID NO: 17410
  derived and/or modified CDS sequence (AUadapt) from InfluenzaA__ABE97686__NA

SEQ ID NO: 17422 - RNA, 1350 nt, Artificial Sequence
  derived and/or modified CDS sequence (AUadapt) from InfluenzaA__ABE97687__NA
augaaucccaaccagaagaucaucaccaucggcucgaucugcauggugaccgggaucgucucccugaugcuccaggugggcaacaugaucagcaucugggugucccacaguauccacacggggaaccagcaccaggccgagccgaucuccaacaccaacuuccugaccgagaaggccgucgcgagcgugaagcuggccggcaauuccagccucugccccaucaacgggugggccguguacuccaaggacaacaguauccgcaucggcuccaagggcgacgucuucgugauccgggagcccuucaucagcugcucccaccuggagugccgcaccuuuuuccugacgcagggggcccuccugaacgacaagcacagcaacggcaccgugaaggaccggaguccccaccgcacccugaugagcugcccggucggggaggcccccucccccuacaacagccgguuugaguccguggcguggagcgccagcgccugccacgacggcaccuccuggcucacgaucgggaucagcggccccgacaauggcgccguggcgguccugaaguacaacgggaucaucaccgacaccaucaaguccuggcgcaacaacauccugcggacccaggagagcgagugugccugcgugaacggcuccugcuucacggugaugaccgacgggccgagcaacggccaggccucccauaagaucuucaagauggagaagggcaaggucgugaaguccguggagcucgacgcccccaacuaccacuacgaggagugcuccuguuaccccgacgccggggagaucacgugcgucugccgcgacaacuggcauggcagcaaccggcccuggguguccuucaaccagaaccuggaguaccagaucggguacaucuguagcggcguguucggggacaacccgcgccccaacgacggcaccggcuccugugggcccgucagcuccaacggcgcguacggggugaagggcuucagcuucaaguacgggaauggcguguggaucggccggaccaaguccaccaacagccgcuccggguucgagaugaucugggaccccaacggcuggaccgagaccgacagcaguuucuccgucaagcaggacaucguggccaucacggacuggagcggguacuccggcagcuuuguccagcacccggagcugaccgggcucgacugcauccggcccugcuucuggguggagcugauccgcggccggcccaaggaguccaccaucuggaccagcggcuccagcaucuccuuuugcggggugaacagcgacacggucggcugguccuggcccgacggggccgagcugccguucaccaucgacaaguga

SEQ ID NO: 17423 - RNA, 1350 nt, Artificial Sequence
  derived and/or modified CDS sequence (AUadapt) from InfluenzaA__ABE97688__NA
augaaucccaaccagaagaucaucaccaucggcucgaucugcauggugaccgggaucgucucccugaugcuccaggugggcaacaugaucagcaucugggugucccacagcauccauacggggaaccagcaccaggccgagccgaucuccaacaccaacuuccugaccgagaaggccgucgcgagcgugaagcuggccggcaacuccagucucugccccaucaacgggugggccguguacuccaaggacaacagcauccgcaucggcuccaagggcgacgucuuugugauccgggagcccuucaucagcugcucccaccuggagugccgcaccuucuuccugacgcagggggcccuccugaaugacaagcacagcaacggcaccgugaaggaccggagcccccaccgcacccugauguccuguccggucggggaggcccccucccccuacaacagccgguucgaguccguggcguggagcgccagcgccugccaugacggcaccuccuggcucacgaucgggaucagcggccccgacaacggcgccguggcgguccugaaguacaacgggaucaucaccgacaccaucaaguccuggcgcaauaacauccugcggacccaggagagcgagugcgccugcgugaacggcuccugcuucacggugaugaccgaugggccgagcaacggccaggccucccacaagaucuucaagauggagaagggcaaggucaucaagagcguggagcucgacgcccccaacuaucacuacgaggagugcuccugcuaccccgacgccggggagaucacgugcgugugucgcgacaacuggcacggcagcaaccggcccugggucuccuucaaccagaaucuggaguaccagaucggguacaucugcagcggcguguucggggacaacccgcgccccaaugacggcaccggcuccugcgggcccgugagcuccaacggcgcguacggggucaagggcuucagcuuuaaguacgggaacggcgugugggugggccggaccaaguccaccaacagccgcuccggguucgagaugaucugggaccccaacggcuggaccgagaccgauagcagcuucuccgucaagcaggacaucguggccaucacggacuggagcggguacuccggcaguuucguccagcacccggagcugaccgggcucgacugcauccggcccugcuucuggguggagcugauccgcggccggcccaaggaguccaccaucuggaccagcggcuccaguaucuccuucugcggggugaacagcgacacggucggcugguccuggcccgacggggccgagcugccguucaucaucgacaaguga

SEQ ID NO: 17424 - RNA, 1350 nt, Artificial Sequence
  derived and/or modified CDS sequence (AUadapt) from InfluenzaA__ABE97690__NA
augaaucccaaccagaagaucaucaccaucggcucgaucugcauggugaccgggaucgucucccugaugcuccaggugggcaacaugaucagcaucugggugucccacagcauccauacggggaaccagcaccaggccgagccgaucuccaacaccaacuuccugaccgagaaggccgucgcgagcgugaagcuggccggcaacuccagucucugccccaucaacgggugggccguguacuccaaggacaacagcauccgcaucggcuccaagggcgacgucuuugugauccgggagcccuucaucagcugcucccaccuggagugccgcaccuucuuccugacgcagggggcccuccugaaugacaagcacagcaacggcaccgugaaggaccggagcccccaccgcucccugauguccuguccggucggggaggcccccagccccuacaacucccgguucgagagcguggcguggagcgccuccgccugccaugacggcaccagcuggcucaccaucgggaucuccggccccgacaacggcgccguggcgguccugaaguacaacgggaucaucacggacaccaucaagaguuggcgcaacaacauccugcggacccaggaguccgagugcgccugcgugaacggcucgugcuuuaccgugaugacggacgggccguccaacggccaggccagccacaagaucuucaagaugaagaagggcaaggucgugaaguccguggagcucgacgcccccaacuaccauuacgaggagugcagcugcuaccccgacgccggggagaucacgugcgucugucgcgacaacuggcacggcuccaaccggcccugggugagcuucaaccagaaucuggaguaccagaucggguacaucugcuccggcguguucggggacaacccgcgccccaacgauggcaccggcagcugcgggcccgucuccagcaacggcgcguacggggugaagggcuucuccuucaaguaugggaacggcguguggaucggccggaccaagagcaccaacucccgcagcggguucgagaugaucugggaccccaacggcuggaccgagaccgauagcuccuucagcgucaagcaggacaucguggccaucaccgacugguccggguacagcggcuccuuuguccagcacccggagcugacggggcucgacugcauccggcccugcuucuggguggagcugauccgcggccggcccaaggagagcaccaucuggaccuccggcagcuccaucaguuucugcggggugaacuccgacaccgucggcuggagcuggcccgacggggccgagcugccguucacgaucgacaaguga

SEQ ID NO: 17425 - RNA, 1350 nt, Artificial Sequence
  derived and/or modified CDS sequence (AUadapt) from InfluenzaA__ABE97691__NA
augaaucccaaccagaagaucaucaccaucggcucgaucugcauggugaccgggaucgucucccugaugcuccaggugggcaacaugaucagcaucugggugucccacaguauccacacggggaaccagcaccaggccgagccgaucuccaacaccaacuuccugaccgagaaggccgucgcgagcgugaagcuggccggcaauuccagccucugccccaucaacgggugggccguguacuccaaggacaacaguauccgcaucggcuccaagggcgacgucuucgugaagcgggagcccugcaucagcugcucccaccugaagugccgcaccuuuuuccugacgcagggggcccuccugaacgacaagcacagcaacggcaccgugaaggaccggaguccccaccgcacccugaugucgugcccggucggggaggcccccucccccuacaacagccgguuugaguccguggcguggagcgccagcgccugccacgacggcaccuccuggcucacgaucgggaucagcggccccgacaauggcgccguggcgguccugaaguacaacgggaucaucaccgacaccaucaaguccuggcgcaacaacauccugcggacccaggagagcgagugugccugcgugaacggcuccugcuucacggugaugaccgacgggccgagcaacggccaggccucccauaagaucuucaagauggagaagggcaaggucgugaaguccguggagcucgacgcccccaacuaccacuacgaggagugcuccuguuaccccgacgccggggagaucacgugcgucugccgcgacaacuggcauggcagcaaccggcccuggguguccuucaaccagaaccuggaguaccagaucggguacaucuguagcggcguguucggggacaacccgcgccccaacgacggcaccggcuccugugggcccgucucguccaacggcgcguacggggugaagggcuucagcuucaaguacgggaauggcguguggaucggccggaccaaguccaccaacagccgcuccggguucgagaugaucugggaccccaacggcuggaccgagaccgacagcaguuucuccgucaagcaggacaucguggccaucacggacuggagcggguacuccggcagcuuuguccagcacccggagcugaccgggcucgacugcauccggcccugcuucuggguggagcugauccgcggccggcccaaggaguccaccaucuggaccagcggcuccagcaucuccuuuugcggggugaacagcgacacggucggcugguccuggcccgacggggccgagcugccguucaccaucgacaaguga

SEQ ID NO: 17426 - RNA, 1350 nt, Artificial Sequence
  derived and/or modified CDS sequence (AUadapt) from InfluenzaA__ABE97694__NA
augaaucccaaccagaagaucaugaccaucggcucgaucugcauggugaccgggaucgucucccugaugcuccaggugggcaacaugaucagcaucugggugucccauagcauccacacggggaaccagcaccaggccgagccgaucuccaacaccaacuuucugaccgagaaggccgucgacagcgugaagcuggcgggcaacuccagccucugccccaucaacgggugggccguguauuccaaggacaacagcauccgcaucggcuccaagggcgacgucuucgugauccgggagcccagcguguccuguagccaccuggagugccgcaccuucuuccugacgcagggggcccuccugaacgauaagcacuccaacggcaccgucaaggaccggagcccccaccgcacccugauguccugcccggugggggaggcccccagucccuacaacucccgguucgagagcguggccuggagcgcguccgccugccaugacggcaccagcuggcucacgaucgggaucuccggccccgacaacggcgccgucgccgugcugaaguacaacgggaucaucaccgauaccaucaagagcuggcgcaacaacauccugcggacccaggaguccgagugcgcgugcgugaacggcaguugcuucacggucaugaccgacgggccguccaacggccaggccagccacaagaucuuuaagauggagaagggcaagguggugaaguccgucgagcucgacgcccccaacuaccacuacgaggaguguagcugcuaccccgacgccggggagaucacgugcgugugccgcgauaacuggcacggcuccaaccggcccugggugagcuucaaccagaaucuggaguaccagaucggguacaucugcuccggcgucuucggggacaacccgcgccccaaugacggcaccggcagcugcgggcccguguccagcaacggcgccuacggggugaagggcuuuuccuucaaguacgggaacggcgucuggaucggccggaccaagagcaccaacucccgcagcggguuugagaugaucugggaccccaacggcuggaccgagaccgacagcuccuucagcgugaagcaggaugucguggcgaucacggacugguccggguacagcggcuccuucgugcagcacccggagcugaccgggcucgacuguauccggcccugcuucugggucgagcugauccgcggccggcccaaggagagcaccaucuggaccuccggcagcuccaucagcuucuguggggugaacuccgacacggugggcuggagcuggcccgacggggccgagcugccguucaccaucgacaaguga

SEQ ID NO: 17427 - RNA, 1350 nt, Artificial Sequence
  derived and/or modified CDS sequence (AUadapt) from InfluenzaA__ABE97696__NA
augaaucccaaccagaagaucaucaccaucggcucgaucugcauggugaccgggaucgucucccugaugcuccaggugggcaacaugaucagcaucugggugucccacagcauccauacggggaaccagcaccaggccgagccgaucuccaacaccaacuuccugaccgagaaggccgucgcgagcgugaagcuggccggcaacuccagucucugccccaucaacgggugggccguguacuccaaggacaacagcauccgcaucggcuccaagggcgacgucuuugugauccgggagcccuucaucagcugcucccaccuggagugccgcaccuucuuccugacgcagggggcccuccugaaugacaagcacagcaacggcuccgugaaggaccggagcccccaccgcacccugauguccuguagcgucggggaggccccgucccccuacaacagccgguucgagagcguggcgugguccgccagcgccugucacgacggcaccuccuggcucaccaucgggaucagcggccccgacaacggcgccguggcgguccugaaguacaacgggaucaucacggauaccaucaaguccuggcgcaacaacauccugcggacccaggagagcgagugcgccugcgugaacggcuccugcuuuaccgugaugacggacgggcccagcaacggccaggccucccacaagaucuucaagauggagaagggcaaggucgucaagagcguggagcucgacgccccgaacuaucacuacgaggagugcuccugcuaccccgacgccggggagaucacgugcgugugucgcgacaacuggcacggcagcaaccggcccuggguguccuucaaccagaaucuggaguaccagaucggguacaucugcagcggcguguucggggacaacccccgcccgaaugacggcaccggcuccugcgggcccgucagcuccaacggcgcguacggggugaagggcuucagcuuuaaguacgggaacggcguguggaucggccggaccaaguccaccaacagccgcagcggguucgagaugaucugggaccccaauggcuggaccgagaccgacuccagcuucuccgucaagcaggacaucguggccaucaccgacuggagcggguacuccggcaguuucguccagcaccccgagcugacggggcucgacugcauccggccgugcuucuggguggagcugauccgcggccggcccaaggaguccaccaucuggaccagcggcuccaguaucuccuucugcggggugaacagcgacaccgucggcugguccuggcccgacggggccgagcugcccuucacgaucgacaaguga

SEQ ID NO: 17428 - RNA, 1350 nt, Artificial Sequence
  derived and/or modified CDS sequence (AUadapt) from InfluenzaA__ABE97697__NA
augaaucccaaccagaagaucaucaccaucggcucgaucugcauggugaccgggaucgucucccugaugcuccaggugggcaacaugaucagcaucugggugucccacagcauccauacggggaaccagcaccaggccgagccgaucuccaacaccaacuuccugaacgagaaggccgucgcgagcgugaagcuggccggcaacuccagucucugccccaucaacgggugggccguguacuccaaggacaacagcauccgcaucggcuccaagggcgacgucuuugugauccgggagcccuucaucagcugcucccaccuggagugccgcaccuucuuccugacccagggggcccuccugaacgauaagcacagcaacggcacggugaaggaccggagcccccaccgcacccugaugucgugcccggucggggaggcccccucccccuauaacagccgguucgaguccguggcguggagcgccagcgccugccacgauggcaccuccuggcucaccaucgggaucagcggccccgacaacggcgccguggcgguccugaaguacaacgggaucaucacggacaccaucaaguccuggcgcaacaacauccugcggacccaggagagugagugcgccugcgugaacggcuccugcuucaccgugaugacggacgggccgagcaacggccaggccucccauaagaucuucaagauggagaagggcaaggucgugaaguccguggagcucgacgcccccaacuaccacuacgaggagugcuccuguuaccccgacgccggggagaucacgugcgucugccgcgacaacuggcacggcagcaaucggcccuggguguccuucaaccagaaccuggaguaccagaucggguacaucugcagcggcguguuuggggacaacccgcgccccaacgacgagaccggcuccugcggccccgucucguccaacggggcguacggcgugaagggguuuagcuucaaguacggcaacgggguguggaucggccggaccaaguccaccaacagccgcuccggcuucgagaugaucugggaccccaauggguggaccgagaccgacagcagcuucuccgucaagcaggacaucguggccaucaccgacuggagcggcuauuccgggagcuucguccagcacccggagcugacgggccucgacugcauccggcccugcuucuggguggagcugauccgcgggcggcccaaggaguccaccaucuggaccagcggcuccaguaucuccuucugcggcgugaacagcgacaccgucgggugguccuggcccgacggcgccgagcugccguucacgaucgacaaguga

SEQ ID NO: 17429 - RNA, 1350 nt, Artificial Sequence
  derived and/or modified CDS sequence (AUadapt) from InfluenzaA__ABE97702__NA
augaaucccaaccagaagaucaucaccaucggcucgaucugcauggugaccgggaucgucucccugaugcuccaggugggcaacaugaucagcaucugggugucccacaguauccacacggggaaccagcaccaggccgagccgaucuccaacaccaacuuccugaccgagaaggccgucgcgagcgugaagcuggccggcaauuccagccucugccccaucaacgggugggccguguacuccaaggacaacagcauccgcaucggcuccaagggcgaugucuucgugauccgggagcccuucaucagcugcucccaccuggagugccgcaccuuuuuccugacgcagggggcccuccugaacgacaagcacagcaacggcaccgugaaggaccggaguccccaccgcacccugaugagcugcccggucggggaggcccccucccccuacaacagccgguucgaguccguggcguggagugccagcgccugccacgacggcaccuccuggcucacgaucgggaucagcggccccgacaauggcgccguggcgguccugaaguacaacgggaucaucaccgacaccaucaaguccuggcgcaacaacauccugcggacccaggagagcgagugcgccugugugaacggcuccugcuucacggugaugaccgacgggccgagcaacggccaggccucccacaagaucuuuaagauggagaagggcaaggucgugaaguccguggagcucgacgcccccuacuaccacuacgaggagugcuccuguuaccccgacgccggggagaucacgugcgucugccgcgacaacuggcacggcaguaaccggcccuggguguccuucaaccagaaccuggaguaccagaucggguacaucugcaguggcguguucggggacaacccgcgccccaacgacggcaccggcuccugcgggcccgucaguuccaacggcgcguacggggugaagggcuucagcuucaaguacgggaacggcguguggaucggccggaccaaguccaccaauagccgcuccggguucgagaugaucugggaccccaacggcuggaccgagaccgacagcagcuuuuccgucaagcaggacaucgugagcaucacggacugguccggguacagcggcuccuucguccagcauccggagcugaccgggcucgacugcauccggcccugcuucuggguggagcugauccgcggccggcccaaggagagcaccaucuggaccuccggcagcuccaucagcuuuugcggggugaacuccgacacggucggcuggagcuggcccgacggggccgagcugccguucaccaccgacaaguga

SEQ ID NO: 17430 - RNA, 1350 nt, Artificial Sequence; identical to SEQ ID NO: 17422
  derived and/or modified CDS sequence (AUadapt) from InfluenzaA__ABE97703__NA

SEQ ID NO: 17431 - RNA, 1350 nt, Artificial Sequence; identical to SEQ ID NO: 17422
  derived and/or modified CDS sequence (AUadapt) from InfluenzaA__ABE97705__NA

SEQ ID NO: 17432 - RNA, 1350 nt, Artificial Sequence
  derived and/or modified CDS sequence (AUadapt) from InfluenzaA__ABE97706__NA
augaaucccaaccaaaagaucaucaccaucggcagcaucugcauggugaccgggaucgucucccugaugcuccaggugggcaacaugaucagccugugggugucccacaguauccacacggggaaccagcaccaggccgagccgaucuccaacaccaacuuccugaccgagcgcgccgucgcgagugugaagcucgccggcaacuccagccugugccccaucaacgggugggccguguacuccaaggacaauagcauccggaucggcuccaagggcgacgucuucgugauccgcgagcccuucaucagcugcucccaucuggagugccggaccuucuuccucacgcaaggggcccugcugaacgacaagcacagcaauggcaccgugaaggaccgcagcccccaccggacccucaugagcugcccggucggggaggcccccucccccuacaauagccgcuucgaguccguggcguggagcgccagcgccugccacgauggcaccuccuggcugacgaucgggaucagcggccccgacaacggcgccguggcgguccugaaguacaacgggaucaucaccgacaccaucaaguccuggcggaauaacauccuccgcacccaggagagcgagugcgccugcgugaacggcuccugcuuuacggugaugaccgacgggccgagcaacggccaggccucccacaagaucuucaagauggaaaagggcaaggucgugaaguccguggagcuggacgcccccaacuaucacuacgaggagugcuccugcuaccccgacgccggggagaucacgugugucugccgggacaacuggcacggcagcaaccgccccuggguguccuuuaaccagaaccuggaguaccagaucggguacaucugcagcggcguguuuggggacaacccgcggcccaacgacggcaccggcuccugcgggcccgucagcuccaauggcgcguacggggugaagggcuucagcuucaaguacgggaacggcguguggaucggccgcaccaaauccaccagcucccggaguggguucgagaugaucugggaccccaacggcuggaccgagaccgacagcuccuucagugucaagcaggacaucguggccaucacggacugguccggguacagcggcuccuucguccagcacccggagcucaccgggcuggauugcauccgccccugcuucuggguggagcugauccggggccgccccaaggagagcaccaucugggccuccggcagcuccaucagcuuuugcggggugaacuccgacaccgucggcuggagcuggcccgacggggccgagcucccguucacgaucgacaaguga

SEQ ID NO: 17433 - RNA, 1350 nt, Artificial Sequence
  derived and/or modified CDS sequence (AUadapt) from InfluenzaA__ABE97707__NA
augaaucccaaccagaagaucaucaccaucggcucgaucugcauggugaccgggaucgucucccugaugcuccaggugggcaacaugaucagcaucugggugucccacaguauccacacggggaaccagcaccaggccgagccgaucuccaacaccaacuuccugaccgagaaggccgucgcgagcgugaagcuggccggcaauuccagccucugccccaucaaggggugggccguguacuccaaggacaacagcauccgcaucggcuccaagggcgaugucuucgugauccgggagcccuucaucagcugcucccaccuggagugccgcaccuucuuucugacgcagggggcccuccugaacgacaagcacagcaacggcaccgugaaggaccggaguccccaccgcacccugaugagcugcccggucggggaggcccccucccccuacaacagccgguucgaguccguggcguggagugccagcgccugccacgacggcaccuccuggcucacgaucgggaucagcggccccgacaauggcgccguggcgguccugaaguacaacgggaucaucaccgacaccaucaaguccuggcgcaacaacauccugcggacccaggagagcgagugcgccugugugaacggcuccugcuucacggugaugaccgacgggccgagcaacggccaggccucccacaagaucuuuaagauggagaagggcaaggucgugaaguccguggagcucgacgcccccaacuaccacuacgaggagugcuccuguuaccccgacgccggggagaucacgugcgucugccgcgacaacuggcacggcaguaaccggcccuggguguccuucaaccagaaccuggaguaccagaucggguacaucuguagcggcguguucggggacaacccgcgccccaacgacggcaccggcuccugcgggcccgucaguuccaacggcgcguacggggugaagggcuucagcuucaaguacgggaauggcguguggaucggccggaccaaguccaccaacagccgcuccggguucgagaugaucugggaccccaacggcuggaccgagaccgacagcaguuucuccgucaagcaggacaucguggccaucacggacuggagcggguacuccggcagcuuuguccagcacccggagcugaccgggcucgacugcauccggcccugcuucuggguggagcugauccgcggccggcccaaggaguccaccaucuggaccagcggcuccagcaucuccuuuugcggggugaacagcgacacggucggcugguccuggcccgacggggccgagcugccguucaccaucgacaaguga

SEQ ID NO: 17434 - RNA, 1350 nt, Artificial Sequence
  derived and/or modified CDS sequence (AUadapt) from InfluenzaA__ABE97708__NA
augaaucccaaccagaagaucaucaccaucggcucgaucugcauggugaccgggaucgucucccugaugcuccaggugggcaacaugaucagcaucugggugucccacagcauccauacggggaaccagcaccaggccgagccgaucuccaacaccaacuuccugaccgagaaggccgucgcgagcgugaagcuggccggcaacuccagucucugccccaucaacgggugggccguguacuccaaggacaacagcauccgcaucggcuccaagggcgacgucuuugugauccgggagcccuucaucagcugcucccaccuggagugccgcaccuucuuccugacgcauggggcccuccugaacgacaagcacagcaacggcaccgugaaggaccggagcccccaucgcacccugaugagcugcccggucggggaggcccccucccccuacaacagccgguucgaguccguggcguggagcgccagugccugccacgacggcaccuccuggcucacgaucgggaucagcggccccgacaacggcgccguggcgguccugaaguacaaugggaucaucaccgacaccaucaaguccuggcgcaacaacauccugcggacccaggagucggagugcgccugcgugaacggcuccuguuucacggugaugaccgacgggccgagcaacggccaggccucccacaagaucuucaagaugaagaagggcaaggucgugaaguccguggagcucgacgcccccaacuaucacuacgaggagugcuccugcuaccccgacgccggggagaucacgugcgucugucgcgacaacuggcacggcagcaaccggcccuggguguccuucaaccagaaucuggaguaccagaucggguacaucugcagcggcguguucggggacaacccgcgccccaaugacggcaccggcuccugcgggcccgucagcuccaacggcgcguacggggugaagggcuucagcuuuaaguacgggaacggcguguggaucggccggaccaaguccaccaacagccgcuccggguucgagaugaucugggaccccaacggcuggaccgagaccgauagcagcuucuccgucaagcaggacaucguggccaucacggacuggagcggguacuccggcaguuucguccagcacccggagcugaccgggcucgacugcauccggcccugcuucuggguggagcugauccgcggccggcccaaggaguccaccaucuggaccagcggcuccaguaucuccuucugcggggugaacagcgacacggucggcugguccuggcccgacggggccgagcugccguucaccaucgacaaguga

SEQ ID NO: 17435 - RNA, 1350 nt, Artificial Sequence
  derived and/or modified CDS sequence (AUadapt) from InfluenzaA__ABE97710__NA
augaaucccaaccagaagaucaucaccaucggcucgaucugcauggugaccgggaucgucucccugaugcuccaggugggcaacaugaucagcaucugggugucccacagcauccauacggggaaccagcaccaggccgagccgaucuccaacaccaacuuccugaccgagaaggccgucgcgagcgugaagcuggccggcaacuccagucucugccccaucaacgggugggccguguacuccaaggacaacagcauccgcaucggcuccaagggcgacgucuuugugauccgggagcccuucaucagcugcucccaccuggagugccgcaccuucuuccugacgcagggggcccuccugaaugacaagcacagcaacggcaccgugaaggaccggagcccccaccgcacccugaugaguugcccggucggggaggcccccucccccuacaacagccgguucgaguccguggcguggagcgccagcgccugucacgacggcaccuccuggcucacgaucgggaucagcggccccgacaacggcgccguggcgguccugaaguacaacgggaucaucaccgauaccaucaaguccuggcgcaacaacauccugcggacccaggagucggagugcgccugcgugaacggcuccugcuuuacggugaugaccgacgggccgagcaacggccaggccucccacaagaucuucaagauggagaagggcaaggucgugaaguccguggagcucaacgcccccaacuaucacuacgaggagugcuccugcuaccccgacgccggggagaucacgugcgucugucgcgacaacuggcacggcagcaaccggcccuggguguccuucaaccagaaucuggaguaccagaucggguacaucugcagcggcguguucggggacaacccgcgccccaaugacggcaccggcuccugcgggcccgucagcuccaacggcgcguacggggugaagggcuucagcuuuaaguacgggaacggcguguggaucggccggaccaaguccaccaacagccgcuccggguucgagaugaucugggaccccaacggcuggaccgagaccgauagcagcuucucccugaagcaggacaucgucgccaucacggacuggagcggguacuccggcaguuucgugcagcacccggagcucaccgggcuggacugcauccggcccugcuucugggucgagcugauccgcggccggcccaaggaguccaccaucuggaccagcggcuccaguaucuccuucugcggggugaacagcgacacggugggcugguccuggcccgacggggccgagcucccguucaccaucgacaaguga

SEQ ID NO: 17436 - RNA, 1350 nt, Artificial Sequence
  derived and/or modified CDS sequence (AUadapt) from InfluenzaA__ABE97711__NA
augaaucccaaccaaaagaucaucaccaucggcagcaucugcauggugaccgggaucgucucccugaugcuccaggugggcaacaugaucagcaucugggugucccacaguauccacacggggaaccagcaccaggccgagccgaucuccaacaccaacuuccugaccgagaaggccgucgcgagugugaagcuggccggcaacuccagccucugccccaucaacgggugggccguguacuccaaggacaauagcauccgcaucggcuccaagggcgacgucuucgugauccgggagcccuucaucagcugcucccaucuggagugccgcaccuucuuccugacgcagggggcccuccugaacgacaagcacagcaauggcaccgugaaggaccggagcccccaccgcacccugaugagcugcccggucggggaggcccccucccccuacaauagccgguucgaguccguggcguggagcgccagcgccugccacgauggcaccuccuggcucacgaucgggaucagcggccccgacaacggcgccguggcgguccugaaguacaacgggaucaucaccgacaccaucaaguccuggcgcaauaacauccugcggacccaggagagcgagugcgccugcgugaacggcuccugcuuuacggugaugaccgacgggccgagcgacggccaggccucccacaagaucuucaagauggagaagggcaaggucgugaaguccguggagcucgacgcccccaacuaucacuacgaggagugcuccugcuaccccgacgccggggagaucacgugugucugccgcgacaacuggcacggcagcaaccggcccuggguguccuuuaaccagaaccuggaguaccagaucggguacaucugcagcggcguguuuggggacaacccgcgccccaacgacggcaccggcuccugcgggcccgucagcuccaauggcgcguacggggugaagggcuucagcuucaaguacgggaacggcguguggaucggccggaccaaguccaccaacagucgcuccggguucgagauggucugggaccccaacggcuggaccgagaccgacagcagcuuuuccgugaagcaggacaucgucgccaucacggacuggagcggguacuccggcagcuucgugcagcauccggagcugaccgggcucgacugcauccggcccugcuucuggguggagcugauccgcggccggcccaaggaguccaccaucuggaccagcggcuccagcaucuccuuuugcggggucaacagcgacacggugggcugguccuggcccgacggggccgagcugccguucaccaucgacaaguga

SEQ ID NO: 17437 - RNA, 1350 nt, Artificial Sequence; identical to SEQ ID NO: 17422
  derived and/or modified CDS sequence (AUadapt) from InfluenzaA__ABE97712__NA

SEQ ID NO: 17438 - RNA, 1350 nt, Artificial Sequence; identical to SEQ ID NO: 17422
  derived and/or modified CDS sequence (AUadapt) from InfluenzaA__ABE97713__NA

SEQ ID NO: 17439 - RNA, 1350 nt, Artificial Sequence; identical to SEQ ID NO: 17422
  derived and/or modified CDS sequence (AUadapt) from InfluenzaA__ABE97715__NA

SEQ ID NO: 17440 - RNA, 1350 nt, Artificial Sequence
  derived and/or modified CDS sequence (AUadapt) from InfluenzaA__ABE97717__NA
augaaucccaaccagaagaucaucaccaucggcucgaucugcauggugaccgggaucgucaaccugaugcuccaggugggcaacaugaucuccaucugggugagccauuccauccacacggggaaccagcaccaggccgagccgaucagcaacaccaacuuccugaccgagaaggccgucgcguccgugaagcuggccggcaauagcucccucugccccaucaacgggugggccguguacagcaaggacaauuccauccgcaucggcagcaagggcgacgucuucgugauccgggagcccuucaucuccugcagccaccuggagugucgcaccuucuuccugacgcagggggcccuccugaacgacaagcacuccaacggcaccgugaaggaccggaguccccaccgcacccugauguccugcccggucggggaggcccccagccccuacaacucccgguucgagaguguggcgugguccgccagcgccugccacgacggcaccagcuggcucacgaucgggaucuccggccccgacaacggcgccguggcgguccugaaguauaacgggaucaucaccgacaccaucaagagcuggcgcaacaacauccugcggacccaggaguccgagugcgccugugugaacggcucgugcuucacggugaugaccgacgggccguccaacggccaggccagccauaagaucuucaagauggagaagggcaaggucgugaaguccguggagcucgacgcccccaacuaccacuacgaggagugcaguugcuaccccgacgccggggagaucacgugcgucugccgcgacaauuggcacggcuccaaccggcccugggugagcuucaaccagaaccuggaguaccagaucggguauaucugcuccggcguguucggggacaacccgcgccccaacgacggcaccggcaguugcgggcccguccccuccaacggcgcguacggggugaagggcuucagcuucaaguacgggaauggcguguggaucggccggaccaaguccaccaacagccgcuccggguucgagaugaucugggacccgaacggcuggaccgagaccgacagcuccuuuagcgucaagcaggacaucguggccaucacggacuggagcggguacuccggcagcuuuguccagcaccccgagcugaccgggcucgacugcauccggcccugcuucuggguggagcugauccgcggccggcccaaggaguccaccaucuggaccagcggcuccagcaucuccuuuugcggggugaacagcgacacggucggcugguccuggccggacggggccgagcugcccuucaccaucgacaaguga

SEQ ID NO: 17441 - RNA, 1350 nt, Artificial Sequence
  derived and/or modified CDS sequence (AUadapt) from InfluenzaA__ABE97718__NA
augaaucccaaccagaagaucaucaccaucggcagcaucugcauggugaccgggaucgucucccugaugcuccaggugggcaacaugaucagcaucugggugucccacaguauccacacggggaaccagcaccaggccgagccgaucuccaacaccaacuuccugaccgagaaggccgucgcgagugugaagcuggccggcaacuccagccucugccccaucaacgggugggccguguacuccaaggacaauagcauccgcaucggcuccaagggcgacgucuucgugauccgggagcccuucaucagcugcucccaucuggagugccgcaccuucuuccugacgcagggggcccuccugaacgacaagcacagcaauggcaccgugaaggaccggagcccccaccgcacccugaugagcugcccggucggggaggcccccucccccuacaauagccgguucgaguccguggcguggagcgccagcgccugccacgauggcaccuccuggcucacgaucgggaucagcggccccgacaacggcgccguggcgguccugaaguacaacgggaucaucaccgacaccaucaaguccuggcgcaauaacauccugcggacccaggagagcgagugcgccugcgugaacggcuccugcuuuacggugaugaccgacgggccgagcaacggccaggccucccacaagaucuucaagauggagaagggcaaggucgugaaguccguggagcucgacgcccccaacuaucacuacgaggagugcuccugcuaccccgacgccggggagaucacgugugucugccgcgacaacuggcacggcagcaaccggcccuggguguccuuuaaccagaaccuggaguaccagaucggguacaucugcagcggcguguuuggggacaacccgcgccccaacgacggcaccggcuccugcgggcccgucagcuccaauggcgcguacggggugaagggcuucagcuucaaguacgggaacggcguguggaucggccggaccaaguccaccaacagucgcuccggguucgagaugaucugggaccccaacggcuggaccgagaccgacagcagcuuuuccgucaagcaggacaucguggccaucacggacuggagcggguacuccggcagcuucguccagcauccggagcugaccgggcucgacugcauccggcccugcuucuggguggagcugauccgcggccggcccaaggaguccaccaucuggaccagcggcuccagcaucuccuuuugcgggguggacagcgacacggucggcugguccuggcccgacggggccgagcugccguucaccaucgacaaguga

SEQ ID NO: 17442 - RNA, 1350 nt, Artificial Sequence
  derived and/or modified CDS sequence (AUadapt) from InfluenzaA__ABE97719__NA
augaaucccaaccagaagaucaucaccaucggcucgaucugcauggugaccgggaucgucucccugaugcuccaggugggcaacaugaucagcaucugggugucccacagcauccauacggggaaccagcaccaggccgagccgaucuccaacaccaacuuccugaccgagaaggccgucgcgagcgugaagcuggccggcaacuccagucucugccccaucaacgggugggccguguacuccaaggacaacagcauccgcaucggcuccaagggcgacgucuuugugauccgggagcccuucaucagcugcucccaccuggagugccgcaccuucuuccugacgcagggggcccuccugaaugacaagcacagcaacggcaccgugaaggaccggagcccccaccgcacccugaugaguugcccggucggggaggcccccucccccuacaacagccgguucgaguccguggcguggagcgccagcgccugucacgacggcaccuccuggcucacgaucgggaucagcggccccgacaacggcgccguggcgguccugaaguacaacgggaucaucaccgauaccaucaaguccuggcgcaacaacauccugcggacccaggagucggagugcgccugcgugaacggcuccugcuuuacggugaugaccgacgggccgagcaacggccaggccucccacaagaucuucaagaugaagaagggcaaggucgugaaguccguggagcucgacgcccccaacuaucacuacgaggagugcuccugcuaccccgacgccggggagaucacgugcgucugucgcgacaacuggcacggcagcaaccggcccuggguguccuucaaccagaaucuggaguaccagaucggguacaucugcagcggcguguucggggacaacccgcgccccaaugacggcaccggcuccugcgggcccgucagcuccaacggcgcguacggggugaagggcuucagcuuuaaguacgggaacggcguguggaucggccggaccaaguccaccaacagccgcuccggguucgagaugaucugggaccccaacggcuggaccgagaccgauagcagcuucuccgucaagcaggacaucguggccaucacggacuggagcggguacuccggcaguuucguccagcacccggagcugaccgggcucgacugcauccggcccugcuucuggguggagcugauccgcggccggcccaaggaguccaccaucuggaccagcggcuccaguaucuccuucugcggggugaacagcgacacggucggcugguccuggcccgacggggccgagcugccguucaccaucgacaaguga

SEQ ID NO: 17443 - RNA, 1350 nt, Artificial Sequence
  derived and/or modified CDS sequence (AUadapt) from InfluenzaA__ABE97720__NA
augaaucccaaccaaaagaucaucaccaucggcagcaucugcauggugaccgggaucgucucccugaugcuccaggugggcaacaugaucagcaucugggugucccacaguauccacacggggaaccagcaccaggccgagccgaucuccaacgccaacuuccugaccgagaaggcggucgccagugugaagcuggccggcaacuccagccucugccccaucaacgggugggccguguacuccaaggacaauagcauccgcaucggcuccaagggcgacgucuucgugauccgggagcccuucaucagcugcucccaucuggagugccgcaccuucuuccugacccagggggcccuccugaacgacaagcacaguaacggcacggugaaggaccggagcccccaccgcacccugaugagcugcccggucggggaggcgcccucccccuauaacagccgguucgaguccguggccuggagcgccagcgccugccacgauggcaccuccuggcucaccaucgggaucagcggccccgacaacggcgcgguggccguccugaaguacaacgggaucaucacggacaccaucaaguccuggcgcaauaacauccugcggacccaggagagcgagugcgccugcgugaacggcuccugcuuuaccgugaugacggacgggccgagcaacggccaggccucccacaagaucuucaagauggagaagggcaaggucgugaaguccguggagcucgacgcccccaauuaccacuacgaggagugcuccugcuaccccgaugcgggggagaucacgugcgucugccgcgacaacuggcacggcagcaaucggcccuggguguccuucaaccagaaccuggaguaccagaucggguacaucugcagcggcguguuuggggacaccccgcgccccaacgacggcaccggcuccugcgggcccgucagcuccaacggcgccuauggggugaagggcuucagcuucaaguacgggaacggcguguggaucggccggaccaaguccaccaacagucgcuccggguucgagaugaucugggaccccaacggcuggaccgagaccgacagcagcuuuuccgucaagcaggacaucguggccaucacggacuggagcggguacuccggcagcuucguccagcauccggagcugaccgggcucgacugcauccggcccugcuucuggguggagcugauccgcggccggcccaaggaguccaccaucuggaccagcggcuccagcaucuccuuuugcggggugaacagcgacacggucggcugguccuggcccgacggggccgagcugccguucaccaucgacaaguga

SEQ ID NO: 17444 - RNA, 1410 nt, Artificial Sequence; identical to SEQ ID NO: 17215
  derived and/or modified CDS sequence (AUadapt) from InfluenzaA__ABF47553__NA

SEQ ID NO: 17445 - RNA, 1413 nt, Artificial Sequence; identical to SEQ ID NO: 16798
  derived and/or modified CDS sequence (AUadapt) from InfluenzaA__ABF47564__NA

SEQ ID NO: 17446 - RNA, 1413 nt, Artificial Sequence
  derived and/or modified CDS sequence (AUadapt) from InfluenzaA__ABF47575__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcgugugcaaccagcgcaucaucaccuacgagaacuccaccugggucaaccacaccuacgugaacaucaacaacacgaacgugaucgcggggaaggacaagaccagcgucgcccuggccggcaacuccucgcugugcuccaucagcggcugggccaucuacaccaaggacaacuccauccggaucgggucgaagggcgacguguucgugauccgcgagccguucaucuccugcagccacuucgagugccggaccuucuuccucacgcagggggcccugcugaacgacaagcacuccaacggcaccgucaaggaccgcagccccuaccgggcgcucauguccugcccccugggggaggcccccucgccguacaacagcaaguucgaguccguggccuggagcgccuccgcgugccacgacggcaugggcuggcugaccaucgggaucucgggccccgacaacggggccguggccguccucaaguacaacggcaucaucaccgagacgaucaaguccuggaagaagcagauccugcgcacccaggagagcgagugcgugugcgugaacggcuccugcuucaccaucaugaccgacgggcccucgaacggcgccgccuccuacaagaucuucaagaucgagaaggggaaggucaccaagagcaucgagcugaacgcgcccaacuuccacuacgaggagugcuccugcuacccggacacgggcaccgugaugugcgugugccgggacaacuggcacgggagcaaccgccccugggucuccuucaaccagaaccucgacuaccagaucggcuacaucugcucgggcguguucggggacaacccccggcccaaggacggcgagggguccugcaacccggugaccgucgacggcgccaacggggugaagggcuucagcuacaaguacggcaacgggguguggaucggccgcacgaaguccaaccggcugcgcaagggguucgagaugaucugggaccccaacggcuggaccgacaccgacucggacuucuccgucaagcaggacgugguggccaucaccgacuggagcggguacagcggcuccuucguccagcaccccgagcugacgggccucgacugcauccggcccugcuucuggguggagcugguccgcgggcugccgaaggagaacaccaccaucuggaccucgggcuccagcaucuccuucugcggggugaacagcgacacggccaacugguccuggcccgacggcgccgagcuccccuucaccaucgacaaguga

SEQ ID NO: 17447 - RNA, 1413 nt, Artificial Sequence; identical to SEQ ID NO: 16798
  derived and/or modified CDS sequence (AUadapt) from InfluenzaA__ABF47586__NA

SEQ ID NO: 17448 - RNA, 1410 nt, Artificial Sequence; identical to SEQ ID NO: 16528
  derived and/or modified CDS sequence (AUadapt) from InfluenzaA__ABF47597__NA

SEQ ID NO: 17449 - RNA, 1413 nt, Artificial Sequence; identical to SEQ ID NO: 17370
  derived and/or modified CDS sequence (AUadapt) from InfluenzaA__ABF47608__NA

SEQ ID NO: 17450 - RNA, 1410 nt, Artificial Sequence
  derived and/or modified CDS sequence (AUadapt) from InfluenzaA__ABF47619__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggcagggcaccacgcugaacaaccgccacucgaacgacaccguccacgaccggaccccguaccgcacccuccugaugaacgagcugggcgugcccuuccaccucgggacgaagcaggucugcaucgccugguccagcuccucgugccacgacggcaaggcguggcugcacgugugcgugaccgggcacgacgagaacgccaccgccuccuucaucuacgacggccggcugguggacagcaucggguccuggucgaagaacauccuccgcacccaggaguccgagugcgucugcaucaacggcacgugcaccguggugaugaccgacggcucggccuccgggcgggcggacaccaagauccuguucaucgaggagggcaagaucguccacaucagcccccugucgggguccgcccagcacguggaggagugcucgugcuacccccgcuacccgggcgugcggugcgucugccgcgacaacuggaagggcuccaaccggcccaucguggacaucaacgugaaggacuacagcaucgucuccucguacgugugcuccgggcucgugggcgacacgccccgcaagaacgacagcgccuccucgucccacugccugaaccccaacaacgaggagggcgggcacggggucaagggcugggccuucgacgacggcaacgacguguggauggggcggaccaucucggagaagcugcgcuccggcuacgagaccuucaaggucaucgggggcuggagcaagccgaacuccaagcuccagaucaaccgccaggugaucguggaccgggggaaccggucgggcuacuccggcaucuucucggucgaggggaaguccugcaucaaccgcugcuucuacguggagcugauccggggccgcaagcaggagaccgaggugugguggacgagcaacucgaucgucguguucugcgggaccuccggcaccuacgggaccggcagcuggcccgacggcgccgacaucaaccugaugcccaucuga

SEQ ID NO: 17451 - RNA, 1413 nt, Artificial Sequence
  derived and/or modified CDS sequence (AUadapt) from InfluenzaA__ABF47630__NA
augaaccccaaccagaagaucaucaccaucggcucgaucuccaucgccaucgggaucaucucgcugauccuccagaucggcaacaucaucuccaucugggccagccacuccauccagaccgggucgcagaaccacacgggcaucugcaaccagcgcaucaucaccuacgagaacuccaccugggugaaccagaccuacgucaacaucaacaacacgaacgugguggcggggaaggacaagaccagcauggcccuggccggcaacuccucgcugugcccgauccggggcugggccaucuacaccaaggacaacuccauccgcaucgggagcaagggcgacgucuucgugauccgggagcccuucaucuccugcucgcaccucgagugccgcaccuucuuccugacgcagggggcccugcucaacgacaagcacuccaacggcaccgugaaggaccggagccccuaccgcgcgcugauguccugcccccugggggaggccccgucgcccuacaacucccgguucgagagcgucgccuggucggccuccgcgugccacgacggccucggcuggcugaccaucgggaucagcggccccgacaacggggccguggccgugcugaaguacaacggcaucaucaccgagacgaucaaguccuggaagaagcgcauccuccggacccaggagucggagugcgucugcaugaacggcuccugcuucaccaucaugaccgacgggcccagcaacggcgccgccuccuaccgcaucuucaagaucgagaaggggcgggugaccaagucgaucgagcuggacgcgccgaacuaccacuacgaggagugcuccugcuaccccgacacgggcaccgugaugugcgucugccgcgacaacuggcacgggagcaaccggcccuggguguccuucaaccagaaccuggacuaccagaucggcuacaucugcucgggcguguucggggacaacccccgcccgaaggacggcgagggguccugcaaccccgucaccguggacggcgccgacggggugaagggcuucagcuaccgguacggcaacggggucuggaucggccgcacgaaguccaaccggcuccgcaagggguucgagaugaucugggaccccaacggcuggaccgacaccgacucggacuucuccaugaagcaggacaucguggccaugaccgacuggagcggguacuccggcucguucgugcagcaccccgagcugacgggccuggacugcaugcggccgugcuucugggucgagcucgugcgcgggcugccccgggagaacaccaccaucuggaccagcggcuccucgaucuccuucugcggggugaacagcgacacggccaacugguccuggcccgacggcgccgagcugcccuucaccaucgacaaguga

SEQ ID NO: 17452 - RNA, 1413 nt, Artificial Sequence
  derived and/or modified CDS sequence (AUadapt) from InfluenzaA__ABF47652__NA
augaaccccaaccagaagaucaucaccaucggcucgaucuccaucgccaucgggaucaucucgcugauccuccagaucggcaacaucaucuccaucugggccagccacuccauccagaccgggucgcagaaccacacgggcaucugcaaccagcgcaucaucaccuacgagaacuccaccugggugaaccagaccuacgucaacaucaacaacacgaacgugguggcggggaaggacaagaccagcaugacccuggccggcaacuccucgcugugcccgauccggggcugggccaucuacaccaaggacaacuccauccgcaucgggagcaagggcgacgucuucgugauccgggagcccuucaucuccugcucgcaccucgagugccgcacguucuuccugacccagggggcccugcucaacgacaagcacuccaacggcaccgugaaggaccggagccccuaccgcgcccugauguccugcccccugggggaggcgccgucgcccuacaacucccgguucgagagcgucgccuggucggccuccgccugccacgacggccucggcuggcugaccaucgggaucagcggccccgacaacggggcgguggccgugcugaaguacaacggcaucaucacggagaccaucaaguccuggaagaagcgcauccuccggacccaggagucggagugcgucugcaugaacggcuccugcuucaccaucaugacggacgggcccagcaacggcgccgccuccuaccgcaucuucaagaucgagaaggggcgggugaccaagucgaucgagcuggacgccccgaacuaccacuacgaggagugcuccugcuaccccaacaccggcaccgugaugugcgucugccgcgacaacuggcacgggagcaaccggcccuggguguccuucaaccagaaccuggacuaccagaucggcuacaucugcucgggcguguucggggacaacccccgcccgaaggacggcgagggguccugcaaccccgucacgguggacggcgcggacggggugaagggcuucagcuaccgguacggcaacggggucuggaucggccgcaccaaguccaaccggcuccgcaagggguucgagaugaucugggaccccaacggcuggaccgacaccgacucggacuucuccaugaagcaggacaucguggccaugacggacuggagcggguacuccggcucguucgugcagcaccccgagcugaccggccuggacugcaugcggccgugcuucugggucgagcucgugcgcgggcugccccgggagaacaccaccaucuggacgagcggcuccucgaucuccuucugcggggugaacagcgacaccgccaacugguccuggcccgacggcgccgagcugcccuucaccaucgacaaguga

SEQ ID NO: 17453 - RNA, 1413 nt, Artificial Sequence; identical to SEQ ID NO: 17370
  derived and/or modified CDS sequence (AUadapt) from InfluenzaA__ABF47663__NA

SEQ ID NO: 17454 - RNA, 1413 nt, Artificial Sequence
  derived and/or modified CDS sequence (AUadapt) from InfluenzaA__ABF47674__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcgugugcauccagcgcaucaucaccuacgagaacuccaccugggucaaccacaccuacgugaacaucaacaacacgaacgugaucgcggggaaggacaagaccagcgucacccuggccggcaacuccucgcugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcgguggccguccugaaguacaacggcaucaucacggagaccaucaaguccuggaagaagcagauccugcgcacccaggagagcgagugcgugugcgugaacggcuccugcuucaccaucaugacggacgggcccucgaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgggacaacuggcacgggagcaaccgccccugggucuccuucaaccagaaccuggacuaccagaucggcuacaucugcucgggcguguucggggacaacccccggcccaaggacggcgagggguccugcaacccggugacggucgacggcgcgaacggggugaagggcuucagcuacaaguacggcaacgggguguggaucggccgcaccaaguccaaccggcugcgcaagggguucgagaugaucugggaccccaacggcuggaccgacaccgacucggacuucuccgucaagcaggacgugguggccaucacggacuggagcggguacagcggcuccuucguccagcaccccgagcucaccggccuggacugcauccggcccugcuucuggguggagcugguccgcgggcucccgaaggagaacaccaccaucuggacgucgggcuccagcaucuccuucugcggggugaacagcgacaccgccaacugguccuggcccgacggcgccgagcugcccuucaccaucgacaaguga

SEQ ID NO: 17455 - RNA, 1413 nt, Artificial Sequence; identical to SEQ ID NO: 17353
  derived and/or modified CDS sequence (AUadapt) from InfluenzaA__ABF47696__NA

SEQ ID NO: 17456 - RNA, 1413 nt, Artificial Sequence
  derived and/or modified CDS sequence (AUadapt) from InfluenzaA__ABF47707__NA
augaaccccaaccagaagaucaucaccaucggcucgaucugcauggccaucgggaucaucucccugauccuccagaucggcaacaucaucagcaucugggugucccacucgauccagaccgggucccagaaccacacgggcaucugcaaccagcgcaucaucaccuacgagaacagcaccugggucaaccagaccuacgugaacaucuccaacacgaacguggucgccgggaagggcaccaccucgaugacccuggcgggcaacuccagccugugcccgauccgggggugggccaucuacuccaaggacaacagcauccgcaucggcuccaagggggacguguucgugauccgggagcccuucaucucgugcucccaccucgagugccgcacguucuuccugacccagggcgcccugcucaacgacaagcacagcaacgggaccgucaaggaccggucccccuaccgcgcccugaugucgugccccaucggcgaggccccgucccccuacaacagccgguucgagagcguggcgugguccgccucggccugccacgacggcaugggguggcugaccaucggcaucuccgggcccgacgacggcgccguggcgguccucaaguacaacggcaucaucacggagaccaucaagagcuggcgcaagcagauccugcggacccaggaguccgagugcgugugcgugaacgggucgugcuucaccaucaugacggacggccccuccgacgggccggccagcuaccgcaucuucaagaucgagaagggcaagaucaccaaguccaucgagcuggacgcccccaacagccacuacgaggagugcuccugcuaccccgacaccgggaccgucaugugcgugugccgggacaacuggcacggcucgaaccgccccuggguguccuucaaccagaaccucgacuaccagaucggcuacaucugcagcggggucuucggcgacaacccgcggcccaaggacgggaagggcuccugcgaccccgugaacguggacggggccgacggcgucaagggcuucucguaccgcuacgggaacggcguguggaucgggcggacgaaguccaacagcucccgcaagggcuucgagaugaucugggaccccaacggguggaccgacaccgacagcaacuuccuggugaagcaggacgucguggccaugaccgacuggucgggcuacuccggcagcuucgugcagcacccggagcugacggggcucgacugcaugcggcccugcuucugggucgagcugauccgcggccggccccgcgagaagaccaccaucuggaccuccgggucguccaucagcuucugcggcgugaacuccgacacggucaacuggagcuggcccgacggcgcggagcugccguucaccaucgacaaguga

SEQ ID NO: 17457 - RNA, 1413 nt, Artificial Sequence; identical to SEQ ID NO: 17353
  derived and/or modified CDS sequence (AUadapt) from InfluenzaA__ABF47718__NA

SEQ ID NO: 17458 - RNA, 1413 nt, Artificial Sequence; identical to SEQ ID NO: 17353
  derived and/or modified CDS sequence (AUadapt) from InfluenzaA__ABF47729__NA

SEQ ID NO: 17459 - RNA, 1413 nt, Artificial Sequence; identical to SEQ ID NO: 17353
  derived and/or modified CDS sequence (AUadapt) from InfluenzaA__ABF47740__NA

SEQ ID NO: 17460 - RNA, 1413 nt, Artificial Sequence
  derived and/or modified CDS sequence (AUadapt) from InfluenzaA__ABF47751__NA
augaaccccaaccagaagaucaucaccaucggcucgaucugcauggccaucgggaucaucucccugauccuccagaucggcaacaucaucagcaucugggugucccacucgauccagaccgggucccagaaccacacgggcaucugcaaccagcgcaucaucaccuacgagaacagcaccugggucaaccagaccuacgugaacaucaacaacacgaacguggucgccgggaaggacaccaccuccgugacccuggcgggcaacucgucccugugcccgauccggggcugggccaucuacagcaaggacaacuccauccgcaucgggucgaagggcgacguguucgucauccgggagcccuucaucuccugcagccaccucgagugccgcacguucuuccugacccagggggcccugcucaacgacaagcacuccaacggcaccgugaaggaccggucgcccuaccgcgcccugauguccugccccaucggggaggccccgagccccuacaacucccgguucgagucgguggcguggagcgccuccgccugccacgacggcaugggcuggcugaccaucgggaucagcggccccgacgacggggccgucgcggugcucaaguacaacggcaucaucacggagaccaucaaguccuggcgcaagcggauccugcgcacccaggagucggagugcgugugcgucaacggcuccugcuucaccaucaugacggacgggcccagcaacggcccggccuccuaccggaucuucaagaucgagaaggggaagaucaccaagucgaucgagcuggacgcccccaacucccacuacgaggagugcagcugcuaccccgacaccggcaccgugaugugcgugugccgcgacaacuggcacggguccaaccggcccugggucucguucaaccagaaccucgacuaccagaucggcuacaucugcuccggcguguucggggacaacccgcgccccaaggacggcaaggggagcugcgaccccgugacggucgacggcgccgacggggugaagggcuucuccuaccgguacggcaacgggguguggaucggccgcaccaagucgaacuccagccggaagggguucgagaugaucugggaccccaacggcuggaccgacaccgacuccaacuuccuggucaagcaggacgugguggccaugacggacuggucgggguacagcggcuccuucguccagcacccggagcugaccggccucgacugcaugcgccccugcuucuggguggagcugauccgggggcgcccccgggagaagaccaccaucuggacgucgggcuccagcaucuccuucugcggggucaacagcgacaccgcgaacugguccuggcccgacggcgccgagcugccguucaccaucgacaaguga

SEQ ID NO: 17461 - RNA, 1413 nt, Artificial Sequence
  derived and/or modified CDS sequence (AUadapt) from InfluenzaA__ABF47773__NA
augaaccccaaccagaagaucaucaccaucggcucgaucugcaugaccaucgggaucaucucccugauccuccagaucggcaacaucaucagcaucugggugucccacucgauccagacggggucccagaaccacaccggcaucugcaaccagcgcaucaucaccuacgagaacagcaccugggucaaccagacguacgugaacaucaacaacaccaacguggucgccgggaaggacaccaccuccgugacgcuggccggcaacucgucccugugcccgauccggggcugggcgaucuacagcaaggacaacuccauccgcaucgggucgaagggcgacguguucgucauccgggagcccuucaucuccugcagccaccucgagugccgcaccuucuuccugacccagggggcccugcucaacgacaagcacuccaacggcaccgugaaggaccggucgcccuaccgcgcccugauguccugccccaucggggaggccccgagccccuacaacucccgguucgagucgguggccuggagcgcguccgccugccacgacggcaugggcuggcugacgaucgggaucagcggccccgacgacggggccgucgccgugcucaaguacaacggcaucaucaccgagaccaucaaguccuggcgcaagcggauccugcgcacccaggagucggagugcgugugcgucaacggcuccugcuucacgaucaugaccgacgggcccagcaacggcccggcguccuaccggaucuucaagaucgagaaggggaagaucaccaagucgaucgagcuggacgcccccaacucccacuacgaggagugcagcugcuaccccgacaccggcacggugaugugcgugugccgcgacaacuggcacggguccaaccggcccugggucucguucaaccagaaccucgacuaccagaucggcuacaucugcuccggcguguucggggacaacccgcgccccaaggacggcaaggggagcugcgaccccgugaccgucgacggcgccgacggggugaagggcuucuccuaccgguacggcaacgggguguggaucggccgcaccaagucgaacuccagccggaagggguucgagaugaucugggaccccaacggcuggaccgacacggacuccaacuuccuggucaagcaggacgugguggccaugaccgacuggucgggguacagcggcuccuucguccagcacccggagcugaccggccucgacugcaugcgccccugcuucuggguggagcugauccgggggcgcccccgggagaagaccacgaucuggaccucgggcuccagcaucuccuucugcggggucaacagcgacaccgccaacugguccuggcccgacggcgcggagcugccguucaccaucgacaaguga

SEQ ID NO: 17462 - RNA, 1413 nt, Artificial Sequence; identical to SEQ ID NO: 17461
  derived and/or modified CDS sequence (AUadapt) from InfluenzaA__ABF47784__NA

SEQ ID NO: 17463 - RNA, 1413 nt, Artificial Sequence; identical to SEQ ID NO: 17461
  derived and/or modified CDS sequence (AUadapt) from InfluenzaA__ABF47795__NA

SEQ ID NO: 17464 - RNA, 1413 nt, Artificial Sequence; identical to SEQ ID NO: 17461
  derived and/or modified CDS sequence (AUadapt) from InfluenzaA__ABF47806__NA

SEQ ID NO: 17465 - RNA, 1413 nt, Artificial Sequence; identical to SEQ ID NO: 17461
  derived and/or modified CDS sequence (AUadapt) from InfluenzaA__ABF47817__NA

SEQ ID NO: 17466 - RNA, 1413 nt, Artificial Sequence; identical to SEQ ID NO: 17461
  derived and/or modified CDS sequence (AUadapt) from InfluenzaA__ABF47839__NA

SEQ ID NO: 17467 - RNA, 1413 nt, Artificial Sequence; identical to SEQ ID NO: 17461
  derived and/or modified CDS sequence (AUadapt) from InfluenzaA__ABF47850__NA

SEQ ID NO: 17468 - RNA, 1413 nt, Artificial Sequence; identical to SEQ ID NO: 17230
  derived and/or modified CDS sequence (AUadapt) from InfluenzaA__ABF47872__NA

SEQ ID NO: 17469 - RNA, 1413 nt, Artificial Sequence; identical to SEQ ID NO: 17230
  derived and/or modified CDS sequence (AUadapt) from InfluenzaA__ABF47883__NA

SEQ ID NO: 17470 - RNA, 1413 nt, Artificial Sequence; identical to SEQ ID NO: 17230
  derived and/or modified CDS sequence (AUadapt) from InfluenzaA__ABF47894__NA

SEQ ID NO: 17471 - RNA, 1410 nt, Artificial Sequence; identical to SEQ ID NO: 17246
  derived and/or modified CDS sequence (AUadapt) from InfluenzaA__ABF47905__NA

SEQ ID NO: 17472 - RNA, 1362 nt, Artificial Sequence
  derived and/or modified CDS sequence (AUadapt) from InfluenzaA__ABF47958__NA
augaaucccaaccagaagaucaucaccaucggcucgaucugcaugguggucgggaucaucucccugauccuccagaucggcaacaucaucagcaucuggaucucccacagcauccagaccgggaaccagaaucacacgggcaucugcaaccagggguccaucaccuacaaggugguggccggccaggacagcaccuccgucauccugaccggcaacagcucccuguguccgauccgcgggugggccauccacagcaaggacaacggcauccggaucggguccaagggcgacguguucgugauccgcgagcccuucaucagcuguucccaccucgagugccggacguucuuccugacccagggggcgcugcucaacgacaagcacagccgcggcaccuuuaaggaccggucccccuaccgcgcccugaugagcugccccgucggcgaggccccgucccccuacaacagccgguucgaguccguggccuggagugccagcgcgugccacgacgggaugggcuggcugaccaucgggaucuccggccccgacgacggcgccguggccguccucaaguacaacgggaucaucacggagaccaucaagaguuggcgcaagaacauccugcggacccaggaguccgagugcacgugcgugaacggcagcugcuucaccaucaugaccgacgggcccuccgauggccuggccagcuacaagaucuucaagaucgagaaggggaaggugaccaaguccaucgagcucaacgcgccgaacagccacuacgaggaguguuccugcuaccccgacaccggcaaggucaugugcgugugccgcgacaacuggcacggcaguaaccggcccuggguguccuucgaccagaaccuggacuacaagaucggguacaucugcaguggcgucuucggggacaacccccgcccgaaggacggcacgggguccugcggccccgugagcgccgacggcgccaacggggugaagggcuuuuccuacaaguacgggaacggcgucuggaucgggcggaccaagagcgacuccagccgccacggcuucgagaugaucugggaucccaacggcuggaccgagaccgacucccgguucagcaugcgccaggacgugguggccaugacggaccggagcggguacuccggcaguuucguccagcaccccgagcugaccgggcucgacugcaugcgcccgugcuucuggguggagcugauccggggccugcccgaggaggacgccaucuggaccuccggcagcaucaucuccuuuugcggggugaacagcgacaccgucgacugguccuggcccgacggcgcggagcuccccuucacgaucgacaaguga

SEQ ID NO: 17473 - RNA, 1350 nt, Artificial Sequence
  derived and/or modified CDS sequence (AUadapt) from InfluenzaA__ABF56651__NA
augaaucccaaccagaagaucaucaccaucggcagcaucugcauggugaccgggaucgucucccugaugcuccaggugggcaacaugaucagcaucugggugucccacaguauccacacggggucccagcaccaggccgagccgaucagcaacaccaacuuccugaccgagaaggccgucgcguccgugaagcuggccggcaauagcucccucugccccaucaacgggugggccguguacagcaaggacaauuccauccgcaucggcagcaagggcgacgucuucgugauccgggagcccuucaucuccugcagccaucuggagugccgcaccuucuuccugacgcagggggcccuccugaacgacaagcacuccaacggcaccgugaaggaucggagcccccaccgcacccugauguccugcccggucggggaggcccccagccccuacaacucccgguuugagagcguggcguggagcgccuccgccugccacgacggcaccagcuggcucacgaucgggaucuccggccccgauaacggcgccguggcgguccugaaguacaacgggaucaucaccgacaccaucaagagcuggcgcaacaauauccugcggacccaggaguccgagugcgccugcgugaacggcagcugcuucacggugaugaccgaugggccguccaacggccaggccagccacaagaucuucaagauggagaagggcaaggucgugaaguccguggagcucgacgcccccaacuaccauuacgaggagugcagcugcuaccccgacgccggggagaucacgugugucugccgcgacaacuggcacggcuccaaccggcccugggugagcuuuaaccagaaccuggaguaccagaucggguacaucugcuccggcguguucggggauaacccgcgccccaacgacggcaccggcagcugcgggcccgucuccagcaauggcgcguacggggugaagggcuucuccuucaaguacgggaacggcguguggaucggccggaccaagagcaccaacucccgcaguggguucgagaugaucugggaccccaacggcuggaccgagaccgacagcuccuucagugucaagcaggacaucguggccaucacggacugguccggguacagcggcuccuucguccagcacccggagcugaccgggcucgauugcauccggcccugcuucuggguggagcugauccgcggccggcccaaggagagcaccaucuggaccuccggcagcuccaucagcuuuugcggggugaacuccgacacggucggcuggagcuggcccgacggggccgagcugccguucaccaucgacaaguga

SEQ ID NO: 17474 - RNA, 1410 nt, Artificial Sequence; identical to SEQ ID NO: 17229
  derived and/or modified CDS sequence (AUadapt) from InfluenzaA__ABF82654__NA

SEQ ID NO: 17475 - RNA, 1413 nt, Artificial Sequence; identical to SEQ ID NO: 16798
  derived and/or modified CDS sequence (AUadapt) from InfluenzaA__ABF82665__NA

SEQ ID NO: 17476 - RNA, 1413 nt, Artificial Sequence; identical to SEQ ID NO: 16798
  derived and/or modified CDS sequence (AUadapt) from InfluenzaA__ABF82676__NA

SEQ ID NO: 17477 - RNA, 1413 nt, Artificial Sequence
  derived and/or modified CDS sequence (AUadapt) from InfluenzaA__ABF82687__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcgugugcaaccagcgcaucaucaccuacgagaacuccaccugggucaaccacaccuacgugaacaucaacaacacgaacgugaucgcggggaaggacaagaccucggucacccuggccggcaacuccagccugugcuccaucucgggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcgguggccguccugaaguacaacggcaucaucacggagaccaucaaguccuggaagaagcagauccugcgcacccaggagagcgagugcgugugcgugaacggcuccugcuucaccaucaugacggacgggcccucgaacggcgccgccuccuacaagaucuucaagaucgagaaggggaagaccaccaagagcaucgagcucaacgcccccaacuuccacuacgaggagugcuccugcuacccggacaccggcacggucaugugcgugugccgggacaacuggcacgggucgaaccgccccuggguguccuucaaccagaaccuggacuaccagaucggcuacaucugcagcggcgucuucggggacaacccccggcccaaggacggcgagggguccugcaacccggugaccguggacggcgcgaacggggucaagggcuucucguacaaguacggcaacgggguguggaucggccgcaccaaguccaaccggcugcgcaagggguucgagaugaucugggaccccaacggcuggaccgacacggacagcgacuucuccgugaagcaggacgucguggccaucaccgacuggucgggguacagcggcuccuucgugcagcaccccgagcucaccggccugaacugcauccggcccugcuucugggucgagcuggugcgcgggcucccgaaggagaacaccacgaucuggaccucgggcuccagcaucuccuucugcggggucaacagcgacaccgccaacugguccuggcccgacggcgccgagcugcccuucaccaucgacaaguga

SEQ ID NO: 17478 - RNA, 1410 nt, Artificial Sequence
  derived and/or modified CDS sequence (AUadapt) from InfluenzaA__ABF82698__NA
augaaccccaaccagaagaucaucaccaucggcucggugucccugaccaucacgaccaucugcuuccucaugcagaucgccauccuggucaucaccgugacccugcacuucaagcagugcgagugcaacucgccgcccaacaaccaggugaugcucugcgagcccacgaucaucgagcgcaacaucaccgagaucgucuaccugaccaacaccacgaucgagaaggagaucugccccaagcuggccgaguaccggaacugguccaagccgcagugcaagaucaccggguucgcgcccuucagcaaggacaacuccauccgccucucggccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccucguccagcugccacgacggcaaggccuggcugcacgugugcgugaccgggcacaacgagaacgcgaccgccuccuucaucuacgacggccggcugguggacucgaucggguccuggagcaagaacauccuccgcacccaggaguccgagugcgucugcaucaacggcacgugcaccguggugaugaccgacggcucggccuccgggcgggccgacaccaagauccuguucaucgaggagggcaagaucguccacaucagcccccugucgggguccgcgcagcacguggaggagugcucgugcuacccccgcuacccgggcgugcggugcgucugccgcgacaacuggaagggcuccaaccggcccaucguggacaucaacgugaaggacuacagcaucgucuccucguacgugugcuccgggcucgugggcgacacgccccgcaagaacgacagcuccucguccagcuacugccuggaccccaacaacgaggagggcgggcacggggucaagggcugggccuucgacgacggcaacgacguguggauggggcggaccaucuccgagaagcugcgcucgggcuacgagaccuucaaggucaucgggggcugguccaagccgaacagcaagcuccagaucaaccgccaggugaucguggacaaggggaaccgguccggcuacucgggcaucuucuccgucgagggcaagagcugcaccaaccggugcuucuacguggagcugauccgcgggcggaagcaggagacggaggugugguggaccucgaacuccaucgucguguucugcgggaccagcggcaccuacgggacgggcuccuggcccgacggcgccgacaucaaccugaugcccaucuga

SEQ ID NO: 17479 - RNA, 1410 nt, Artificial Sequence; identical to SEQ ID NO: 16528
  derived and/or modified CDS sequence (AUadapt) from InfluenzaA__ABF82709__NA

SEQ ID NO: 17480 - RNA, 1413 nt, Artificial Sequence; identical to SEQ ID NO: 16817
  derived and/or modified CDS sequence (AUadapt) from InfluenzaA__ABF82822__NA

SEQ ID NO: 17481 - RNA, 1413 nt, Artificial Sequence; identical to SEQ ID NO: 16798
  derived and/or modified CDS sequence (AUadapt) from InfluenzaA__ABF82833__NA

SEQ ID NO: 17482 - RNA, 1413 nt, Artificial Sequence; identical to SEQ ID NO: 16798
  derived and/or modified CDS sequence (AUadapt) from InfluenzaA__ABF82844__NA

SEQ ID NO: 17483 - RNA, 1413 nt, Artificial Sequence
  derived and/or modified CDS sequence (AUadapt) from InfluenzaA__ABF82855__NA
augaaccccaaccagaagaucaucaccaucggcucgaucuccaucgccaucgggaucaucagccugaugcuccagaucggcaacaucaucuccaucugggccucgcacuccauccagaucgggagccagaaccacaccggcgugugcaaccagcgcaucaucacguacgagaacuccaccugggucaaccacaccuacgugaacaucaacaacaccaacgugaucgcggggaaggacaagacgagcgucacccuggccggcaacuccucgcugugcuccaucagcggcugggccaucuacaccaaggacaacuccauccggaucgggucgaagggcgacguguucgugauccgcgagccguucaucuccugcagccaccucgagugccggaccuucuuccugacgcagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcgguggccguccugaaguacaacggcaucaucaccgagacgaucaaguccuggaagaagcagauccugcgcacccaggagagcgagugcgugugcgugaacggcuccugcuucaccaucaugaccgacgggcccucgaacggcgccgccuccuacaagaucuucaagaucgagaaggggaaggucaccaagagcaucgagcucaacgcccccaacuuccacuacgaggagugcuccugcuacccggacacgggcaccgugaugugcgugugccgggacaacuggcacgggagcaaccgccccugggucuccuucaaccagaaccuggacuaccagaucggcuacaucugcucgggcguguucggggacaacccccggcccaaggacggcgagggguccugcaacccggugaccgucgacggcgcgaacggggugaagggcuucagcuacaaguacggcaacgggguguggaucggccgcacgaaguccaaccggcugcgcaagggguucgagaugaucugggaccccaacggcuggaccgacaccgacucggacuucuccgucaagcaggacgugguggccaucaccgacuggagcggguacagcggcuccuucguccagcaccccgagcucacgggccuggacugcauccggcccugcuucuggguggagcugguccgcgggcucccgaaggagaacaccaccaucuggaccucgggcuccagcaucuccuucugcggggugaacagcgacacggccaacugguccuggcccgacggcgccgagcugcccuucaccaucgacaaguga

SEQ ID NO: 17484 - RNA, 1413 nt, Artificial Sequence; identical to SEQ ID NO: 16798
  derived and/or modified CDS sequence (AUadapt) from InfluenzaA__ABF82866__NA

SEQ ID NO: 17485 - RNA, 1413 nt, Artificial Sequence; identical to SEQ ID NO: 17332
  derived and/or modified CDS sequence (AUadapt) from InfluenzaA__ABF82888__NA

SEQ ID NO: 17486 - RNA, 1413 nt, Artificial Sequence; identical to SEQ ID NO: 16798
  derived and/or modified CDS sequence (AUadapt) from InfluenzaA__ABF82910__NA

SEQ ID NO: 17487 - RNA, 1413 nt, Artificial Sequence; identical to SEQ ID NO: 16798
  derived and/or modified CDS sequence (AUadapt) from InfluenzaA__ABF82921__NA

SEQ ID NO: 17488 - RNA, 1413 nt, Artificial Sequence; identical to SEQ ID NO: 16798
  derived and/or modified CDS sequence (AUadapt) from InfluenzaA__ABF82932__NA

SEQ ID NO: 17489 - RNA, 1413 nt, Artificial Sequence; identical to SEQ ID NO: 16798
  derived and/or modified CDS sequence (AUadapt) from InfluenzaA__ABF82943__NA

SEQ ID NO: 17490 - RNA, 1350 nt, Artificial Sequence
  derived and/or modified CDS sequence (AUadapt) from InfluenzaA__ABG20474__NA
augaaucccaaccaaaagaucaucaccaucggcagcaucugcauggugaucgggaucgucucccugaugcuccagaucggcaacaugaucagcaucugggugucccacagcauccagaccgggaaccagcgccaggccgagccgaucuccaauacgaaguuccugaccgagaaggccguggcgagcgucacccuggccggcaacuccagccucugccccaucuccgggugggccguguacagcaaggacaauuccauccggaucggcagccgcggcgacguguucgucauccgggagcccuucaucuccugcagccaccuggaaugccgcaccuuuuuccugacgcagggggcccuccugaacgacaagcacuccaacggcaccgugaaggaccggagccccuaccgcacccugauguccuguccggugggggaggcccccagccccuacaacucccgguucgagagcgucgcguggagcgccuccgccugccacgauggcaccagcuggcucacgaucgggaucuccggccccgacaacggcgccguggcggugcugaaguacaacgggaucaucaccgacaccaucaagagcuggcgcaacaauguccugcggacccaggaguccgagugcgccugcgugaacggcagcugcuucacggugaugaccgacgggccguccaacggccaggccaguuacaagaucuucaaaauggagaagggcaaggucgugaaguccguggagcucgacgcccccaacuaccacuacgaggagugcaguugcuaccccgacgccggggagaucacgugcgucugccgcgacaacuggcacggcuccaaucggcccugggugagcuucaaccagaaccuggaguaccagaucggguacaucugcuccggcguguucggggauaacccgcgccccaacgacggcaccggcagcugcgggcccgucucccccaacggcgcguacggggugaagggcuucaguuucaaauacgggaacggcguguggaucggccggaccaaguccaccaacagccgcuccggguucgagaugaucugggacccgaacggcuggaccgggaccgauagcaacuucagcgucaagcaggacaucguggccaucacggacugguccggcuacagcggguccuuuguccagcaccccgagcugaccggccucgacugcauccggcccugcuucuggguggagcugauccgcggccggcccaaggagagcaccaucuggaccuccgggagcuccaucuucuuuugcggcgugaacagcgacacggucuccuggagcuggccggacggggccgagcugcccuucaccaucgacaaguga

SEQ ID NO: 17491 - RNA, 1410 nt, Artificial Sequence; identical to SEQ ID NO: 16528
  derived and/or modified CDS sequence (AUadapt) from InfluenzaA__ABG26761__NA

SEQ ID NO: 17492 - RNA, 1410 nt, Artificial Sequence
  derived and/or modified CDS sequence (AUadapt) from InfluenzaA__ABG26772__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccgacaagugcuaccaguucgcccugggccaggggaccacgcugaacaaccgccacagcaacgacaccguccacgaccggaccccguaccgcacccuccugaugaacgagcugggcgugcccuuccaccucggcacgaagcaggucugcaucgccugguccucguccucgugccacgacgggaaggcguggcugcacgugugcgugaccggccacgacgagaacgccaccgccuccuucaucuacgacgggcggcugguggacagcaucggcuccuggucgaagaagauccuccgcacccaggaguccgagugcgucugcaucaacgggacgugcaccguggugaugaccgacggcagcgccuccggccgggcggacaccaagauccuguucaucaaggaggggaagaucguccacaucucgccccugagcggcuccgcccagcacguggaggagugcucgugcuacccccgcuacccgggggugcggugcgucugccgcgacaacuggaagggcuccaaccggcccaucguggacaucaacgugaaggacuacucgaucgucuccagcuacgugugcuccggccucgugggggacacgccccgcaagaacgacucguccagcuccucgcacugccugaaccccaacaacgaggagggcgggcacggcgucaaggggugggccuucgacgacggcaacgacguguggaugggccggaccaucuccgagaagcugcgcucgggguacgagaccuucaaggucaucgagggcugguccaagccgaacagcaagcuccagaucaaccgccaggugaucguggaccgggggaaccgguccggcuacucggggaucuucuccgucgagggcaagagcugcaucaaccgcugcuucuacguggagcugauccggggccgcaagcaggagaccgaggugugguggacgucgaacuccaucgucguguucugcgggaccagcggcaccuacgggaccggcuccuggcccgacggggccgacaucaaccugaugcccaucuga

SEQ ID NO: 17493 - RNA, 1413 nt, Artificial Sequence
  derived and/or modified CDS sequence (AUadapt) from InfluenzaA__ABG26783__NA
augaaccccaaccagaagaucaucaccaucggcucgaucuccaucgccaucgggaucaucucgcugauccuccagaucggcaacaucaucuccaucugggccagccacuccauccagaccgggucgcagaaccacacgggcaucugcaaccagcgcaucaucaccuacgagaacuccaccugggugaaccagaccuacgucaacaucaacaacacgaacgugguggcggggaaggacaagaccagcaugacccuggccggcaacuccucgcugugcccgauccggggcugggccaucuacaccaaggacaacuccauccgcaucgggagcaagggcgacgucuucgugauccgggagcccuucaucuccugcucgcaccucgagugccgcacguucuuccugacccagggggcccugcucaacgacaagcacuccaacggcaccgugaaggaccggagccccuaccgcgcccugauguccugcccccugggggaggcgccgucgcccuacaacucccgguucgagagcgucgccuggucggccuccgccugccacgacggccucggcuggcugaccaucgggaucagcggccccgacaacggggcgguggccgugcugaaguacaacggcaucaucacggagaccaucaaguccuggaagaagcgcauccuccggacccaggagucggagugcgucugcaugaacggcuccugcuucaccaucaugacggacgggcccagcaacggcgccgccuccuaccgcaucuucaagaucgagaaggggcgggugaccaagucgaucgagcuggacgccccgaacuaccacuacgaggagugcuccugcuaccccaacaccggcaccgugaugugcgucugccgcgacaacuggcacgggagcaaccggcccuggguguccuucaaccagaaccuggacuaccagaucggcuacaucugcucgggcguguucggggacaacccccgcccgaaggacggcgagggguccugcaaccccgucacgguggacggcgcggacggggugaagggcuucagcuaccgguacggcaacggggucuggaucggccgcaccaaguccaaccggcuccgcaagggguucgagaugaucugggaccccaacggcuggaccgacaccgacucggacuucuccaugaagcaggacaucguggccaugacggacuggagcggguacuccggcucguucgugcagcaccccgagcugaccggccuggacugcauccggccgugcuucugggucgagcucgugcgcgggcugccccgggagaacaccaccaucuggacgagcggcuccucgaucuccuucugcggggugaacagcgacaccgccaacugguccuggcccgacggcgccgagcugcccuucaccaucgacaaguga

SEQ ID NO: 17494 - RNA, 1413 nt, Artificial Sequence; identical to SEQ ID NO: 17370
  derived and/or modified CDS sequence (AUadapt) from InfluenzaA__ABG26794__NA

SEQ ID NO: 17495 - RNA, 1410 nt, Artificial Sequence
  derived and/or modified CDS sequence (AUadapt) from InfluenzaA__ABG26805__NA
augaaccccaaccagaagaucaucaccaucggcucggugucccugaccaucgccacgaucugcuuccucacccagaucgccauccuggucaccaccgugacgcugcacuucaagcaguacgagugcucguccccgcccaacaaccaggugaugcccugcgagcccaucaucaucgagcgcaacaucaccgagaucgucuaccucaccaacaccacgaucgagaaggagaucugcccgaagcugguggaguaccggaacuggagcaagccccagugcaagaucaccggguucgcgcccuucuccaaggacaacucgauccgccuguccgccggcggggacaucugggugacccgggagcccuacgucagcugcgacccgggcaagugcuaccaguucgcccucgggcagggcaccacgcugaacaacaagcacuccaacgacaccauccacgaccgcacccccuaccggacccugcucaugaacgagcugggcgugcccuuccaccuggggacgaagcaggucugcaucgccuggucguccucguccugccacgacggcaaggccuggcuccacgugugcaucaccgggcacgacaagaacgcgaccgccagcuucaucuacgacggccgccugguggacuccaucgggucgugguccaagaacauccugcggacccaggagagcgagugcgugugcaucaacggcacgugcaccgucgugaugaccgacggcuccgccucggagcgcgccgacaccaagauccucuucaucgaggaggggaagaucgugcacaucagcccccuguccggcucggcgcagcacgucgaggagugcuccugcuacccgcgguaccccggggugcgcugcgugugccgggacaacuggaagggcucgaaccgccccaucgucgacaucaacgugaaggacuacuccaucgugagcuccuacgucugcucgggccuggugggggacacgccccggaagaacgaccgcuccagcuccucguacugccggaacccgaacaacgagaagggcaaccacggggugaagggcugggccuucgacgacgggaacgacgucuggaugggccgcaccaucggcgaggagcuccgguccggguacgagaccuucaaggugaucggcggguggucgacccccaacuccaagcugcagaucaaccgccagaucaucgucgacagcggcaaccgguccggguacucgggcaucuucuccguggagggcaagagcugcaucaaccgcugcuucuacguggagcugauccgggggcgcgagcaggagacgcgcgucugguggaccucgaacuccaucgugguguucugcggcaccagcgggaccuacggcacgggguccuggcccgacggcgccgacaucaaccucaugcccaucuga

SEQ ID NO: 17496 - RNA, 1413 nt, Artificial Sequence; identical to SEQ ID NO: 17353
  derived and/or modified CDS sequence (AUadapt) from InfluenzaA__ABG26816__NA

SEQ ID NO: 17497 - RNA, 1413 nt, Artificial Sequence; identical to SEQ ID NO: 17461
  derived and/or modified CDS sequence (AUadapt) from InfluenzaA__ABG26827__NA

SEQ ID NO: 17498 - RNA, 1413 nt, Artificial Sequence; identical to SEQ ID NO: 17461
  derived and/or modified CDS sequence (AUadapt) from InfluenzaA__ABG26838__NA

SEQ ID NO: 17499 - RNA, 1410 nt, Artificial Sequence
  derived and/or modified CDS sequence (AUadapt) from InfluenzaA__ABG26860__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccucguccagcugccacgacggcaaggcguggcugcacgugugcgugaccgggcacgacgagaacgccaccgccuccuucaucuacgacggccggcugguggacucgaucggguccuggucgaagaacauccuccgcacccaggaguccgagugcgucugcaucaacggcacgugcaccguggugaugaccgacggcagcgccuccgaccgggcggacaccaagauccuguucaucgaggaggggaagaucguccacaucucgccccugagcggcuccgcccagcacguggaggagugcucgugcuacccccgcuacccgggggugcggugcgucugccgcgacaacuggaagggcuccaaccggcccaucaucgacaucaacgugaaggacuacagcaucguguccucguacgucugcuccggccucgugggggacacgccccgcaagaacgacagcuccucguccucguacugcuggaaccccaacaacgagaagggcgggcacggcgugaaggggugggccuucgacgacggcaacgacgucuggaugggccggaccaucuccgaggagagccgcuccggguacgagaccuucaaggugaucggcggguggucgaagccgaacuccaagcugcagaucaaccggcaggucaucguggaccgcggcaaccggagcggguacuccggcaucuucucgguggagggcaagagcugcaucaaccgcugcuucuacgucgagcugauccgggggcgcaagcaggagaccgaggugugguggacguccaacucgaucguggucuucugcggcaccuccgggaccuacggcaccgggagcuggcccgacggcgccgacaucaaccucaugcccaucuga

SEQ ID NO: 17500 - RNA, 1410 nt, Artificial Sequence
  derived and/or modified CDS sequence (AUadapt) from InfluenzaA__ABG26871__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccuacaaccagaucaugcucugcgagcccacgaucaucgagcgcaacaucaccgagaucguguaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggucacccgggagcccuacguguccugcgaccccggcaagugcuaccaguucgcccuggggcagggcaccacgcugaacaaccgccacagcaacgacaccgugcacgaccggaccccguaccgcacccuccugaugaacgagcugggcguccccuuccaccucgggacgaagcaggucugcaucgccugguccucguccagcugccacgacggcaaggcguggcugcacgugugcgugaccgggcacgacgagaacgccaccgccuccuucaucuacgacggccggcugguggacucgaucggguccuggagcaagaacauccuccgcacccaggaguccgagugcgugugcaucaacggcacgugcaccgucgugaugaccgacggcucggccuccgaccgggcggacaccaagauccuguucaucgaggaggggaagaucgugcacaucagcccccugucgggcuccgcccagcacgucgaggagugcagcugcuacccccgcuacccgggggugcggugcgugugccgcgacaacuggaagggcuccaaccggcccaucgucgacaucaacgugaaggacuacucgaucguguccagcuacgucugcuccggccucgugggggacacgccccgcaagaacgacucguccagcuccucguacugcuggaaccccaacaacgagaagggcgggcacggcgugaaggggugggccuucgacgacggcaacgacgucuggaugggccggaccaucuccgaggagagccgcuccggguacgagaccuucaaggugaucggcggguggucgaagccgaacuccaagcugcagaucaaccggcaggucaucguggaccgcggcaaccggagcggguacuccggcaucuucucgguggagggcaagagcugcaucaaccgcugcuucuacgucgagcugauccgggggcgcaagcaggagaccgaggugugguggacguccaacucgaucguggucuucugcggcaccuccgggaccuacggcaccgggagcuggcccgacggcgccgacaucaaccucaugcccaucuga

SEQ ID NO: 17501 - RNA, 1410 nt, Artificial Sequence
  derived and/or modified CDS sequence (AUadapt) from InfluenzaA__ABG26893__NA
augaaccccaaccagaagaucaucaccaucggcucgaucucccugaccaucgccacgaucugcuuccucaugcagaucgccauccuggugaccaccgucacccugcacuucaagcaguacgagugcaacucgccgcccaacaaccaggugaugcucugcgagcccacgaucaucgagcgcaacaucaccgagaucguguaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggucacccgggagcccuacguguccugcgaccccggcaagugcuaccaguucgcccuggggcagggcaccacgcugaacaaccgccacagcaacgacaccgugcacgaccggaccccguaccgcacccuccugaugaacgagcugggcguccccuuccaccucgggacgaagcaggucugcaucgccugguccucguccagcugccacgacggcaaggcguggcugcacgugugcgugaccgggcacgacgagaacgccaccgccuccuucaucuacgacggccggcugguggacucgaucggguccuggucgaagaacauccuccgcacccaggaguccgagugcgugugcaucaacggcacgugcaccgucgugaugaccgacggcagcgccuccgaccgggcggacaccaagauccuguucaucgaggaggggaagaucgugcacaucucgccccugagcggcuccgcccagcacgucgaggagugcucgugcuacccccgcuacccgggggugcggugcgugugccgcgacaacuggaagggcuccaaccggcccaucgucgacaucaacgugaaggacuacagcaucguguccucguacgucugcuccggccucgugggggacacgccccgcaagaacgacagcuccucguccucguacugcuggaaccccaacaacgagaagggcgggcacggcgugaaggggugggccuucgacgacggcaacgacgucuggaugggccggaccaucuccgaggagagccgcuccggguacgagaccuucaaggugaucggcggguggucgaagccgaacuccaagcugcagaucaaccggcaggucaucguggaccgcggcaaccggagcggguacuccggcaucuucucgguggagggcaagagcugcaucaaccgcugcuucuacgucgagcugauccgggggcgcaagcaggagaccgaggugugguggacguccaacucgaucguggucuucugcggcaccuccgggaccuacggcaccgggagcuggcccgacggcgccgacaucaaccucaugcccaucuga

SEQ ID NO: 17502 - RNA, 1410 nt, Artificial Sequence
  derived and/or modified CDS sequence (AUadapt) from InfluenzaA__ABG26915__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccucguccagcugccacgacggcaaggcguggcugcacgugugcgugaccgggcacgacgagaacgccaccgccuccuucaucuacgacggccggcugguggacucgaucuccagcugguccaagaacauccuccgcacccaggagucggagugcgucugcaucaacgggacgugcaccguggugaugaccgacggcuccgccagcgagcgggcggacaccaagauccuguucaucgaggagggcaagaucguccacaucucgccccuguccgggagcgcccagcacguggaggagugcuccugcuacccccgcuacccgggcgugcggugcgucugccgcgacaacuggaaggggucgaaccggcccaucguggacaucaacgugaaggacuacuccaucgucagcuccuacgugugcucgggccucgugggcgacacgccccgcaagaacgacuccagcuccucguccuacugccugaaccccaacaacgaggagggcgggcacggggucaagggcugggccuucgacgacgggaacgacguguggaugggccggaccaucagcgagaagcugcgcuccggcuacgagaccuucaaggucaucgggggcuggucgaagccgaacuccaagcuccagaucaaccgccaggugaucguggaccgggggaaccggagcggcuacuccgggaucuucucggucgagggcaagagcugcgugaaccgcugcuucuacguggagcugauccggggccgcaagcaggagaccgaggucugguggacguccaacucgaucgugguguucugcgggaccuccggcaccuacgggaccggcagcuggcccgacggggccgacaucaaccugaugcccaucuga

SEQ ID NO: 17503 - RNA, 1410 nt, Artificial Sequence
  derived and/or modified CDS sequence (AUadapt) from InfluenzaA__ABG26937__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccuccaaccaggugaugcucugcgagcccacgaucaucgagcgcaacaucaccgagaucgucuaccugaccaacaccacgaucgagaaggagaucugccccaagcuggcggaguaccggaacuggagcaagccgcagugcaagaucaccggguucgcccccuucuccaaggacaacucgauccgccucuccgccggcggggacaucugggugacccgggagcccuacgugagcugcgaccccggcaagugcuaccaguucgcccuggggcagggcaccacgcugaacaaccgccacuccaacgacaccguccacgaccggaccccguaccgcacccuccugaugaacgagcugggcgugcccuuccaccucgggacgaagcaggucugcaucgccuggucguccagcuccugccacgacggcaaggcguggcugcacgugugcgugaccgggcacgacgagaacgccaccgccucguucaucuacgacggccggcugguggacuccaucgggagcugguccaagaacauccuccgcacccaggagucggagugcgucugcaucaacggcacgugcaccguggugaugaccgacggcuccgccagcgagcgggcggacaccaagauccuguucaucgaggaggggaagaucguccacaucucgccccuguccggcagcgcccagcacguggaggagugcuccugcuacccccgcuacccgggggugcggugcgucugccgcgacaacuggaagggcucgaaccggcccaucguggacaucaacgugaaggacuacuccaucgucagcuccuacgugugcucgggccucgugggggacacgccccgcaagaacgacuccagcuccucguccuacugccggaaccccaacaacgagaagggcagccacggggucaagggcugggccuucgacgacgggaacgacguguggaugggccgcaccaucuccgaggagcugcggucgggcuacgagaccuucaaggucaucgggggcugguccaagccgaacagcaagcugcagaucaaccgccaggugaucguggaccgggggaaccgcuccggcuacucggggaucuucagcgucgagggcaaguccugcaucaaccggugcuucuacguggagcucauccgcggccgcaagcaggagaccgaggugugguggacgucgaacuccaucgucguguucugcgggaccagcggcaccuacgggaccggcuccuggcccgacggggccgacaucaaccugaugcccaucuga

SEQ ID NO: 17504 - RNA, 1413 nt, Artificial Sequence; identical to SEQ ID NO: 16798
  derived and/or modified CDS sequence (AUadapt) from InfluenzaA__ABG26948__NA

SEQ ID NO: 17505 - RNA, 1410 nt, Artificial Sequence; identical to SEQ ID NO: 16568
  derived and/or modified CDS sequence (AUadapt) from InfluenzaA__ABG26959__NA

SEQ ID NO: 17506 - RNA, 1413 nt, Artificial Sequence
  derived and/or modified CDS sequence (AUadapt) from InfluenzaA__ABG37123__NA
augaaccccaaccagaagaucaucaccaucggcucgaucuccaucaccaucgggaucaucagccugaugcuccagaucggcaacaucaucuccaucugggccucgcacuccauccagacggggagccagaaccacaccggcgugugcaaccagcgcaucaucaccuacgagaacuccaccugggucaaccacacguacgugaacaucaacaacaccaacgugaucgccgggaaggacaagaccucggucacccuggcgggcaacuccagccugugcuccaucagcggcugggccaucuacacgaaggacaacuccauccggaucgggucgaagggcgacguguucgugauccgcgagccguucaucuccugcagccaccucgagugccggaccuucuuccugacccagggggcccugcucaacgacaagcacuccaacggcaccgucaaggaccgcucgcccuaccgggcccugauguccugcccccugggggaggcccccagcccguacaacucgaaguucgaguccguggcguggagcgccuccgccugccacgacggcaugggcuggcucacgaucgggaucagcggccccgacaacggggccguggcgguccugaaguacaacggcaucaucaccgagaccaucaaguccuggaagaagcagauccugcgcacccaggagucggagugcgugugcgugaacggcuccugcuucacgaucaugaccgacgggcccagcaacggcgccgccuccuacaagaucuucaagaucgagaaggggaaggucaccaagucgaucgagcucaacgcccccaacuuccacuacgaggagugcuccugcuacccggacaccggcacggugaugugcgugugccgggacaacuggcacgggagcaaccgccccugggucuccuucaaccagaaccuggacuaccagaucggcuacaucugcucgggcguguucggggacaacccccggcccaaggacggcgagggguccugcaacccggugaccgucgacggcgccaacggggugaagggcuucagcuacaaguacggcaacgggguguggaucggccgcaccaaguccaaccggcugcgcaagggguucgagaugaucugggaccccaacggcuggaccgacacggacagcgacuucuccgucaagcaggacgugguggcgaucaccgacuggucgggguacagcggcuccuucguccagcaccccgagcucaccggccuggacugcauccggcccugcuucuggguggagcugguccgcgggcucccgaaggagaacaccacgaucuggaccucgggcuccagcaucuccuucugcggggugaacagcgacaccgccaacugguccuggcccgacggcgccgagcugcccuucaccaucgacaaguga

SEQ ID NO: 17507 - RNA, 1410 nt, Artificial Sequence
  derived and/or modified CDS sequence (AUadapt) from InfluenzaA__ABG37134__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccgacaagugcuaccaguucgcccugggccaggggaccacgcugaacaaccgccacagcaacgacaccguccacgaccggaccccguaccgcacccuccugaugaacgagcugggcgugcccuuccaccucggcacgaagcaggucugcaucgccugguccucguccucgugccacgacgggaaggcguggcugcacgugugcgugaccggccacgacgagaacgccaccgccuccuucaucuacgacgggcggcugguggacagcaucggcuccuggucgaagaagauccuccgcacccaggaguccgagugcgucugcaucaacgggacgugcaccguggugaugaccgacggcagcgccuccggccgggcggacaccaagauccuguucaucgaggaggggaagaucguccacaucucgcagcugcucggcagcgcccagcacguggaggagugcuccugcuacccccgcuaccccggggugcggugcgucugccgcgacaacuggaagggcucgaaccggccgaucguggacaucaacgugaaggacuacuccaucgucucguccuacgugugcagcggccuggugggggacacgccccgcaagaacgacuccucguccagcucccacugccugaaccccaacaacgaggagggcgggcacggcgucaaggggugggccuucgacgacggcaacgacguguggaugggccggaccaucucggagaagcuccgcuccggguacgagaccuucaaggucaucgagggcuggucgaagcccaacuccaagcugcagaucaaccgccaggugaucguggaccgggggaaccggagcggcuacuccgggaucuucucggucgagggcaaguccugcaucaaccgcugcuucuacguggagcugauccggggccgcaagcaggagaccgaggugugguggacgagcaacucgaucgucguguucugcgggaccuccggcaccuacgggaccggcagcuggccggacggggccgacaucaaccucaugcccaucuga

SEQ ID NO: 17508 - RNA, 1410 nt, Artificial Sequence; identical to SEQ ID NO: 16528
  derived and/or modified CDS sequence (AUadapt) from InfluenzaA__ABG37145__NA

SEQ ID NO: 17509 - RNA, 1410 nt, Artificial Sequence
  derived and/or modified CDS sequence (AUadapt) from InfluenzaA__ABG37156__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggcagggcaccacgcugaacaaccgccacucgaacgacaccguccacgaccggaccccguaccgcacccuccugaugaacgagcugggcgugcccuuccaccucgggacgaagcaggucugcaucgccugguccagcuccucgugccacgacggcaaggcguggcugcacgugugcgugaccgggcacgacgagaacgccaccgccuccuucaucuacgacggccggcugguggacagcaucggguccuggucgaagaacauccuccgcacccaggaguccgagugcgucugcaucaacggcacgugcaccguggugaugaccgacggcucggccuccgggcgggcggacaccaagauccuguucaucgaggagggcaagaucguccacaucagcccccugucgggguccgcccagcacguggaggagugcucgugcuacccccgcuacccgggcgugcggugcgucugccgcgacaacuggaagggcuccaaccggcccaucguggacaucaacgugaaggacuacagcaucgucuccaacuacgugugcucggggcucgugggcgacacgccccgcaagaacgacuccagcuccucgucccacugccugaaccccaacaacgaggagggcgggcacggggucaagggcugggccuucgacgacggcaacgacguguggauggggcggaccaucucggagaagcugcgcuccggcuacgagaccuucaaggucaucgggggcuggagcaagccgaacuccaagcuccagaucaaccgccaggugaucguggaccgggggaaccggucgggcuacuccggcaucuucucggucgaggggaaguccugcaucaaccgcugcuucuacguggagcugauccggggccgcaagcaggagaccgaggugugguggacgagcaacucgaucgucguguucugcgggaccuccggcaccuacgggaccggcagcuggcccgacggcgccgacaucaaccugaugcccaucuga

SEQ ID NO: 17510 - RNA, 1410 nt, Artificial Sequence
  derived and/or modified CDS sequence (AUadapt) from InfluenzaA__ABG37167__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccgacaagugcuaccaguucgcccugggccaggggaccacgcugaacaaccgccacagcaacgacaccguccacgaccggaccccguaccgcacccuccugaugaacgagcugggcgugcccuuccaccucggcacgaagcaggucugcaucgccugguccucguccagcugccacgacgggaaggcguggcugcacgugugcgugaccggccacgacgagaacgccaccgccuccuucaucuacgacgggcggcugguggacucgaucuccagcugguccaagaacauccuccgcacccaggagucggagugcgucugcaucaacggcacgugcaccguggugaugaccgacggguccgccagcggccgggcggacaccaagauccuguucaucgaggagggcaagaucguccacaucucgccccuguccgggagcgcccagcacguggaggagugcuccugcuacccccgcuacccgggcgugcggugcgucugccgcgacaacuggaaggggucgaaccggcccaucguggacaucaacgugaaggacuacuccaucgucagcuccuacgugugcucgggccucgugggcgacacgccccgcaagaacgacuccagcuccucguccuacugccugaaccccaacaacgaggagggcgggcacggggucaagggcugggccuucgacgacgggaacgacguguggaugggccggaccaucagcgagaagcugcgcuccggcuacgagaccuucaaggucaucgggggcuggucgaagccgaacuccaagcuccagaucaaccgccaggugaucguggaccgggggaaccggagcggcuacuccgggaucuucucggucgagggcaagagcugcgugaaccgcugcuucuacguggagcugauccggggccgcaagcaggagaccgaggucugguggacguccaacucgaucgugguguucugcgggaccuccggcaccuacgggaccggcagcuggcccgacggggccgacaucaaccugaugcccaucuga

SEQ ID NO: 17511 - RNA, 1410 nt, Artificial Sequence
  derived and/or modified CDS sequence (AUadapt) from InfluenzaA__ABG37189__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugcuccugugcgagcccacgaucaucgagcgcaacaucaccgagaucgucuaccugaccaacaccacgaucgagaaggagaucugccccaagcucgcggaguaccggaacugguccaagccgcagugcaagaucaccggguucgcccccuucagcaaggacaacuccauccgccugucggccggcggggacaucugggugacccgggagcccuacguguccugcgaccccggcaagugcuaccaguucgcccuggggcagggcaccacgcucaacaaccgccacagcaacgacaccguccacgaccggaccccguaccgcacccugcugaugaacgagcucggcgugcccuuccaccuggggacgaagcaggucugcaucgccugguccucguccagcugccacgacggcaaggcguggcugcacgugugcgugaccgggcacgacgagaacgccaccgccuccuucaucuacgacggccggcucguggacucgaucggguccuggucgaagaacauccugcgcacccaggaguccgagugcgucugcaucaacggcacgugcaccguggugaugaccgacggcagcgccuccgggcgggcggacaccaagauccuguucaucgaggagggcaagaucguccacaucucgagccucuccgggucggcccagcacguggaggagugcuccugcuacccccgcuaccccggcgugcggugcgucugccgcgacaacuggaagggcagcaaccggccgaucguggacaucaacgugaaggacuacuccaucgucucguccuacgugugcagcgggcuggugggcgacacgccccgcaagaacgacuccucguccucgucccacugccugaaccccaacaacgaggagggcgggcacggggucaagggcugggccuucgacgacggcaacgacguguggauggggcggaccaucagcgagaagcuccgcuccggcuacgagaccuucaaggucaucgggggcuggucgaagcccaacuccaagcugcagaucaaccgccaggugaucguggaccgggggaaccggagcggcuacuccggcaucuucucggucgagggcaagagcugcaucaaccgcugcuucuacguggagcugauccgggggcgcaagcaggagaccgaggugugguggacguccaacucgaucgucguguucugcgggaccuccggcaccuacgggaccggcagcuggccggacggcgccgacaucaaccucaugcccaucuga

SEQ ID NO: 17512 - RNA, 1410 nt, Artificial Sequence
  derived and/or modified CDS sequence (AUadapt) from InfluenzaA__ABG37200__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgacagcggcaagugcuaccaguucgcccuggggcagggcaccacgcugaacaaccgccacuccaacgacaccguccacgaccggacccccuaccgcacccuccugaugaacgagcugggcgugccguuccaccucgggacgaagcaggucugcaucgccuggucguccagcuccugccacgacggcaaggcguggcugcacgugugcgugaccgggcacgacgagaacgccaccgccucguucaucuacgacggccggcugguggacuccaucgggucgugguccaagaacauccuccgcacccaggagagcgagugcgucugcaucaacggcacgugcaccguggugaugaccgacggcuccgccucggggcgggcggacaccaagauccuguucaucgaggagggcaagaucguccacaucagcacgcuguccgggucggcccagcacguggaggagugcuccugcuacccccgcuaccccggcgugcggugcgucugccgcgacaacuggaagggcagcaaccggcccaucguggacaucaacgugaaggacuacuccaucgucucguccuacgugugcagcgggcucgugggcgacaccccgcgcaagaacgacuccucguccucgucccacugccugaaccccaacaacgaggagggcgggcacggggucaagggcugggccuucgacgacggcaacgacguguggauggggcggaccaucagcgagaagcugcgcuccggcuacgagaccuucaaggucaucgggggcuggucgaagcccaacuccaagcuccagaucaaccgccaggugaucguggaccgggggaaccggagcggcuacuccggcaucuucucggucgagggcaagagcugcaucaaccgcugcuucuacguggagcugauccgggggcgcaagcaggagacggaggugugguggaccuccaacucgaucgucguguucugcgggaccuccggcaccuacgggacgggcagcuggcccgacggcgccgacaucaaccugaugccgaucuga

SEQ ID NO: 17513 - RNA, 1410 nt, Artificial Sequence
  derived and/or modified CDS sequence (AUadapt) from InfluenzaA__ABG37211__NA
augaaccccaaccagaagaucaucaccaucggcucggugucccugaccaucgccacgaucugcuuccucacccagaucgccauccuggucaccaccgugacgcugcacuucaagcaguacgagugcucguccccgcccaacaaccaggugaugcccugcgagcccaucaucaucgagcgcaacaucaccgagaucgucuaccucaccaacaccacgaucgagaaggagaucugcccgaagcugguggaguaccggaacuggagcaagccccagugcaagaucaccggguucgcgcccuucuccaaggacaacucgauccgccuguccgccggcggggacaucugggugacccgggagcccuacgucagcugcgacccgggcaagugcuaccaguucgcccucgggcagggcaccacgcugaacaacaagcacuccaacgacaccauccacgaccgcacccccuaccggacccugcucaugaacgagcugggcgugcccuuccaccuggggacgaagcaggucugcaucgccuggucguccucguccugccacgacggcaaggccuggcuccacgugugcaucaccgggcacgacaagaacgcgaccgccagcuucaucuacgacggccgccugguggacuccaucgggucgugguccaagaacauccugcggacccaggagagcgagugcgugugcaucaacggcacgugcaccgucgugaugaccgacggcuccgccucggagcgcgccgacaccaagauccucuucaucgaggaggggaagaucgugcacaucagcccccuguccggcucggcgcagcacgucgaggagugcuccugcuacccgcgguaccccggggugcgcugcgugugccgggacaacuggaagggcucgaaccgccccaucgucgacaucaacgugaaggacuacuccaucgugagcuccuacgucugcucgggccuggugggggacacgccccggaagaacgaccgcuccagcuccucguacugccggaacccgaacaacgagaagggcaaccacggggugaagggcugggccuucgacgacgggaacgacgucuggaugggccgcaccaucggcgaggagcuccgguccggguacgagaccuucaaggugaucggcggguggucgacccccaacuccaagcugcagaucaaccgccaggucaucguggacagcggcaaccgguccggguacucgggcaucuucuccguggagggcaagagcugcaucaaccgcugcuucuacgucgagcugauccgggggcgcgagcaggagacgcgcgugugguggaccucgaacuccaucguggucuucugcggcaccagcgggaccuacggcacgggguccuggcccgacggcgccgacaucaaccucaugcccaucuga

SEQ ID NO: 17514 - RNA, 1410 nt, Artificial Sequence
  derived and/or modified CDS sequence (AUadapt) from InfluenzaA__ABG37233__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccuccaaccaggcgaugcucugcgagcccacgaucaucgagcgcaacaucaccgagaucguguaccugaccaacaccacgaucgagaaggagaucugccccaagcuggccgaguaccggaacuggagcaagccgcagugcaagaucaccggguucgcccccuucuccaaggacaacucgauccgccucuccgccggcggggacaucugggucacccgggagcccuacgugagcugcgaccccggcaagugcuaccaguucgcccuggggcagggcaccacgaucaacaaccgccacuccaacgacaccgugcacgaccggaccccguaccgcacccugcucaugaacgagcugggcguccccuuccaccuggggacgaagcaggucugcaucgcguggucguccucguccugccacgacggcaaggccuggcuccacgugugcgugaccgggcacgacgagaacgccaccgccagcuucaucuacgacggccggcugguggacuccaucgggucgugguccaagaacauccugcgcacccaggagagcgagugcgugugcaucaacggcacgugcaccgucgugaugaccgacggcuccgcgucggggcgggccgacaccaagauccucuucaucgaggagggcaagaucgugcacaucucgccccuguccgggagcgcccagcacgucgaggagugcuccugcuacccccgcuacccgggcgugcggugcgugugccgcgacaacuggaagggcucgaaccggcccaucgucgacaucaacgugaaggacuacuccaucgugagcuccuacgucugcucggggcuggugggcgacacgccccgcaagaacgacuccucguccaacagcuacugccggaaccccaacaacgagaaggggucccacggcgugaaggggugggccuucgacgacggcaacgacgucuggaugggccgcaccaucucggccgagucccggagcggguacgagaccuucaaggugaucggcgggugguccaagccgaacucgaagcuccagaucaaccgccaggucaucguggaccggggcaaccgcuccggguacucgggcaucuucagcguggagggcaaguccugcaucaaccggugcuucuacgucgagcugauccgcgggcgcaagcaggagaccgaggugugguggacgucgaacuccaucguggucuucugcggcaccagcgggaccuacggcaccggguccuggcccgacggcgcggacaucaaccugaugcccaucuga

SEQ ID NO: 17515 - RNA, 1410 nt, Artificial Sequence
  derived and/or modified CDS sequence (AUadapt) from InfluenzaA__ABG37244__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccucguccagcugccacgacggcaaggcguggcugcacgugugcgugaccgggcacgacgagaacgccaccgccuccuucaucuacgacggccggcugguggacucgaucggguccuggucgaagaacauccuccgcacccaggaguccgagugcgucugcaucaacggcacgugcaccguggugaugaccgacggcagcgccuccgaccgggcggacaccaagauccuguucaucgaggaggggaagaucguccacaucucgccccugagcggcuccgcccagcacguggaggagugcucgugcuacccccgcuacccgggggugcggugcgucugccgcgacaacuggaagggcuccaaccggcccaucguggacaucaacgugaaggacuacagcaucgucuccucguacgugugcuccggccucgugggggacacgccccgcaagaacgacagcuccucguccucguacugcuggaaccccaacaacgagaagggcgggcacggcgucaaggggugggccuucgacgacggcaacgacguguggaugggccggaccaucuccgaggagagccgcuccggguacgagaccuucaaggucaucggcggguggucgaagccgaacuccaagcugcagaucaaccgccaggugaucguggaccggggcaaccggagcggguacuccggcaucuucucggucgagggcaagagcugcaucaaccgcugcuucuacguggagcugauccgggggcgcaagcaggagaccgaggugugguggacguccaacucgaucgucguguucugcggcaccuccgggaccuacggcaccgggagcuggcccgacggcgccgacaucaaccucaugcccaucuga

SEQ ID NO: 17516 - RNA, 1410 nt, Artificial Sequence; identical to SEQ ID NO: 17515
  derived and/or modified CDS sequence (AUadapt) from InfluenzaA__ABG37255__NA

SEQ ID NO: 17517 - RNA, 1410 nt, Artificial Sequence; identical to SEQ ID NO: 17502
  derived and/or modified CDS sequence (AUadapt) from InfluenzaA__ABG37266__NA

SEQ ID NO: 17518 - RNA, 1410 nt, Artificial Sequence; identical to SEQ ID NO: 17515
  derived and/or modified CDS sequence (AUadapt) from InfluenzaA__ABG37277__NA

SEQ ID NO: 17519 - RNA, 1410 nt, Artificial Sequence; identical to SEQ ID NO: 17515
  derived and/or modified CDS sequence (AUadapt) from InfluenzaA__ABG37288__NA

SEQ ID NO: 17520 - RNA, 1410 nt, Artificial Sequence; identical to SEQ ID NO: 17515
  derived and/or modified CDS sequence (AUadapt) from InfluenzaA__ABG37310__NA

SEQ ID NO: 17521 - RNA, 1410 nt, Artificial Sequence; identical to SEQ ID NO: 17502
  derived and/or modified CDS sequence (AUadapt) from InfluenzaA__ABG37321__NA

SEQ ID NO: 17522 - RNA, 1410 nt, Artificial Sequence
  derived and/or modified CDS sequence (AUadapt) from InfluenzaA__ABG37332__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucgagcgcaacaucaccgagaucguccaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggcagggcaccacgcugaacaaccgccacucgaacgacaccguccacgaccggaccccguaccgcacccuccugaugaacgagcugggcgugcccuuccaccucgggacgaagcaggucugcaucgccugguccagcuccucgugccacgacggcaaggcguggcugcacgugugcgugaccgggcacgacgagaacgccaccgccuccuucaucuacgacggccggcugguggacucgaucggguccuggagcaagaacauccuccgcacccaggaguccgagugcgucugcaucaacggcacgugcaccguggugaugaccgacggcucggccuccgaccgggcggacaccaagauccuguucaucgaggaggggaagaucguccacaucucgccccugagcggcggggcccagcacguggaggagugcuccugcuacccccgcuacccgggcgugcggugcgucugccgcgacaacuggaagggcucgaaccggcccaucguggacaucaacgugaaggacuacuccaucgucucguccuacgugugcagcgggcucgugggcgacacgccccgcaagaacgacuccucguccucguccuacugcuggaaccccaacaacgagaagggcgggcacggggucaagggcugggccuucgacgacggcaacgacguguggauggggcggaccaucagcgaggagucccgcucgggcuacgagaccuucaaggucaucgggggcugguccaagccgaacucgaagcugcagaucaaccgccaggugaucguggaccgggggaaccgguccggcuacagcggcaucuucuccgucgagggcaagucgugcaucaaccgcugcuucuacguggagcugauccgggggcgcaagcaggagaccgaggugugguggacgucgaacuccaucgucguguucugcgggaccagcggcaccuacgggaccggcuccuggcccgacggcgccgacaucaaccucaugcccaucuga

SEQ ID NO: 17523 - RNA, 1410 nt, Artificial Sequence
  derived and/or modified CDS sequence (AUadapt) from InfluenzaA__ABG37343__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccucguccagcugccacgacggcaaggcguggcugcacgugugcgugaccgggcacgacgagaacgccaccgccuccuucaucuacgacggccggcugguggacucgaucggguccuggucgaagaacauccuccgcacccaggaguccgagugcgucugcaucaacggcacgugcaccguggugaugaccgacggcagcgccuccgaccgggcggacaccaagauccuguucaucgaggaggggaagaucguccacaucucgccccugagcggcuccgcccagcacguggaggagugcucgugcuacccccgcuacccgggggugcggugcgucugccgcgacaacuggaagggcuccaaccggcccaucguggacaucaacgugaagaacuacagcaucgucuccucguacgugugcuccggccucgugggggacacgccccgcaagaacgacagcuccucguccucguacugcuggaaccccaacaacgagaagggcgggcacggcgucaaggggugggccuucgacgacggcaacgacguguggaugggccggaccaucuccgaggagagccgcuccggguacgagaccuucaaggucaucggcggguggucgaagccgaacuccaagcugcagaucaaccgccaggugaucguggaccggggcaaccggagcggguacuccggcaucuucucggucgagggcaagagcugcaucaaccgcugcuucuacguggagcugauccgggggcgcaagcaggagaccgaggugugguggacguccaacucgaucgucguguucugcggcaccuccgggaccuacggcaccgggagcuggcccgacggcgccgacaucaaccucaugcccaucuga

SEQ ID NO: 17524 - RNA, 1410 nt, Artificial Sequence; identical to SEQ ID NO: 17503
  derived and/or modified CDS sequence (AUadapt) from InfluenzaA__ABG37354__NA

SEQ ID NO: 17525 - RNA, 1413 nt, Artificial Sequence; identical to SEQ ID NO: 17230
  derived and/or modified CDS sequence (AUadapt) from InfluenzaA__ABG37365__NA

SEQ ID NO: 17526 - RNA, 1413 nt, Artificial Sequence; identical to SEQ ID NO: 17332
  derived and/or modified CDS sequence (AUadapt) from InfluenzaA__ABG37387__NA

SEQ ID NO: 17527 - RNA, 1413 nt, Artificial Sequence
  derived and/or modified CDS sequence (AUadapt) from InfluenzaA__ABG37398__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcgugugcaaccagcgcaucaucaccuacgagaacaacaccugggucaaccacaccuacgugaacaucaacaacacgaacgugaucgcggggaaggacaagaccuccgucacccuggccggcaacucgucccugugcagcaucuccggcugggccaucuacaccaaggacaacucgauccggaucggguccaagggcgacguguucgugauccgcgagccguucaucagcugcucccaccucgagugccggacguucuuccugacccagggggcccugcucaacgacaagcacucgaacggcaccgucaaggaccgcucccccuaccgggcccugaugagcugcccccugggggaggcgcccuccccguacaacucgaaguucgagagcguggccugguccgccagcgccugccacgacggcaugggcuggcucaccaucgggaucuccggccccgacaacggggcgguggccguccugaaguacaacggcaucaucacggagaccaucaagucguggaagaagcagauccugcgcacccaggaguccgagugcgugugcgugaacggcagcugcuucaccaucaugacggacgggcccuccaacggcgccgccucguacaagaucuucaagaucgagaaggggaaggucaccaaguccaucgagcucaacgcccccaacuuccacuacgaggagugcagcugcuacccggacaccggcaccgugaugugcgugugccgggacaacuggcacggguccaaccgccccugggucucguucaaccagaaccuggacuaccagaucggcuacaucugcuccggcguguucggggacaacccccggcccaaggacggcgaggggagcugcaacccggugacggucgacggcgcgaacggggugaagggcuucuccuacaaguacggcaacgggguguggaucggccgcaccaagucgaaccggcugcgcaagggguucgagaugaucugggaccccaacggcuggaccgacaccgacuccgacuucagcgucaagcaggacgugguggccaucacggacugguccggguacucgggcagcuucguccagcaccccgagcucaccggccuggacugcauccggcccugcuucuggguggagcugguccgcgggcucccgaaggagaacaccaccaucuggacguccggcucguccaucagcuucugcggggugaacuccgacaccgccaacuggagcuggcccgacggcgccgagcugcccuucaccaucgacaaguga

SEQ ID NO: 17528 - RNA, 1410 nt, Artificial Sequence
  derived and/or modified CDS sequence (AUadapt) from InfluenzaA__ABG37409__NA
augaaccccaaccagaagaucaucaccaucggcucggugucccugaccaucgccacgaucugcuuccucaugcagaucgucauccuggugaccaccgugacccugcacuucaagcaguacgagugcaacucgccgcccaacaaccaggucaugcccugcgagcccacgaucaucgagcgcaacaucaccgagaucguguaccucaccaacaccacgaucgagaaggagaucugcccgaagcuggccgaguaccggaacugguccaagccccagugcaacaucaccggguucgcgcccuucagcaaggacaacuccauccgccugucggccggcggggacaucugggugacccgggagcccuacgucuccugcgacccggacaagugcuaccaguucgcccucggccaggggaccacgcugaacaacggccacagcaacgacaccgugcacgaccgcacccccuaccggacccugcucaugaacgagcugggcgugcccuuccaccuggggacgaagcaggucugcaucgccugguccucguccucgugccacgacggcaaggccuggcuccacgugugcgugaccggggacgacgagaacgcgaccgccuccuucaucuacaacggccgccuggucgacagcaucggguccuggucgaagaagauccugcggacccaggaguccgagugcgugugcaucaacggcacgugcaccguggucaugaccgacggcagcgccuccgggaaggccgacaccaagauccucuucaucgaggagggcaagaucgugcacacgucgcugcugagcggguccgcgcagcacguggaggagugcucgugcuacccccgcuacccgggcguccggugcgugugccgcgacaacuggaagggcuccaaccggcccaucguggacaucaacgucaaggacuacucgaucguguccagcuacgugugcuccgggcucgucggcgacacgccccgcaagaacgacucguccagcuccucgcacugccuggaccccaacaacgaggagggcgggcacggggugaagggcugggccuucgacgaccggaacgacgucuggaugggccgcaccaucuccgagaagcugcggucgggguacgagaccuucaaggugaucgagggcugguccaagccgaacagcaagcuccagaucaaccgccaggugaucgucgaccgggggaaccgcuccggcuacucggggaucuucuccguggagggcaagagcugcaucaaccggugcuucuacguggagcugauccgcggccggaagcaggagaccgagguccuguggaccucgaacuccaucgugguguucugcgggaccagcggcaccuacgggacgggcuccuggcccgacggggccgacaucaaccucaugcccaucuga

SEQ ID NO: 17529 - RNA, 1410 nt, Artificial Sequence
  derived and/or modified CDS sequence (AUadapt) from InfluenzaA__ABG37442__NA
augaaccccaaccagaagaucaucaccaucggcucggugucccugaccaucgccacgaucugcuuccucaugcagaucgccauccuggucaccaccgugacccugcacuucaagcaguucgagugcaacucgccgcccaacaaccaggugaugcucugcgagcccacgaucaucgaggggaacaucaccgagaucgucuaccugaccaacaccacgaucgagaaggagaucugccccaagcuggcggaguaccgcaacugguccaagccgcagugcaacaucaccggcuucgcccccuucagcaaggacaacuccauccggcucucggccgggggcgacaucugggugacccgcgagcccuacguguccugcgaccccgacaagugcuaccaguucgcccuggggcagggcaccacgcugaacaacggccacagcaacgacaccguccacgaccggaccccguaccgcacccuccugaugaacgagcugggggugcccuuccaccucggcacgcgccaggugugcaucgccugguccucguccagcugccacgacgggaaggcguggcugcacgucugcgugaccggcgacgacgagaacgccaccgccuccuucaucuacaacgggcggcugguggacucgaucggcuccuggagcaagaagauccuccggacccaggaguccgagugcgucugcaucaacggcacgugcaccguggugaugaccgacgggucggccuccggcaaggcggacaccaagauccuguucaucgaggaggggaagaucguccacaucagcacgcugucgggcuccgcccagcacguggaggagugcucgugcuacccccgcuaccccggcgugcggugcgucugccgcgacaacuggaagggguccaaccggccgaucguggacaucaacgugaaggacuacagcaucgucuccucguacgugugcuccggccucgugggggacacgccccgcaagaacgacagcuucuccucgucccacugccuggaccccaacaacgaggagggcgggcacggcgucaagggcugggccuucgacgacgggaacgacguguggaugggccggaccaucagcgagaagcugcgcuccggguacgagaccuucaaggucaucgagggcuggucgaagcccaacuccaagcuccagaccaaccgccaggugaucguggagcgggggaaccggagcggcuacuccggcaucuucucggucgaggggaaguccugcaucaaccgcugcuucuacguggagcugauccggggccgcaaggaggagaccgaggugugguggaccagcaacucgaucgucguguucugcgggaccuccggcacguacgggaccggcagcuggccggacggcgccgacaucaaccugaugcccaucuga

SEQ ID NO: 17530 - RNA, 1410 nt, Artificial Sequence; identical to SEQ ID NO: 16556
  derived and/or modified CDS sequence (AUadapt) from InfluenzaA__ABG37453__NA

SEQ ID NO: 17531 - RNA, 1410 nt, Artificial Sequence; identical to SEQ ID NO: 16568
  derived and/or modified CDS sequence (AUadapt) from InfluenzaA__ABG37464__NA

SEQ ID NO: 17532 - RNA, 1410 nt, Artificial Sequence
  derived and/or modified CDS sequence (AUadapt) from InfluenzaA__ABG37475__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccagcugccacgacggcaaggcguggcugcacgucugcgugaccggggacgacgagaacgccaccgccuccuucaucuacaacggccggcugguggacucgaucggguccuggagcaagaagauccuccgcacccaggaguccgagugcgucugcaucaacggcacgugcaccguggugaugaccgacggcucggccuccgggaaggcggacaccaagauccuguucaucgaggagggcaagaucguccacaucagcacgcugucgggguccgcccagcacguggaggagugcucgugcuacccccgguaccccggcgugcgcugcgucugccgggacaacuggaagggcuccaaccgcccgaucguggacaucaacgugaaggacuacagcaucgucuccucguacgugugcuccgggcucgugggcgacacgccccggaagaacgacagcuucuccucgucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggucgaagcccaacuccaagcuccagaucaaccgccaggugaucguggagcggggcgaccgcagcggguacuccggcaucuucucggucgagggcaaguccugcaucaaccggugcuucuacguggagcugauccgcgggcggaaggaggagaccgaggugcuguggaccagcaacucgaucgucguguucugcggcaccuccgggaccuacggcacggggagcuggccggacggcgccgacaucaaccucaugcccaucuga

SEQ ID NO: 17533 - RNA, 1410 nt, Artificial Sequence
  derived and/or modified CDS sequence (AUadapt) from InfluenzaA__ABG37486__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaaccucaccggguucgcccccuucagcaaggacaacuccauccgccugucggccggcggggacaucugggugacccgggagcccuacguguccugcgaccccgacaagugcuaccaguucgcccugggccaggggaccacgcucaacaacggccacagcaacgacaccguccacgaccgcaccccguaccggacccugcugaugaacgagcucggcgugcccuuccaccuggggacgcgccaggugugcaucgccugguccucguccucgugccacgacggcaaggcguggcugcacgucugcgugaccggggacgacgagaacgccaccgccuccuucaucuacaacggccggcucguggacagcaucggguccuggucgaagaagauccugcgcacccaggaguccgagugcgucugcaucaacggcacgugcaccguggugaugaccgacggcagcgccuccgggaaggcggacaccaagauccuguucaucgaggagggcaagaucguccacaucucgacgcucagcggguccgcccagcacguggaggagugcucgugcuacccccgguaccccggcgugcgcugcgucugccgggacaacuggaagggcuccaaccgcccgaucguggacaucaacgugaaggacuacucgaucgucuccagcuacgugugcuccgggcuggugggcgacacgccccggaagaacgacucguucuccagcucccacugccuggaccccaacaacgaggagggcgggcacggggucaagggcugggccuucgacgacggcaacgacguguggauggggcgcaccaucucggagaagcuccgguccggcuacgagaccuucaaggucaucgagggguggucgaagcccaacuccaagcugcagaccaaccgccaggugaucguggagcggggcaaccgcagcggguacuccggcaucuucucggucgagggcaaguccugcaucaaccggugcuucuacguggagcugauccgcgggcggaaggaggagaccgaggugugguggaccagcaacucgaucgucguguucugcggcaccuccgggacguacggcaccgggagcuggccggacggcgccgacaucaaccucaugcccaucuga

SEQ ID NO: 17534 - RNA, 1410 nt, Artificial Sequence
  derived and/or modified CDS sequence (AUadapt) from InfluenzaA__ABG37497__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccucgugccacgacggcaaggcguggcugcacgucugcgugaccggggacgacgagaacgccaccgccuccuucaucuacaacggccggcugguggacagcaucggguccuggucgaagaagauccuccgcacccaggaguccgagugcgucugcaucaacggcacgugcaccguggugaugaccgacggcagcgccuccgggaaggcggacaccaagaucaucuucaucgaggagggcaagaucguccacaucucgacgcugagcggguccgcccagcacguggaggagugcucgugcuacccccgguaccccggcgugcgcugcgucugccgggacaacuggaagggcuccaaccgcccgaucguggacaucaacgugaaggacuacucgaucgucuccagcuacgugugcuccgggcuggugggcgacacgccccggaagaacgacucguucuccagcucccacugccucgaccccaacaacgaggagggcgggcacggggucaagggcugggccuucgacgacggcaacgacguguggauggggcgcaccaucucggagaagcugcgguccggcuacgagaccuucaaggucaucgagggguggucgaagcccaacuccaagcugcagaccaaccgccaggugaucguggagcggggcaaccgcagcggguacuccggcaucuucucggucgagggcaaguccugcaucaaccggugcuucuacguggagcucauccgcgggcggaaggaggagaccgaggugugguggaccagcaacucgaucgucguguucugcggcaccuccgggacguacggcaccgggagcuggccggacggcgccgacaucaaccugaugcccaucuga

SEQ ID NO: 17535 - RNA, 1410 nt, Artificial Sequence; identical to SEQ ID NO: 16582
  derived and/or modified CDS sequence (AUadapt) from InfluenzaA__ABG37508__NA

SEQ ID NO: 17536 - RNA, 1410 nt, Artificial Sequence; identical to SEQ ID NO: 16993
  derived and/or modified CDS sequence (AUadapt) from InfluenzaA__ABG37519__NA

SEQ ID NO: 17537 - RNA, 1410 nt, Artificial Sequence; identical to SEQ ID NO: 16993
  derived and/or modified CDS sequence (AUadapt) from InfluenzaA__ABG37530__NA

SEQ ID NO: 17538 - RNA, 1410 nt, Artificial Sequence; identical to SEQ ID NO: 16993
  derived and/or modified CDS sequence (AUadapt) from InfluenzaA__ABG37541__NA

SEQ ID NO: 17539 - RNA, 1410 nt, Artificial Sequence; identical to SEQ ID NO: 16993
  derived and/or modified CDS sequence (AUadapt) from InfluenzaA__ABG37552__NA

SEQ ID NO: 17540 - RNA, 1410 nt, Artificial Sequence; identical to SEQ ID NO: 16993
  derived and/or modified CDS sequence (AUadapt) from InfluenzaA__ABG37563__NA

SEQ ID NO: 17541 - RNA, 1410 nt, Artificial Sequence; identical to SEQ ID NO: 16993
  derived and/or modified CDS sequence (AUadapt) from InfluenzaA__ABG37585__NA

SEQ ID NO: 17542 - RNA, 1410 nt, Artificial Sequence; identical to SEQ ID NO: 16993
  derived and/or modified CDS sequence (AUadapt) from InfluenzaA__ABG37596__NA

SEQ ID NO: 17543 - RNA, 1410 nt, Artificial Sequence; identical to SEQ ID NO: 16993
  derived and/or modified CDS sequence (AUadapt) from InfluenzaA__ABG37607__NA

SEQ ID NO: 17544 - RNA, 1410 nt, Artificial Sequence; identical to SEQ ID NO: 16993
  derived and/or modified CDS sequence (AUadapt) from InfluenzaA__ABG37618__NA

SEQ ID NO: 17545 - RNA, 1413 nt, Artificial Sequence; identical to SEQ ID NO: 17230
  derived and/or modified CDS sequence (AUadapt) from InfluenzaA__ABG47810__NA

SEQ ID NO: 17546 - RNA, 1413 nt, Artificial Sequence
  derived and/or modified CDS sequence (AUadapt) from InfluenzaA__ABG47832__NA
augaaccccaaccagaagaucaucaccaucggcucgaucuccaucgccaucgggaucaucucgcugauccuccaggugggcaacaucaucuccaucugggccagccacuccauccagaccgggucgcagaaccacacgggcaucugcaaccagcgcaucaucaccuacgagaacuccaccugggucaaccagaccuacgugaacaucaacaacacgaacguggucgcggggaaggacaagaccagcaugacccuggccggcaacuccucgcugugcccgauccggggcugggccaucuacaccaaggacaacuccauccgcaucgggagcaagggcgacguguucgugauccgggagcccuucaucuccugcucgcaccucgagugccgcacguucuuccugacccagggggcccugcucaacgacaagcacuccaacggcaccgucaaggaccggagccccuaccgcgcccugauguccugcccccugggggaggcgccgucgcccuacaacucccgguucgagagcguggccuggucggccuccgccugccacgacggccucggcuggcugaccaucgggaucagcggccccgacaacggggcgguggccguccugaaguacaacggcaucaucacggagaccaucaaguccuggaagaagcgcauccuccggacccaggagucggagugcgugugcaugaacggcuccugcuucaccaucaugacggacgggcccagcaacggcgccgccuccuaccgcaucuucaagaucgagaaggggcgggugaccaagucgaucgagcuggacgccccgaacuaccacuacgaggagugcuccugcuaccccaacaccggcaccgucaugugcgugugccgcgacaacuggcacgggagcaaccggcccuggguguccuucaaccagaaccuggacuaccagaucggcuacaucugcucgggcgucuucggggacaacccccgcccgaaggacggcgagggguccugcaaccccgugacgguggacggcgcggacggggucaagggcuucagcuaccgguacggcaacgggguguggaucggccgcaccaaguccaaccggcuccgcaagggguucgagaugaucugggaccccaacggcuggaccgacaccgacucggacuucuccaugaagcaggacaucguggccaugacggacuggagcggguacuccggcucguucguccagcaccccgagcugaccggccuggacugcaugcggccgugcuucuggguggagcucgugcgcgggcugccccgggagaacaccaccaucuggacgagcggcuccucgaucuccuucugcggggucaacagcgacaccgccaacugguccuggcccgacggcgccgagcugcccuucaccaucgacaaguga

SEQ ID NO: 17547 - RNA, 1413 nt, Artificial Sequence; identical to SEQ ID NO: 17370
  derived and/or modified CDS sequence (AUadapt) from InfluenzaA__ABG47843__NA

SEQ ID NO: 17548 - RNA, 1410 nt, Artificial Sequence
  derived and/or modified CDS sequence (AUadapt) from InfluenzaA__ABG47865__NA
augaaccccaaccagaagaucaucaccaucggcucggugucccugaccaucgccacgaucugcuuccucaugcagaucgccauccuggucaucaccgugacccugcacuucaagcaguacgagugcaacucgccgcccaacaaccaggugaugcucugcgagcccaccaucaucgagcgcaacaucacggagaucgucuaccugaccaacaccaccaucgagaaggagaucugccccaagcuggcggaguaccggaacugguccaagccgcagugcaagaucacgggguucgcccccuucagcaaggacaacuccauccgccucucggccggcggggacaucugggugacccgggagcccuacguguccugcgaccccgacaagugcuaccaguucgcccugggccaggggaccacccugaacaaccgccacagcaacgacacgguccacgaccggaccccguaccgcacccuccugaugaacgagcugggcgugcccuuccaccucggcaccaagcaggucugcaucgccugguccucguccagcugccacgacgggaaggcguggcugcacgugugcgugacgggccacgacgagaacgccaccgccuccuucaucuacgacgggcggcugguggacucgaucggcuccuggagcaagaagauccuccgcacccaggaguccgagugcgucugcaucaacgggaccugcacgguggugaugaccgacggcucggccuccggccgggcggacaccaagauccuguucaucgaggaggggaagaucguccacaucagcccccugucgggcuccgcccagcacguggaggagugcagcugcuacccccgcuacuccggggugcggugcgucugccgcgacaacuggaagggcucgaaccggccgaucguggacaucaacgugaaggacuacuccaucgucagcuccuacgugugcucgggccucgugggggacacgccccgcaagaacgacuccagcuccucgucccacugccugaaccccaacaacgaggagggcgggcacggcgucaaggggugggccuucgacgacggcaacgacguguggaugggccggaccaucagcgagaagcugcgcuccggguacgagaccuucaaggucaucggcggguggucgaagcccaacuccaagcuccagaucaaccgccaggugaucguggaccggggcaaccggagcggguacuccggcaucuucucggucgagggcaagagcugcaucaaccgcugcuucuacguggagcugauccgggggcgcaagcaggagaccgaggugugguggaccuccaacucgaucgucguguucugcggcacguccgggaccuacggcaccgggagcuggccggacggcgccgacaucaaccugaugcccaucuga

SEQ ID NO: 17549 - RNA, 1410 nt, Artificial Sequence; identical to SEQ ID NO: 17515
  derived and/or modified CDS sequence (AUadapt) from InfluenzaA__ABG47876__NA

SEQ ID NO: 17550 - RNA, 1410 nt, Artificial Sequence; identical to SEQ ID NO: 17515
  derived and/or modified CDS sequence (AUadapt) from InfluenzaA__ABG47887__NA

SEQ ID NO: 17551 - RNA, 1410 nt, Artificial Sequence; identical to SEQ ID NO: 17502
  derived and/or modified CDS sequence (AUadapt) from InfluenzaA__ABG47898__NA

SEQ ID NO: 17552 - RNA, 1410 nt, Artificial Sequence; identical to SEQ ID NO: 17515
  derived and/or modified CDS sequence (AUadapt) from InfluenzaA__ABG47909__NA

SEQ ID NO: 17553 - RNA, 1410 nt, Artificial Sequence; identical to SEQ ID NO: 17503
  derived and/or modified CDS sequence (AUadapt) from InfluenzaA__ABG47920__NA

SEQ ID NO: 17554 - RNA, 1410 nt, Artificial Sequence; identical to SEQ ID NO: 17503
  derived and/or modified CDS sequence (AUadapt) from InfluenzaA__ABG47931__NA

SEQ ID NO: 17555 - RNA, 1410 nt, Artificial Sequence; identical to SEQ ID NO: 17503
  derived and/or modified CDS sequence (AUadapt) from InfluenzaA__ABG47942__NA

SEQ ID NO: 17556 - RNA, 1410 nt, Artificial Sequence
  derived and/or modified CDS sequence (AUadapt) from InfluenzaA__ABG47953__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccuccaaccaggugaugcucugcgagcccacgaucaucgagcgcaacaucaccgagaucgucuaccugaccaacaccacgaucgagaaggagaucugccccaagcuggcggaguaccggaacuggagcaagccgcagugcaagaucaccggguucgcccccuucuccaaggacaacucgauccgccucuccgccggcggggacaucugggugacccgggagcccuacgugagcugcgaccccggcaagugcuaccaguucgcccuggggcagggcaccacgcugaacaaccgccacuccaacgacaccguccacgaccggaccccguaccgcacccuccugaugaacgagcugggcgugcccuuccaccucgggacgaagcaggucugcaucgccuggucguccagcuccugccacgacggcaaggcguggcugcacgugugcgugaccgggcacgacgagaacgccaccgccucguucaucuacgacggccggcugguggacuccaucgggagcugguccaagaacauccuccgcacccaggagucggagugcgucugcaucaacggcacgugcaccguggugaugaccgacggcuccgccagcgagcgggcggacaccaagauccuguucaucgaggaggggaagaucguccacaucucgccccuguccggcagcgcccagcacguggaggagugcuccugcuacccccgcuacccgggggugcggugcgucugccgcgacaacuggaagggcucgaaccggcccaucguggacaucaacgugaaggacuacuccaucgucagcuccuacgugugcucgggccucgugggggacacgccccgcaagaacgacuccagcuccucguccuacugccggaaccccaacaacgagaagggcagccacggggucaagggcugggccuucgacgacgggaacgacguguggaugggccgcaccaucuccgaggagcugcggucgggcuacgagaccuucaaggucaucgggggcugguccaagccgaacagcaagcugcagaucaaccgccaggugaucguggaccgggggaaccgcuccggcuacucggggaucuucagcgucgagggcaaguccugcaucaaccggugcuucuacguggagcucauccgcggccgcaagcaggagaccgaggugugguggacgucgaacuccaucgucguguucugcgggaccagcggcaccuacgggaccggcuccuggcccgacggggccaacaucaaccugaugcccaucuga

SEQ ID NO: 17557 - RNA, 1410 nt, Artificial Sequence
  derived and/or modified CDS sequence (AUadapt) from InfluenzaA__ABG47964__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccucguccagcugccacgacggcaaggcguggcugcacgugugcgugaccgggcacgacgagaacgccaccgccuccuucaucuacgacggccggcugguggacucgaucggguccuggucgaagaacauccuccgcacccaggaguccgagugcgucugcaucaacggcacgugcaccguggugaugaccgacggcagcgccuccgagcgggcggacaccaagauccuguucaucgaggaggggaagaucguccacaucucgccccugagcggcuccgcccagcacguggaggagugcucgugcuacccccgcuacccgggggugcggugcgucugccgcgacaacuggaagggcuccaaccggcccaucguggacaucaacgugaaggacuacagcaucgucuccucguacgugugcuccggccucgugggggacacgccccgcaagaacgacagcuccucguccucguacugccagaaccccaacaacgagaagggcucccacggggucaagggcugggccuucgacgacgggaacgacguguggaugggccggaccaucagcgaggagcugcgcuccggcuacgagaccuucaaggucaucgggggcuggucgaagccgaacuccaagcugcagaucaaccgccaggugaucguggaccgggggaaccggagcggcuacuccgggaucuucucggucgagggcaagagcugcaucaaccgcugcuucuacguggagcucauccggggccgcaagcaggagaccgaggugugguggacguccaacucgaucgucguguucugcgggaccuccggcaccuacgggaccggcagcuggcccgacggggccgacaucaaccugaugcccaucuga

SEQ ID NO: 17558 - RNA, 1410 nt, Artificial Sequence
  derived and/or modified CDS sequence (AUadapt) from InfluenzaA__ABG47975__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccuccaaccaggugaugcucugcgagcccacgaucaucgagcgcaacaucaccgagaucgucuaccugaccaacaccacgaucgagaaggagaucugccccaagcuggcggaguaccggaacuggagcaagccgcagugcaagaucaccggguucgcccccuucuccaaggacaacucgauccgccucuccgccggcggggacaucugggugacccgggagcccuacgugagcugcgaccccggcaagugcuaccaguucgcccuggggcagggcaccacgcugaacaaccgccacuccaacgacaccguccacgaccggaccccguaccgcacccuccugaugaacgagcugggcgugcccuuccaccucgggacgaagcaggucugcaucgccuggucguccagcuccugccacgacggcaaggcguggcugcacgugugcgugaccgggcacgacgagaacgccaccgccucguucaucuacgacggccggcugguggacuccaucgggagcugguccaagaacauccuccgcacccaggagucggagugcgucugcaucaacggcacgugcaccguggugaugaccgacggcuccgccagcgagcgggcggacaccaagauccuguucaucgaggaggggaagaucguccacaucucgccccuguccggcagcgcccagcacguggaggagugcuccugcuacccccgcuacccgggggugcggugcgucugccgcgacaacuggaagggcucgaaccggcccaucguggacaucaacgugaaggacuacuccaucgucagcuccuacgugugcucgggccucgugggggacacgccccgcaagaacgacuccagcuccucguccuacugccgggaccccaacaacgagcgcggcagccacggggucaagggcugggccuucgacgacgggaacgacguguggaugggccggaccaucuccgaggagcugcgcucgggcuacgagaccuucaaggucaucgggggcugguccaagccgaacagcaagcugcagaucaaccgccaggugaucguggaccgggggaaccgguccggcuacucggggaucuucagcgucgagggcaaguccugcaucaaccgcugcuucuacguggagcucauccgcggccggaagcaggagaccgaggugugguggacgucgaacuccaucgucguguucugcgggaccagcggcaccuacgggaccggcuccuggcccgacggggccgacaucaaccugaugcccaucuga

SEQ ID NO: 17559 - RNA, 1410 nt, Artificial Sequence
  derived and/or modified CDS sequence (AUadapt) from InfluenzaA__ABG47986__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccuccaaccaggugaugcucugcgagcccacgaucaucgagcgcaacaucaccgagaucgucuaccugaccaacaccacgaucgagaaggagaucugccccaagcuggcggaguaccggaacuggagcaagccgcagugcaagaucaccggguucgcccccuucuccaaggacaacucgauccgccucuccgccggcggggacaucugggugacccgggagcccuacgugagcugcgaccccggcaagugcuaccaguucgcccuggggcagggcaccacgcugaacaaccgccacuccaacgacaccguccacgaccggaccccguaccgcacccuccugaugaacgagcugggcgugcccuuccaccucgggacgaagcaggucugcaucgccuggucguccagcuccugccacgacggcaaggcguggcugcacgugugcgugaccgggcacgacgagaacgccaccgccucguucaucuacgacggccggcugguggacuccaucgggagcugguccaagaacauccuccgcacccaggagucggagugcgucugcaucaacggcacgugcaccguggugaugaccgacggcuccgccagcgagcgggcggacaccaagauccuguucaucgaggaggggaagaucguccacaucucgccccuguccggcagcgcccagcacguggaggagugcuccugcuacccccgcuacccgggggugcggugcgucugccgcgacaacuggaagggcucgaaccggcccaucguggacaucaacgugaaggacuacuccaucgucagcuccuacgugugcucgggccucgugggggacacgccccgcaagaacgacuccagcuccucguccuacugccggaagcccaacaacgagaagggcagccacggggucaagggcugggccuucgacgacgggaacgacguguggaugggccgcaccaucuccgaggagcugcggucgggcuacgagaccuucaaggucaucgggggcugguccaagccgaacagcaagcugcagaucaaccgccaggugaucguggaccgggggaaccgcuccggcuacucggggaucuucagcgucgagggcaaguccugcaucaaccggugcuucuacguggagcucauccgcggccgcaagcaggagaccgaggugugguggacgucgaacuccaucgucguguucugcgggaccagcggcaccuacgggaccggcuccuggcccgacggggccgacaucaaccugaugcccaucuga

SEQ ID NO: 17560 - RNA, 1410 nt, Artificial Sequence; identical to SEQ ID NO: 17503
  derived and/or modified CDS sequence (AUadapt) from InfluenzaA__ABG47997__NA

SEQ ID NO: 17561 - RNA, 1410 nt, Artificial Sequence
  derived and/or modified CDS sequence (AUadapt) from InfluenzaA__ABG48008__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccuccaaccaggugaugcucugcgagcccacgaucaucgagcgcaacaucaccgagaucgucuaccugaccaacaccacgaucgagaaggagaucugccccaagcuggcggaguaccggaacuggagcaagccgcagugcaagaucaccggguucgcccccuucuccaaggacaacucgauccgccucuccgccggcggggacaucugggugacccgggagcccuacgugagcugcgaccccggcaagugcuaccaguucgcccuggggcagggcaccacgcugaacaaccgccacuccaacgacaccguccacgaccggaccccguaccgcacccuccugaugaacgagcugggcgugcccuuccaccucgggacgaagcaggucugcaucgccuggucguccagcuccugccacgacggcaaggcguggcugcacgugugcgugaccgggcacgacgagaacgccaccgccucguucaucuacgacggccggcugguggacuccaucgggagcugguccaagaacauccuccgcacccaggagucggagugcgucugcaucaacggcacgugcaccguggugaugaccgacggcuccgccagcgagcgggcggacaccaagauccuguucaucgaggaggggaagaucguccacaucucgccccuguccggcagcgcccagcacguggaggagugcuccugcuacccccgcuacccgggggugcggugcgucugccgcgacaacuggaagggcucgaaccggcccaucguggacaucaacgugaaggacuacuccaucgucagcuccuacgugugcucgggccucgugggggacacgccccgccggaacgacuccagcuccucguccuacugccgcaagcccaacaacgagaagggcagccacggggucaagggcugggccuucgacgacgggaacgacguguggaugggccggaccaucuccgaggagcugcgcucgggcuacgagaccuucaaggucaucgggggcugguccaagccgaacagcaagcugcagaucaaccgccaggugaucguggaccgggggaaccgguccggcuacucggggaucuucagcgucgagggcaaguccugcaucaaccgcugcuucuacguggagcucauccgcggccggaagcaggagaccgaggugugguggacgucgaacuccaucgucguguucugcgggaccagcggcaccuacgggaccggcuccuggcccgacggggccgacaucaaccugaugcccaucuga

SEQ ID NO: 17562 - RNA, 1410 nt, Artificial Sequence
  derived and/or modified CDS sequence (AUadapt) from InfluenzaA__ABG48019__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccuccaaccaggugaugcucugcgagcccacgaucaucgagcgcaacaucaccgagaucgucuaccugaccaacaccacgaucgagaaggagaucugccccaagcuggcggaguaccggaacuggagcaagccgcagugcaagaucaccggguucgcccccuucuccaaggacaacucgauccgccucuccgccggcggggacaucugggugacccgggagcccuacgugagcugcgaccccggcaagugcuaccaguucgcccuggggcagggcaccacgcugaacaaccgccacuccaacgacaccguccacgaccggaccccguaccgcacccuccugaugaacgagcugggcgugcccuuccaccucgggacgaagcaggucugcaucgccuggucguccagcuccugccacgacggcaaggcguggcugcacgugugcgugaccgggcacgacgagaacgccaccgccucguucaucuacgacggccggcugguggacuccaucgggucgugguccaagaacauccuccgcacccaggagagcgagugcgucugcaucaacggcacgugcaccguggugaugaccgacggcuccgccucggagcgggcggacaccaagauccuguucaucgaggaggggaagaucguccacaucagcccccuguccggcucggcccagcacguggaggagugcuccugcuacccccgcuacccgggggugcggugcgccugccgcgacaacuggaagggcagcaaccggcccaucgucgacaucaacgugaaggacuacuccaucgugucguccuacgucugcagcggccucgugggggacacgccccgcaagaacgacuccucguccucguccuacugccggaaccccaacaacgagaagggcagccacggggugaagggcugggccuucgacgacgggaacgacgucuggaugggccgcaccaucuccgaggagcugcggucgggcuacgagaccuucaaggugaucgggggcugguccaagccgaacagcaagcugcagaucaaccgccaggucaucguggaccgggacaaccgcuccggguacucgggcaucuucagcguggaggggaaguccugcaucaaccggugcuucuacgucgagcucauccgcggccgcaagcaggagaccgaggugugguggacgucgaacuccaucguggucuucugcggcaccagcgggaccuacggcaccggguccuggcccgacggcgccgacaucaaccugaugcccaucuga

SEQ ID NO: 17563 - RNA, 1410 nt, Artificial Sequence; identical to SEQ ID NO: 17503
  derived and/or modified CDS sequence (AUadapt) from InfluenzaA__ABG48030__NA

SEQ ID NO: 17564 - RNA, 1410 nt, Artificial Sequence; identical to SEQ ID NO: 17503
  derived and/or modified CDS sequence (AUadapt) from InfluenzaA__ABG48041__NA

SEQ ID NO: 17565 - RNA, 1413 nt, Artificial Sequence; identical to SEQ ID NO: 17230
  derived and/or modified CDS sequence (AUadapt) from InfluenzaA__ABG48052__NA

SEQ ID NO: 17566 - RNA, 1410 nt, Artificial Sequence; identical to SEQ ID NO: 17132
  derived and/or modified CDS sequence (AUadapt) from InfluenzaA__ABG48063__NA

SEQ ID NO: 17567 - RNA, 1410 nt, Artificial Sequence; identical to SEQ ID NO: 17255
  derived and/or modified CDS sequence (AUadapt) from InfluenzaA__ABG48074__NA

SEQ ID NO: 17568 - RNA, 1410 nt, Artificial Sequence; identical to SEQ ID NO: 16556
  derived and/or modified CDS sequence (AUadapt) from InfluenzaA__ABG48085__NA

SEQ ID NO: 17569 - RNA, 1410 nt, Artificial Sequence
  derived and/or modified CDS sequence (AUadapt) from InfluenzaA__ABG48107__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccucgugccacgacggcaaggcguggcugcacgucugcgugaccggggacgacgagaacgccaccgccuccuucaucuacaacggccggcugguggacagcaucggguccuggucgaagaagacccuccgcacgcaggaguccgagugcgucugcaucaacgggaccugcaccguggugaugaccgacggcagcgccuccgggaaggcggacacgaagauccuguucaucgaggagggcaagaucguccacaucucgacccugagcggguccgcccagcacguggaggagugcucgugcuacccccgguaccccggcgugcgcugcgucugccgggacaacuggaagggcuccaaccgcccgaucguggacaucaacgugaaggacuacucgaucgucuccagcuacgugugcuccgggcucgugggcgacacgccccggaagaacgacucguucuccagcucccacugccuggaccccaacaacgaggagggcggccacggggucaagggcugggccuucgacgacggcaacgacguguggauggggcgcaccaucucggagaagcugcgguccggcuacgagaccuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaaggaggagaccgaggugugguggaccagcaacucgaucgucguguucugcggcaccuccgggacguacggcaccgggagcuggccggacggcgccgacaucaaccugaugcccaucuga

SEQ ID NO: 17570 - RNA, 1410 nt, Artificial Sequence; identical to SEQ ID NO: 16568
  derived and/or modified CDS sequence (AUadapt) from InfluenzaA__ABG48118__NA

SEQ ID NO: 17571 - RNA, 1410 nt, Artificial Sequence; identical to SEQ ID NO: 16568
  derived and/or modified CDS sequence (AUadapt) from InfluenzaA__ABG48129__NA

SEQ ID NO: 17572 - RNA, 1410 nt, Artificial Sequence; identical to SEQ ID NO: 16556
  derived and/or modified CDS sequence (AUadapt) from InfluenzaA__ABG48140__NA

SEQ ID NO: 17573 - RNA, 1410 nt, Artificial Sequence; identical to SEQ ID NO: 16568
  derived and/or modified CDS sequence (AUadapt) from InfluenzaA__ABG48151__NA

SEQ ID NO: 17574 - RNA, 1410 nt, Artificial Sequence; identical to SEQ ID NO: 16556
  derived and/or modified CDS sequence (AUadapt) from InfluenzaA__ABG48173__NA

SEQ ID NO: 17575 - RNA, 1410 nt, Artificial Sequence; identical to SEQ ID NO: 16568
  derived and/or modified CDS sequence (AUadapt) from InfluenzaA__ABG48184__NA

SEQ ID NO: 17576 - RNA, 1410 nt, Artificial Sequence
  derived and/or modified CDS sequence (AUadapt) from InfluenzaA__ABG48195__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccucgugccacgacggcaaggcguggcugcacgucugcgugaccggggacgacgagaacgccaccgccuccuucaucuacaacggccggcugguggacagcaucggguccuggucgaagaagauccuccgcacccaggaguccgagugcgucugcaucaacggcacgugcaccguggugaugaccgacggcagcgccuccgggaaggcggacaccaagauccuguucaucgaggagggcaagaucguccacaucucgacgcugagcggguccgcccagcacguggaggagugcucgugcuacccccgguaccccggcgugcgcugcgucugccgggacaacuggaagggcuccaaccgcccgaucguggacaucaacgugaaggacuacucgaucgucuccagcuacgugugcuccgggcucgugggcgacacgccccggaagaacgacucguucuccagcucccacugcaucgaccccaacaacgaggagggcgggcacggggucaagggcugggccuucgacgacggcaacgacguguggauggggcgcaccaucucggagaagcugcgguccggcuacgagaccuucaaggucaucgagggguggucgaagcccaacuccaagcugcagaccaaccgccaggugaucguggagcggggcaaccgcagcggguacuccggcaucuucucggucgagggcaaguccugcaucaaccggugcuucuacguggagcucauccgcgggcggaaggaggagaccgaggugugguggaccagcaacucgaucgucguguucugcggcaccuccgggacguacggcaccgggagcuggccggacggcgccgacaucaaccugaugcccaucuga

SEQ ID NO: 17577 - RNA, 1410 nt, Artificial Sequence
  derived and/or modified CDS sequence (AUadapt) from InfluenzaA__ABG48206__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucgagcgcaacaucaccgagaucgucuaccugaccaacaccacgaucgagaaggagaucugccccaagcugguggaguaccggaacugguccaagccgcagugcaacaucaccggguucgcgcccuucagcaaggacaacuccauccgccucucggccggcggggacaucugggugacccgggagcccuacgucuccugcgaccccgacaagugcuaccaguucgcccugggccaggggaccacgcugaacaacggccacagcaacgacaccgugcacgaccgcaccccguaccggacccuccugaugaacgagcugggcgugcccuuccaccucgggacgcgccaggucugcaucgccugguccucguccagcugccacgacggcaaggccuggcugcacgugugcgugaccggggacgacaagaacgcgaccgccuccuucaucuacaacggccggcuggucgacucgaucggguccuggucgaagaagauccuccgcacccaggaguccgagugcgugugcaucaacggcacgugcaccguggucaugaccgacggcagcgccuccgggaaggccgacaccaagauccuguucaucgaggagggcaagaucgugcacaucucgacgcugagcggguccgcgcagcacguggaggagugcucgugcuacccccgguaccccggcguccgcugcgugugccgggacaacuggaagggcuccaaccgcccgaucguggacaucaacgucaaggacuacagcaucguguccucguacgugugcuccgggcucgucggcgacacgccccggaagaacgacucguucuccagcucccacugccuggaccccaacaacgaggagggcgggcacggggugaagggcugggccuucgacgacggcaacgacgucuggauggggcgcaccaucaacgagaagcugcggucgggcuacgagaccuucaaggugaucgaggggugguccaagcccaacagcaagcuccagaucaaccgccaggugaucgucgagcggggcaaccgcuccggguacucgggcaucuucuccguggagggcaagagcugcaucaaccggugcuucuacguggagcugauccgcgggcggaaggaggagaccgaggucugguggaccuccaacucgaucgugguguucugcggcaccagcgggaccuacggcacgggguccuggccggacggcgccgacaucaaccugaugcccaucuga

SEQ ID NO: 17578 - RNA, 1410 nt, Artificial Sequence; identical to SEQ ID NO: 16993
  derived and/or modified CDS sequence (AUadapt) from InfluenzaA__ABG48217__NA

SEQ ID NO: 17579 - RNA, 1410 nt, Artificial Sequence; identical to SEQ ID NO: 16993
  derived and/or modified CDS sequence (AUadapt) from InfluenzaA__ABG48228__NA

SEQ ID NO: 17580 - RNA, 1410 nt, Artificial Sequence; identical to SEQ ID NO: 17577
  derived and/or modified CDS sequence (AUadapt) from InfluenzaA__ABG48239__NA

SEQ ID NO: 17581 - RNA, 1410 nt, Artificial Sequence; identical to SEQ ID NO: 16993
  derived and/or modified CDS sequence (AUadapt) from InfluenzaA__ABG48250__NA

SEQ ID NO: 17582 - RNA, 1410 nt, Artificial Sequence
  derived and/or modified CDS sequence (AUadapt) from InfluenzaA__ABG48272__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaagaagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagucccgcagcggcuacgagaccuucaaggucaucgaggggugguccaaccccaacucgaagcugcagaucaaccgccaggugaucguggaccggggcaaccgguccggguacagcggcaucuucucggucgaggggaaguccugcaucaaccgcugcuucuacguggagcugauccggggccgcaaggaggagaccgaggugcucuggaccagcaacuccaucgucguguucugcggcaccagcgggacguacggcaccggguccuggccggacggcgccgacaucaaccugaugcccaucuga

SEQ ID NO: 17583 - RNA, 1410 nt, Artificial Sequence
  derived and/or modified CDS sequence (AUadapt) from InfluenzaA__ABG48294__NA
augaaccccaaccagaagaucaucaccaucggcucggugucccugaccaucgccacgaucugcuuccucaugcagaucgccauccuggucaccaccgugacccugcacuucaagcaguacgagugcagcuccccgcccaacaaccaggugauccccugccagcccacgaucaucgagcgcaacaucaccgagaucgucuaccucaccaacaccacgaucgagaaggagaucugcccgaagcugguggaguaccggaacuggucgaagccccagugcaagaucaccggguucgcgcccuucuccaaggacaacagcauccgccuguccgccggcggggacaucugggugacccgggagcccuacgucucgugcgacccgggcaagugcuaccaguucgcccucgggcagggcaccacgcugaacaaccgccacuccaacgacaccgugcacgaccggacccccuaccgcacccugcucaugaacgagcugggcgugcccuuccaccuggggacgaagcaggucugcaucgccuggagcuccucguccugccacgacggcaaggccuggcuccacgugugcgugaccgggcacgacgagaacgcgaccgccagcuucaucuacgacggccggcuggucgacuccaucgggucguggucccgcaacauccugcggacccaggagagcgagugcgugugcaucaacggcacgugcaccguggucaugaccgacggcuccgccucggagcgcgccgacaccaagauccucuucaucgaggaggggaagguggugcacaucagcccccuguccggcucggcgcagcacgucgaggagugcuccugcuacccgcgguaccccggggugcgcugcgugugccgggacaacuggaagggcagcaaccgccccaucgucgacaucaacgugaaggacuacuccaucaucucguccuacgugugcagcggccuggucggggacacgccccggcgcaacgacuccucguccagcuccuacugccagaacccgaacaacgagaagggcucgcacggggugaagggcugggccuucgacgacgggaacgacgucuggaugggccggaccaucuccgaggagcuccgcagcggcuacgagaccuucaaggugaucgggggcugguccacccccaacucgaagcugcagaucaaccgccaggugaucgucgacuccgggaaccggagcggcuacucggggaucuucuccguggagggcaagagcugcaucaaccggugcuucuacguggagcugauccgcggccgcaagcaggagacgaaggucugguggaccuccaacucgaucgugguguucugcgggaccuccggcaccuacgggacgggcagcuggcccgacggggccgacaucgaccucaugcccaucuga

SEQ ID NO: 17584 - RNA, 1410 nt, Artificial Sequence
  derived and/or modified CDS sequence (AUadapt) from InfluenzaA__ABG48305__NA
augaaccccaaccagaagaucaucaucaucggcucggugucccugaccaucgccaccaucugcuuccucaugcagaucgccauccuggucacgaccgugacccugcacuucaagcaguacgagugcaacucgccgcccaacaaccaggugaugcucugcgagcccaccaucaucgagcgcaacaucacggagaucgucuaccugaccaacaccaccaucgagaaggagaucugccccaagcuggcggaguaccggaacugguccaagccgcagugcaagaucacgggguucgcccccuucagcaaggacaacuccauccgccucucggccggcggggacaucugggugacccgggagcccuacguguccugcgaccccggcaagugcuaccaguucgcccuggggcagggcaccacccugaacaaccgccacagcaacgacacgguccacgaccggaccccguaccgcacccuccugaugaacgagcugggcgugcccuuccaccucgggaccaagcaggucugcaucgccugguccucguccagcugccacgacggcaaggcguggcugcacgugugcgugacggggcacgacgagaacgccaccgccuccuucaucuacgacggccggcugguggacucgaucggguccuggagcaagaacauccuccgcacccaggaguccgagugcgucugcaucaacgggaccugcacgguggugaugaccgacggcucggccuccgagcgggcggacaccaagauccuguucaucgaggagggcaagaucguccacaucagcccccugucgggcuccgcccagcacguggaggagugcagcugcuacccccgcuacccgggggugcggugcgucugccgcgacaacuggaagggcuccaaccggcccaucguggacaucaacgugaaggacuacucgaucgucuccagcuacgugugcuccggccucgugggggacacgccccgcaagaacgacucguccagcuccucguacugccggaaccccaacaacgagaagggcucccacggggucaagggcugggccuucgacgacgggaacgacguguggaugggccgcaccaucagcgaggagcugcgguccggcuacgagaccuucaaggucaucgggggcuggucgaagccgaacuccaagcugcagaucaaccgccaggugaucguggaccgggggaaccgcagcggcuacuccgggaucuucucggucgagggcaagagcugcaucaaccggugcuucuacguggagcucauccgcggccgcaagcaggagaccgaggugugguggaccuccaacucgaucgucguguucugcgggacguccggcaccuacgggaccggcagcuggcccgacggggccgacaucaaccugaugcccaucuga

SEQ ID NO: 17585 - RNA, 1410 nt, Artificial Sequence
  derived and/or modified CDS sequence (AUadapt) from InfluenzaA__ABG48316__NA
augaaccccaaccagaagaucaucaccaucggcucggugucccugaccgucgccacgaucugcuuccucaugcagaucgccauccuggugaccaccgugacccugcacuucaagcaguacgagugcaacucgccgcccaacaaccaggucaugcucugcgagcccacgaucaucgagcgcaacaucaccgagaucguguaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacgucuccugcgaccccggcaagugcuaccaguucgcccuggggcagggcaccacgcugaacaaccgccacagcaacgacaccgugcacgaccggaccccguaccgcacccuccugaugaacgagcugggcgugcccuuccaccucgggacgaagcaggucugcaucgccugguccucguccagcugccacgacggcaaggcguggcugcacgugugcgugaccgggcacgacgagaacgccaccgccuccuucaucuacgacggccggcuggucgacucgaucggguccuggucgaagaacauccuccgcacccaggaguccgagugcgugugcaucaacggcacgugcaccguggucaugaccgacggcagcgccuccgagcgggcggacaccaagauccuguucaucgaggaggggaagaucgugcacaucucgccccugagcggcuccgcccagcacguggaggagugcucgugcuacccccgcuacccggggguccggugcgugugccgcgacaacuggaagggcuccaaccggcccaucguggacaucaacgucaaggacuacagcaucguguccucguacgugugcuccggccucgucggggacacgccccgcaagaacgacagcuccucguccucguacugccggaaccccaacaacgagaagggcucccacggggugaagggcugggccuucgacgacgggaacgacgucuggaugggccgcaccaucagcgaggagcugcgguccggcuacgagaccuucaaggugaucgggggcuggucgaagccgaacuccaagcugcagaucaaccgccaggugaucgucgagcgggggaaccgcagcggcuacuccgggaucuucucgguggagggcaagagcugcaucaaccggugcuucuacguggagcucauccgcggccgcaagcaggagaccgaggucugguggacguccaacucgaucgugguguucugcgggaccuccggcaccuacgggaccggcagcuggcccgacggggccgacaucaaccugaugcccaucuga

SEQ ID NO: 17586 - RNA, 1410 nt, Artificial Sequence
  derived and/or modified CDS sequence (AUadapt) from InfluenzaA__ABG48327__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccucguccagcugccacgacggcaaggcguggcugcacgugugcgugaccgggcacgacgagaacgccaccgccuccuucaucuacgacggccggcugguggacucgaucggguccuggucgaagaacauccuccgcacccaggaguccgagugcgucugcaucaacggcacgugcaccguggugaugaccgacggcagcgccuccgagcgggcggacaccaagauccuguucaucgaggaggggaagaucguccacaucucgccccugagcggcuccgcccagcacguggaggagugcucgugcuacccccgcuacccgggggugcggugcgucugccgcgacaacuggaagggcuccaaccggcccaucguggacaucaacgugaaggacuacagcaucgucuccucguacgugugcuccggccucgugggggacacgccccgcaagaacgacagcuccucguccucguacugccggaaccccaacaacgagaagggcucccgcggggucaagggcugggccuucgacgacgggaacgacguguggaugggccggaccaucagcgaggagcugcgcuccggcuacgagaccuucaaggucaucgggggcuggucgaagccgaacuccaagcugcagaucaaccgccaggugaucguggaccgggggaaccggagcggcuacuccgggaucuucucggucgagggcaagagcugcaucaaccgcugcuucuacguggagcucauccgcggccggaagcaggagaccgaggugugguggacguccaacucgaucgucguguucugcgggaccuccggcaccuacgggaccggcagcuggcccgacggggccgacaucaaccugaugcccaucuga

SEQ ID NO: 17587 - RNA, 1410 nt, Artificial Sequence
  derived and/or modified CDS sequence (AUadapt) from InfluenzaA__ABG48338__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccucguccagcugccacgacggcaaggcguggcugcacgugugcgugaccgggcacgacgagaacgccaccgccuccuucaucuacgacggccggcugguggacucgaucggguccuggucgaagaacauccuccgcacccaggaguccgagugcgucugcaucaacggcacgugcaccguggugaugaccgacggcagcgccuccgagcgggcggacaccaagauccuguucaucgaggaggggaagaucguccacaucucgccccugagcggcuccgcccagcacguggaggagugcucgugcuacccccgcuacccgggggugcggugcgucugccgcgacaacuggaagggcuccaaccggcccaucguggacaucaacgugaaggacuacagcaucgucuccucguacgugugcuccggccucgugggggacacgccccgcaagaacgacagcuccucguccucguacugccggaaccccaacaacgagaagggcucccacggggucaagggcugggccuucgacgacgggaacgacguguggaugggccgcaccaucagcgaggagcugcgguccggcuacgagaccuucaaggucaucgggggcuggucgaagccgaacuccaagcugcagaucaaccgccaggugaucguggaccgggggaaccgcagcggcuacuccgggaucuucucggucgagggcaagagcugcaucaaccggugcuucuacguggagcucauccgcggccgcaagcaggagaccgaggugugguggacguccaacucgaucgucguguucugcgggaccuccggcaccuacgggaccggcagcuggcccgacggggccgacaucaaccugaugcccaucuga

SEQ ID NO: 17588 - RNA, 1410 nt, Artificial Sequence; identical to SEQ ID NO: 17587
  derived and/or modified CDS sequence (AUadapt) from InfluenzaA__ABG48349__NA

SEQ ID NO: 17589 - RNA, 1410 nt, Artificial Sequence
  derived and/or modified CDS sequence (AUadapt) from InfluenzaA__ABG48360__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugauguccgagcugggcgugcccuuccaccucgggacgaagcaggucugcaucgccuggucguccagcuccugccacgacggcaaggcguggcugcacgugugcgugaccgggcacgacgagaacgccaccgccucguucaucuacgacggcaagcugguggacuccaucgggucgugguccaagaacauccuccggacccaggagagcgagugcgucugcaucaacggcacgugcaccguggugaugaccgacggcuccgccucggagcgcgcggacaccaagauccuguucaucgaggaggggaagaucguccacaucagcccccuguccggcucggcccagcacguggaggagugcuccugcuacccccgguacccgggggugcgcugcgucugccgggacaacuggaagggcagcaaccgccccaucguggacaucaacgugaaggaccacuccaucgucucguccuacgugugcagcggccucgugggggacacgccccggaagaacgacuccucguccucguccuacugccgcaaccccaacaacgagaagggcagccacggggucaagggcugggccuucgacgacgggaacgacguguggaugggccggaccaucuccgaggagcugcgcucgggcuacgagaccuucaaggucaucgggggcugguccaagccgaacagcaagcugcagaucaaccgccaggugaucguggaccgggggaaccgguccggcuacucggggaucuucagcgucgagggcaaguccugcaucaaccgcugcuucuacguggagcucauccggggccgcaagcaggagaccgaggugugguggacgucgaacuccaucgucguguucugcgggaccagcggcaccuacgggaccggcuccuggcccgacggggccgacaucaaccugaugcccaucuga

SEQ ID NO: 17590 - RNA, 1410 nt, Artificial Sequence; identical to SEQ ID NO: 17587
  derived and/or modified CDS sequence (AUadapt) from InfluenzaA__ABG48371__NA

SEQ ID NO: 17591 - RNA, 1410 nt, Artificial Sequence
  derived and/or modified CDS sequence (AUadapt) from InfluenzaA__ABG67138__NA
augaaccccaaccagaagaucaucaccaucggcucggugucccugaccaucgccacgaucugcuuccucacccagaucgccauccuggucaccaccgugacgcugcacuucaagcaguacgagugcaacucgccgcccuccaaccaggugaugcucugcgagcccaccaccaucgagcgcaacaucaccgagaucgucuaccugacgaacaccaccaucgagaaggagaucugccccaagcuggcggaguaccggaacuggagcaagccgcagugcaagaucaccggguucgcccccuucuccaaggacaacucgauccgccucuccgccggcggggacaucugggugacgcgggagcccuacgugucgugcgaccccgacaagugcuaccaguucgcccugggccaggggaccacccugaacaaccgccacuccaacgacaccguccacgaccggacgccguaccgcacccuccugaugaacgagcugggcgugcccuuccaccucggcaccaagcaggucugcaucgccuggagcuccucguccugccacgacgggaaggcguggcugcacgugugcgugaccggccacgacgagaacgccacggccucguucaucuacgacgggcggcugguggacuccaucggcagcugguccaagaagauccuccgcacccaggagucggagugcgucugcaucaacgggaccugcaccguggugaugacggacggcuccgccucgggccgggcggacaccaagauccuguucaucgaggaggggaagaucguccacaucagcccccuguccggcucggcccagcacguggaggagugcuccugcuacccccgcuacccgggggugcggugcgucugccgcgacaacuggaagggcagcaaccggcccaucguggacaucaacgugaaggacuacuccaucgucucguccuacgugugcucgggccucgugggggacacgccccgcaagaacgacuccagcuccucgucccacugccugaaccccaacaacgaggagggcgggcacggcgucaaggggugggccuucgacgacggcaacgacguguggaugggccggaccaucucggagaagcugcgcuccggguacgagaccuucaaggucaucgagggcuggagcaagccgaacuccaagcuccagaucaaccgccaggugaucguggaccgggggaaccggucgggcuacuccgggaucuucucggucgagggcaagagcugcaucaaccgcugcuucuacguggagcugauccggggccgcaagcaggagaccgaggugugguggaccuccaacucgaucgucguguucugcgggaccuccggcacguacgggaccggcagcuggcccgacggggccgacaucaaccugaugcccaucuga

SEQ ID NO: 17592 - RNA, 1410 nt, Artificial Sequence; identical to SEQ ID NO: 16528
  derived and/or modified CDS sequence (AUadapt) from InfluenzaA__ABG67149__NA

SEQ ID NO: 17593 - RNA, 1410 nt, Artificial Sequence
  derived and/or modified CDS sequence (AUadapt) from InfluenzaA__ABG67160__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccgguccuggagcaagccgcagugcaagaucaccggguucgcccccuucuccaaggacaacucgauccgccucuccgccggcggggacaucugggugacccgggagcccuacgugagcugcgaccccggcaagugcuaccaguucgcccuggggcagggcaccacgcugaacaaccgccacuccaacgacaccguccacgaccggaccccguaccgcacccuccugaugaacgagcugggcgugcccuuccaccucgggacgaagcaggucugcaucgccuggucguccagcuccugccacgacggcaaggcguggcugcacgugugcgugaccgggcacgacgagaacgccaccgccucguucaucuacgacggccggcugguggacuccaucgggagcugguccaagaacauccuccgcacccaggagucggagugcgucugcgugaacggcacgugcaccguggucaugaccgacggcuccgccagcgagcgggcggacaccaagauccuguucaucgaggaggggaagaucgugcacaucucgccccuguccggcagcgcccagcacguggaggagugcuccugcuacccccgcuacccggggguccggugcgugugccgcgacaacuggaagggcucgaaccggcccaucguggacaucaacgucaaggacuacuccaucgugagcuccuacgugugcucgggccucgucggggacacgccccgcaagaacgacuccagcuccucguccuacugcuggaaccccaacaacgagaagggcgggcacggcgugaaggggugggccuucgacgacggcaacgacgucuggaugggccggaccaucagcgaggagcugcgcuccggguacgagaccuucaaggugaucggcggguggucgaagccgaacuccaagcugcagaucaaccgccaggugaucgucgaccggggcaaccggagcggguacuccggcaucuucucgguggagggcaagagcugcaucaaccgcugcuucuacguggagcucauccgggggcgcaagcaggagaccgaggucugguggacguccaacucgaucgugguguucugcggcaccuccgggaccuacggcaccgggagcuggcccgacggcgccgacaucaaccugaugcccaucuga

SEQ ID NO: 17594 - RNA, 1410 nt, Artificial Sequence
  derived and/or modified CDS sequence (AUadapt) from InfluenzaA__ABG67171__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccucguccagcugccacgacggcaaggcguggcugcacgugugcgugaccgggcacgacaagaacgccaccgccuccuucaucuacgacggccggcugguggacucgaucggguccuggucgaagaacauccuccgcacccaggaguccgagugcgucugcaucaacggcacgugcaccguggugaugaccgacggcagcgccuccgaccgggcggacaccaagauccuguucaucgaggaggggaagaucguccacaucucgccccugagcggcuccgcccagcacguggaggagugcucgugcuacccccgcuacccgggggugcggugcgucugccgcgacaacuggaagggcuccaaccggcccaucguggacaucaacgugaaggacuacagcaucgucuccucguacgugugcuccggccucgugggggacacgccccgcaagaacgacagcuccucguccucguacugcuggaaccccaacaacgagaagggcgggcacggcgucaaggggugggccuucgacgacggcaacgacguguggaugggccggaccaucuccgaggagagccgcuccggguacgagaccuucaaggucaucggcggguggucgaagccgaacuccaagcugcagaucaaccgccaggugaucguggaccggggcaaccggagcggguacuccggcaucuucucggucgagggcaagagcugcaucaaccgcugcuucuacguggagcugauccgggggcgcaagcaggagaccgaggugugguggacguccaacucgaucgucguguucugcggcaccuccgggaccuacggcaccgggagcuggcccgacggcgccgacaucaaccucaugcccaucuga

SEQ ID NO: 17595 - RNA, 1410 nt, Artificial Sequence; identical to SEQ ID NO: 17515
  derived and/or modified CDS sequence (AUadapt) from InfluenzaA__ABG67182__NA

SEQ ID NO: 17596 - RNA, 1410 nt, Artificial Sequence
  derived and/or modified CDS sequence (AUadapt) from InfluenzaA__ABG67193__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaccaucgagcgcaacaucaccgagaucgucuaccugaccaacacgaccaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggcagggcacgacccugaacaaccgccacagcaacgacaccguccacgaccggaccccguaccgcacgcuccugaugaacgagcugggcgugcccuuccaccucgggaccaagcaggucugcaucgccugguccucguccucgugccacgacggcaaggcguggcugcacgugugcgugaccgggcacgacgagaacgccaccgccuccuucaucuacgacggccggcugguggacagcaucggguccuggucgaagaacauccuccgcacgcaggaguccgagugcgucugcaucaacgggaccugcaccguggugaugaccgacggcagcgccuccgaccgggcggacacgaagauccuguucaucgaggagggcaagaucguccacaucucgccccugucgggcuccgcccagcacguggaggagugcagcugcuacccccgcuacccgggggugcggugcgucugccgcgacaacuggaagggcuccaaccggcccaucguggacaucaacgugaagaacuacucgaucgucuccagcuacgugugcuccggccucgugggggacacgccccgcaagaacgacucguccucguccagcuacugcuggaaccccaacaacgagaagggcgggcacggcgucaaggggugggccuucgacgacggcaacgacguguggaugggccggaccaucuccgaggagucgcgcuccggguacgagaccuucaaggucaucggcggguggagcaagccgaacuccaagcugcagaucaaccgccaggugaucguggaccggggcaaccggucgggguacuccggcaucuucucggucgagggcaagagcugcaucaaccgcugcuucuacguggagcugauccgggggcgcaagcaggagaccgaggugugguggaccuccaacucgaucgucguguucugcggcaccuccgggaccuacggcacggggagcuggcccgacggcgccgacaucaaccucaugcccaucuga

SEQ ID NO: 17597 - RNA, 1410 nt, Artificial Sequence; identical to SEQ ID NO: 17515
  derived and/or modified CDS sequence (AUadapt) from InfluenzaA__ABG67204__NA

SEQ ID NO: 17598 - RNA, 1410 nt, Artificial Sequence
  derived and/or modified CDS sequence (AUadapt) from InfluenzaA__ABG67215__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccuccaaccaggugaugcucugcgagcccacgaucaucgagcgcaacaucaccgagaucgucuaccugaccaacaccacgaucgagaaggagaucugccccaagcuggcggaguaccggaacuggagcaagccgcagugcaagaucaccggguucgcccccuucuccaaggacaacucgauccgccucuccgccggcggggacaucugggugacccgggagcccuacgugagcugcggccccgggaagugcuaccaguucgcccugggccagggcaccacgcugaacaaccgccacuccaacgacaccguccacgaccggaccccguaccgcacccuccugaugaacgagcugggggugcccuuccaccucggcacgaagcaggucugcaucgccuggucguccagcuccugccacgacgggaaggcguggcugcacgugugcgugaccggccacgacgagaacgccaccgccucguucaucuacgacgggcggcugguggacuccaucggcagcugguccaagaacauccuccgcacccaggagucggagugcgucugcaucaacggcacgugcaccguggugaugaccgacggguccgccagcgagcgggcggacaccaagauccuguucaucgaggagggcaagaucguccacaucucgccccuguccgggagcgcccagcacguggaggagugcuccugcuacccccgcuacccgggcgugcggugcgucugccgcgacaacuggaagggcucgaaccggcccaucguggacaucaacgugaaggacuacuccaucgucagcuccuacgugugcucggggcucgugggcgacacgccccgcaagaacgacuccagcuccucguccuacugccggaaccccaacaacgagaaggggagccacggcgucaaggggugggccuucgacgacggcaacgacguguggaugggccgcaccaucuccgaggagcugcggucgggguacgagaccuucaaggucaucggcgggugguccaagccgaacagcaagcugcagaucaaccgccaggugaucguggaccggggcaaccgcuccggguacucgggcaucuucagcgucgagggcaaguccugcaucaaccggugcuucuacguggagcucauccgcgggcgcaagcaggagaccgaggugugguggacgucgaacuccaucgucguguucugcggcaccagcgggaccuacggcaccggguccuggcccgacggcgccgacaucaaccugaugcccaucuga

SEQ ID NO: 17599 - RNA, 1410 nt, Artificial Sequence; identical to SEQ ID NO: 17503
  derived and/or modified CDS sequence (AUadapt) from InfluenzaA__ABG67226__NA

SEQ ID NO: 17600 - RNA, 1410 nt, Artificial Sequence; identical to SEQ ID NO: 17503
  derived and/or modified CDS sequence (AUadapt) from InfluenzaA__ABG67248__NA

SEQ ID NO: 17601 - RNA, 1413 nt, Artificial Sequence; identical to SEQ ID NO: 17230
  derived and/or modified CDS sequence (AUadapt) from InfluenzaA__ABG67480__NA

SEQ ID NO: 17602 - RNA, 1413 nt, Artificial Sequence; identical to SEQ ID NO: 16798
  derived and/or modified CDS sequence (AUadapt) from InfluenzaA__ABG67494__NA

SEQ ID NO: 17603 - RNA, 1410 nt, Artificial Sequence; identical to SEQ ID NO: 16556
  derived and/or modified CDS sequence (AUadapt) from InfluenzaA__ABG67505__NA

SEQ ID NO: 17604 - RNA, 1410 nt, Artificial Sequence; identical to SEQ ID NO: 16556
  derived and/or modified CDS sequence (AUadapt) from InfluenzaA__ABG67516__NA

SEQ ID NO: 17605 - RNA, 1410 nt, Artificial Sequence; identical to SEQ ID NO: 17569
  derived and/or modified CDS sequence (AUadapt) from InfluenzaA__ABG67527__NA

SEQ ID NO: 17606 - RNA, 1410 nt, Artificial Sequence
  derived and/or modified CDS sequence (AUadapt) from InfluenzaA__ABG67538__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaccaucgagcgcaacaccaccgagaucgucuaccugacgaacaccaccaucgagaaggagaucugccccaagcuggcggaguaccggaacugguccaagccgcagugcaacaucaccggguucgcccccuucagcaaggacaacuccauccgccucucggccggcggggacaucugggugacgcgggagcccuacguguccugcgaccccgacaagugcuaccaguucgcccugggccaggggaccacccugaacaacggccacucgaacgacaccguccacgaccgcacgccguaccggacccuccugaugaacgagcugggcgugcccuuccaccucgggacccgccaggugugcaucgccugguccagcuccucgugccacgacggcaaggcguggcugcacgucugcgugaccggggacgacgagaacgccacggccuccuucaucuacaacggccggcugguggacucgaucggguccuggagcaagaagauccuccgcacccaggaguccgagugcgucugcaucaacgggaccugcaccguggugaugacggacggcucggccuccgggaaggcggacaccaagauccuguucaucgaggagggcaagaucguccacaucucgacccugagcggguccgcccagcacguggaggagugcucgugcuacccccgguaccccggcgugcgcugcgucugccgggacaacuggaagggcuccaaccgcccgaucaucgacaucaacgugaaggacuacucgaucguguccagcuacgucugcuccgggcucgugggcgacacgccccggaagaacgacucguucuccucgucccacugccuggaccccaacaacgaggagggcggccacggggugaagggcugggccuucgacgacggcaacgacgucuggauggggcgcaccaucagcgagaagcugcgguccggcuacgagaccuucaaggugaucgagggguggucgaagcccaacuccaagcuccagaccaaccgccaggucaucguggagcggggcaaccgcucgggguacuccggcaucuucagcguggagggcaaguccugcaucaaccggugcuucuacgucgagcugauccgcgggcggaaggaggagaccgaggugugguggacgucgaacucgaucguggucuucugcggcaccuccgggaccuacggcaccgggagcuggccggacggcgccgacaucaaccugaugcccaucuga

SEQ ID NO: 17607 - RNA, 1410 nt, Artificial Sequence
  derived and/or modified CDS sequence (AUadapt) from InfluenzaA__ABG67549__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucgagcgcaacaucaccgagaucgucuaccugaccaacaccacgaucgagaaggagaucugccccaagcugguggaguaccggaacugguccaagccgcagugcaacaucaccggguucgcgcccuucagcaaggacaacuccauccgccucucggccggcggggacaucugggugacccgggagcccuacgucuccugcgaccccgacaagugcuaccaguucgcccugggccaggggaccacgcugaacaacggccacagcaacgacaccgugcacgaccgcaccccguaccggacccuccugaugaacgagcugggcgugcccuuccaccucgggacgcgccaggucugcaucgccugguccucguccagcugccacgacggcaaggccuggcugcacgugugcgugaccggggacgacaagaacgcgaccgccuccuucaucuacaacggccggcuggucgacucgaucggguccuggagcaagaagauccuccgcacccaggaguccgagugcgugugcaucaacggcacgugcaccguggucaugaccgacggcucggccuccgggaaggccgacaccaagauccuguucaucgaggagggcaagaucgugcacaucagcacgcugucgggguccgcgcagcacguggaggagugcucgugcuacccccgguaccccggcguccgcugcgugugccgggacaacuggaagggcuccaaccgcccgaucguggacaucaacgucaaggacuacagcaucguguccucguacgugugcuccgggcucgucggcgacacgccccggaagaacgacagcuucuccucgucccacugccuggaccccaacaacgaggagggcgggcacggggugaagggcugggccuucgacgacggcaacgacgucuggauggggcgcaccaucagcgagaagcugcgguccggcuacgagaccuucaaggugaucgagggguggucgaagcccaacuccaagcuccagaucaaccgccaggugaucgucgagcggggcaaccgcagcggguacuccggcaucuucucgguggagggcaaguccugcaucaaccggugcuucuacguggagcugauccgcgggcggaaggaggagaacgaggucugguggaccagcaacucgaucgugguguucugcggcaccuccgggaccuacggcaccgggagcuggccggacggcgccgacaucaaccugaugcccaucuga

SEQ ID NO: 17608 - RNA, 1410 nt, Artificial Sequence; identical to SEQ ID NO: 16993
  derived and/or modified CDS sequence (AUadapt) from InfluenzaA__ABG67560__NA

SEQ ID NO: 17609 - RNA, 1410 nt, Artificial Sequence; identical to SEQ ID NO: 16993
  derived and/or modified CDS sequence (AUadapt) from InfluenzaA__ABG67571__NA

SEQ ID NO: 17610 - RNA, 1410 nt, Artificial Sequence
  derived and/or modified CDS sequence (AUadapt) from InfluenzaA__ABG67582__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucgagcgcaacaucaccgagaucgucuaccugaccaacaccacgaucgagaaggagaucugccccaagcugguggaguaccggaacugguccaagccgcagugcaacaucaccggguucgcgcccuucagcaaggacaacuccauccgccucucggccggcggggacaucugggugacccgggagcccuacgucuccugcgaccccgacaagugcuaccaguucgcccugggccaggggaccacgcugaacaacggccacagcaacgacaccgugcacgaccgcaccccguaccggacccuccugaugaacgagcugggcgugcccuuccaccucgggacgcgccaggucugcaucgccugguccucguccagcugccacgacggcaaggccuggcugcacgugugcgugaccggggacgacaagaacgcgaccgccuccuucaucuacaacggccggcuggucgacucgaucggguccuggagcaagaagauccuccgcacccaggaguccgagugcgugugcaucaacggcacgugcaccguggucaugaccgacggcucggccuccgggaaggccgacaccaagauccuguucaucgaggagggcaagaucgugcacaucagcacgcugucgggguccgcgaagcacguggaggagugcucgugcuacccccgguaccccggcguccgcugcgugugccgggacaacuggaagggcuccaaccgcccgaucguggacaucaacgucaaggacuacagcaucguguccucguacgugugcuccgggcucgucggcgacacgccccggaagaacgacagcuucuccucgucccacugccuggaccccaacaacgaggagggcgggcacggggugaagggcugggccuucgacgacggcaacgacgucuggauggggcgcaccaucagcgagaagcugcgguccggcuacgagaccuucaaggugaucgagggguggucgaagcccaacuccaagcuccagaucaaccgccaggugaucgucgagcggggcaaccgcagcggguacuccggcaucuucucgguggagggcaaguccugcaucaaccggugcuucuacguggagcugauccgcgggcggaaggaggagaccgaggucugguggaccagcaacucgaucgugguguucugcggcaccuccgggaccuacggcacggggagcuggccggacggcgccgacaucaaccugaugcccaucuga

SEQ ID NO: 17611 - RNA, 1410 nt, Artificial Sequence; identical to SEQ ID NO: 17577
  derived and/or modified CDS sequence (AUadapt) from InfluenzaA__ABG67593__NA

SEQ ID NO: 17612 - RNA, 1410 nt, Artificial Sequence; identical to SEQ ID NO: 16993
  derived and/or modified CDS sequence (AUadapt) from InfluenzaA__ABG67604__NA

SEQ ID NO: 17613 - RNA, 1410 nt, Artificial Sequence; identical to SEQ ID NO: 16993
  derived and/or modified CDS sequence (AUadapt) from InfluenzaA__ABG67615__NA

SEQ ID NO: 17614 - RNA, 1410 nt, Artificial Sequence; identical to SEQ ID NO: 16993
  derived and/or modified CDS sequence (AUadapt) from InfluenzaA__ABG67626__NA

SEQ ID NO: 17615 - RNA, 1410 nt, Artificial Sequence; identical to SEQ ID NO: 16993
  derived and/or modified CDS sequence (AUadapt) from InfluenzaA__ABG67637__NA

SEQ ID NO: 17616 - RNA, 1410 nt, Artificial Sequence; identical to SEQ ID NO: 16993
  derived and/or modified CDS sequence (AUadapt) from InfluenzaA__ABG67648__NA

SEQ ID NO: 17617 - RNA, 1410 nt, Artificial Sequence
  derived and/or modified CDS sequence (AUadapt) from InfluenzaA__ABG67659__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucgagcgcaacaucaccgagaucgucuaccugaccaacaccacgaucgagaaggagaucugccccaagcugguggaguaccggaacugguccaagccgcagugcaacaucaccggguucgcgcccuucagccgcgacaacuccauccggcucucggccggcggggacaucugggugacccgcgagcccuacgucuccugcgaccccgacaagugcuaccaguucgcccugggccaggggaccacgcugaacaacggccacagcaacgacaccgugcacgaccggaccccguaccgcacccuccugaugaacgagcugggcgugcccuuccaccucgggacgcggcaggucugcaucgccugguccucguccagcugccacgacggcaaggccuggcugcacgugugcgugaccggggacgacaagaacgcgaccgccuccuucaucuacaacggccgccuggucgacucgaucggguccuggagcaagaagauccuccggacccaggaguccgagugcgugugcaucaacggcacgugcaccguggucaugaccgacggcucggccuccgggaaggccgacaccaagauccuguucaucgaggagggcaagaucgugcacaucagcacgcugucgggguccgcgcagcacguggaggagugcucgugcuacccccgcuaccccggcguccggugcgugugccgcgacaacuggaagggcuccaaccggccgaucguggacaucaacgucaaggacuacagcaucguguccucguacgugugcuccgggcucgucggcgacacgccccgcaagaacgacagcuucuccucgucccacugccuggaccccaacaacgaggagggcgggcacggggugaagggcugggccuucgacgacggcaacgacgucuggauggggcggaccaucagcgagaagcugcgcuccggcuacgagaccuucaaggugaucgagggguggucgaagcccaacuccaagcuccagaucaaccgccaggugaucgucgagcggggcaaccggagcggguacuccggcaucuucucgguggagggcaaguccugcaucaaccgcugcuucuacguggagcugauccgggggcgcaaggaggagaccgaggucugguggaccagcaacucgaucgugguguucugcggcaccuccgggaccuacggcacggggagcuggccggacggcgccgacaucaaccugaugcccaucuga

SEQ ID NO: 17618 - RNA, 1410 nt, Artificial Sequence
  derived and/or modified CDS sequence (AUadapt) from InfluenzaA__ABG67670__NA
augaaccccaaccagaagaucaucaccaucggcucggugucccugaccaucgccacgaucugcuuccucaugcagaucgccauccugaucaccaccgucacccugcacuucaagcaguacgagugcaacucgccgcccaacaaccaggugaugcucugcgagcccacgaucaucgagcgcaacaucaccgagaucguguaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggucacccgggagcccuacguguccugcgaccccggcaagugcuaccaguucgcccuggggcagggcaccacgcugaacaaccgccacagcaacgacaccgugcacgaccggaccccguaccgcacccuccugaugaacgagcugggcguccccuuccaccucgggacgaagcaggucugcaucgccugguccucguccucgugccacgacggcaaggcguggcugcacgugugcgugaccgggcacgacgagaacgccaccgccuccuucaucuacgacggccggcugguggacagcaucggguccuggucgaagaacauccuccgcacccaggaguccgagugcgugugcaucaacggcacgugcaccgucgugaugaccgacggcagcgccuccgggcgggcggacaccaagauccuguucaucgaggagggcaagaucgugcacaucucgccccugagcggguccgcccagcacgucgaggagugcucgugcuacccccgcuacccgggcgugcggugcgugugccgcgacaacuggaagggcuccaaccggcccaucgucgacaucaacgugaaggacuacucgaucguguccagcuacgucugcuccgggcucgugggcgacacgccccgcaagaacgacucguccagcuccucgcacugccugaaccccaacaacgaggagggcgggcacggggugaagggcugggccuucgacgacggcaacgacgucuggauggggcggaccaucuccgagaagcugcgcucgggcuacgagaccuucaaggugaucgggggcugguccaagccgaacagcaagcuccagaucaaccggcaggucaucguggaccgcgggaaccgguccggcuacucgggcaucuucuccguggagggcaagagcugcaucaaccgcugcuucuacgucgagcugauccgggggcgcaagcaggagaccgaggugugguggacgucgaacuccaucguggucuucugcgggaccagcggcaccuacgggaccggcuccuggcccgacggcgccgacaucaaccugaugcccaucuga

SEQ ID NO: 17619 - RNA, 1410 nt, Artificial Sequence; identical to SEQ ID NO: 17132
  derived and/or modified CDS sequence (AUadapt) from InfluenzaA__ABG79944__NA

SEQ ID NO: 17620 - RNA, 1413 nt, Artificial Sequence; identical to SEQ ID NO: 17461
  derived and/or modified CDS sequence (AUadapt) from InfluenzaA__ABG79955__NA

SEQ ID NO: 17621 - RNA, 1410 nt, Artificial Sequence
  derived and/or modified CDS sequence (AUadapt) from InfluenzaA__ABG79966__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccuccaaccaggugaugcucugcgagcccacgaucaucgagcgcaacaucaccgagaucgucuaccugaccaacaccacgaucgagaaggagaucugccccaagcuggcggaguaccggaacuggagcaagccgcagugcaagaucaccggguucgcccccuucuccaaggacaacucgauccgccucuccgccggcggggacaucugggugacccgggagcccuacgugagcugcgaccccggcaagugcuaccaguucgcccuggggcagggcaccacgcugaacaaccgccacuccaacgacaccguccacgaccggaccccguaccgcacccuccugaugaacgagcugggcgugcccuuccaccucgggacgaagcaggucugcaucgccuggucguccagcuccugccacgacggcaaggcguggcugcacgugugcgugaccgggcacgacgagaacgccaccgccucguucaucuacgacggccggcugguggacuccaucgggagcugguccaagaacauccuccgcacccaggagucggagugcgucugcaucaacggcacgugcaccguggugaugaccgacggcuccgccagcgagcgggcggacaccaagauccuguucaucgaggaggggaagaucguccacaucucgccccuguccggcagcgcccagcacguggaggagugcuccugcuacccccgcuacccgggggugcggugcgucugccgcgacaacuggaagggcucgaaccggcccaucguggacaucaacgugaaggacuacuccaucgucagcuccuacgugugcucgggccucgugggggacacgccccgcaagaacgacuccagcuccucguccuacugccagaaccccaacaacgagaagggcagccacggggucaagggcugggccuucgacgacgggaacgacguguggaugggccggaccaucuccgaggagcugcgcucgggcuacgagaccuucaaggucaucgggggcugguccaagccgaacagcaagcugcagaucaaccgccaggugaucguggaccgggggaaccgguccggcuacucggggaucuucagcgucgagggcaaguccugcaucaaccgcugcuucuacguggagcucauccggggccgcaagcaggagaccgaggugugguggacgucgaacuccaucgucguguucugcgggaccagcggcaccuacgggaccggcuccuggcccgacggggccgacaucaaccugaugcccaucuga

SEQ ID NO: 17622 - RNA, 1410 nt, Artificial Sequence
  derived and/or modified CDS sequence (AUadapt) from InfluenzaA__ABG79977__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggcgaugcucugcgagcccacgaucaucgagcgcaacaucaccgagaucguguaccugaccaacaccacgaucgagaaggagaucugccccaagcuggccgaguaccggaacugguccaagccgcagugcaagaucaccggguucgcccccuucagcaaggacaacuccauccgccucucggccggcggggacaucugggucacccgggagcccuacguguccugcgaccccggcaagugcuaccaguucgcccuggggcagggcaccacgcugaacaaccgccacagcaacgacaccgugcacgaccggaccccguaccgcacccuccugaugaacgagcugggcguccccuuccaccucgggacgaagcaggucugcaucgcgugguccucguccucgugccacgacggcaaggccuggcugcacgugugcgugaccgggcacgacgagaacgccaccgccuccuucaucuacgacggccggcugguggacagcaucggguccuggucgaagaacauccuccgcacccaggaguccgagugcgugugcaucaacggcacgugcaccgucgugaugaccgacggcagcgcguccgaccgggccgacaccaagauccuguucaucgaggaggggaagaucgugcacaucucgccccugucgggcuccgcccagcacgucgaggagugcagcugcuacccccgcuacccgggggugcggugcgugugccgcgacaacuggaagggcuccaaccggcccaucgucgacaucaacgugaaggacuacucgaucguguccagcuacgucugcuccggccucgugggggacacgccccgcaagaacgacucguccucguccagcuacugcuggaaccccaacaacgagaagggcgggcacggcgugaaggggugggccuucgacgacggcaacgacgucuggaugggccggaccaucuccgaggagucgcgcuccggguacgagaccuucaaggugaucggcggguggagcaagccgaacuccaagcugcagaucaaccggcaggucaucguggaccgcggcaaccggucgggguacuccggcaucuucucgguggagggcaagagcugcaucaaccgcugcuucuacgucgagcugauccgggggcgcaagcaggagaccgaggugugguggacguccaacucgaucguggucuucugcggcaccuccgggaccuacggcaccgggagcuggcccgacggcgccgacaucaaccucaugcccaucuga

SEQ ID NO: 17623 - RNA, 1410 nt, Artificial Sequence; identical to SEQ ID NO: 17515
  derived and/or modified CDS sequence (AUadapt) from InfluenzaA__ABG79988__NA

SEQ ID NO: 17624 - RNA, 1410 nt, Artificial Sequence; identical to SEQ ID NO: 17515
  derived and/or modified CDS sequence (AUadapt) from InfluenzaA__ABG79999__NA

SEQ ID NO: 17625 - RNA, 1410 nt, Artificial Sequence
  derived and/or modified CDS sequence (AUadapt) from InfluenzaA__ABG80010__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggaagggcaccacgcugaacaaccgccacagcaacgacaccguccacgaccggaccccguaccgcacccuccugaugaacgagcugggcgugcccuuccaccucgggacgaagcaggucugcaucgccugguccucguccagcugccacgacggcaaggcguggcugcacgugugcgugaccgggcacgacgagaacgccaccgccuccuucaucuacgacggccggcugguggacucgaucggguccuggucgaagaacauccuccgcacccaggaguccgagugcgucugcaucaacggcacgugcaccguggugaugaccgacggcagcgccuccgaccgggcggacaccaagauccuguucaucgaggaggggaagaucguccacaucucgccccugagcggcuccgcccagcacguggaggagugcucgugcuacccccgcuacccgggggugcggugcgucugccgcgacaacuggaagggcuccaaccggcccaucguggacaucaacgugaaggacuacagcaucgucuccucguacgugugcuccggccucgugggggacacgccccgcaagaacgacagcuccucguccucguacugcuggaaccccaacaacgagaagggcgggcacggcgucaaggggugggccuucgacgacggcaacgacguguggaugggccggaccaucuccgaggagagccgcuccggguacgagaccuucaaggucaucggcggguggucgaagccgaacuccaagcugcagaucaaccgccaggugaucguggaccggggcaaccggagcggguacuccggcaucuucucggucgagggcaagagcugcaucaaccgcugcuucuacguggagcugauccgggggcgcaagcaggagaccgaggugugguggacguccaacucgaucgucguguucugcggcaccuccgggaccuacggcaccgggagcuggcccgacggcgccgacaucaaccucaugcccaucuga

SEQ ID NO: 17626 - RNA, 1410 nt, Artificial Sequence; identical to SEQ ID NO: 17515
  derived and/or modified CDS sequence (AUadapt) from InfluenzaA__ABG80021__NA

SEQ ID NO: 17627 - RNA, 1410 nt, Artificial Sequence
  derived and/or modified CDS sequence (AUadapt) from InfluenzaA__ABG80032__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccucguccagcugccacgacggcaaggcguggcugcacgugugcgugaccgggcacgacgagaacgccaccgccuccaucaucuacgacggccggcugguggacucgaucuccucgugguccaagaacauccuccgcacccaggagagcgagugcgucugcaucaacgggacgugcaccguggugaugaccgacggcuccgccucggagcgggcggacaccaagauccuguucaucgaggagggcaagaucguccacaucagcccccuguccgggucggcccagcacguggaggagugcuccugcuacccccgcuacccgggcgugcggugcgucugccgcgacaacuggaaggggagcaaccggcccaucguggacaucaacgugaaggacuacuccaucgucucguccuacgugugcagcggccucgugggcgacacgccccgcaagaacgacuccucguccucguccuacugccugaaccccaacaacgaggagggcgggcacggggucaagggcugggccuucgacgacgggaacgacguguggaugggccggaccaucagcgagaagcugcgcuccggcuacgagaccuucaaggucaucgggggcuggucgaagccgaacuccaagcuccagaucaaccgccaggugaucguggaccgggggaaccggagcggcuacuccgggaucuucucggucgagggcaagagcugcgugaaccgcugcuucuacguggagcugauccggggccgcaagcaggagaccgaggucugguggacguccaacucgaucgugguguucugcgggaccuccggcaccuacgggaccggcagcuggcccgacggggccgacaucaaccugaugcccaucuga

SEQ ID NO: 17628 - RNA, 1410 nt, Artificial Sequence; identical to SEQ ID NO: 17502
  derived and/or modified CDS sequence (AUadapt) from InfluenzaA__ABG80043__NA

SEQ ID NO: 17629 - RNA, 1410 nt, Artificial Sequence; identical to SEQ ID NO: 17515
  derived and/or modified CDS sequence (AUadapt) from InfluenzaA__ABG80054__NA

SEQ ID NO: 17630 - RNA, 1410 nt, Artificial Sequence; identical to SEQ ID NO: 17502
  derived and/or modified CDS sequence (AUadapt) from InfluenzaA__ABG80065__NA

SEQ ID NO: 17631 - RNA, 1410 nt, Artificial Sequence
  derived and/or modified CDS sequence (AUadapt) from InfluenzaA__ABG80076__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccucguccucgugccacgacggcaaggcguggcugcacgugugcgugaccgggcacgacgagaacgccaccgccuccuucaucuacgacggccggcugguggacagcaucggguccuggucgaagaacauccuccgcacccaggaguccgagugcgucugcaucaacggcacgugcaccguggugaugaccgacggcagcgccuccgagcgggcggacaccaagauccuguucaucgaggaggggaagaucguccacaucucgccccugagcggcuccgcccagcacguggaggagugcucgugcuacccccgcuacccgggggugcggugcgucugccgcgacaacuggaagggcuccaaccggcccaucguggacaucaacgugaaggacuacucgaucgucuccagcuacgugugcuccggccucgugggggacacgccccgcaagaacgacucguccagcuccucguacugccggaaccccaacaacgagaagggcucccacggggucaagggcugggccuucgacgacgggaacgacguguggaugggccgcaccaucucggaggagcugcgguccggcuacgagaccuucaaggucaucgggggcuggagcaagccgaacuccaagcugcagaucaaccgccaggugaucguggaccgggggaaccgcucgggcuacuccgggaucuucagcgucgagggcaagaacugcaucaaccggugcuucuacguggagcucauccgcggccgcaagcaggagaccgaggugugguggacgucgaacuccaucgucguguucugcgggaccagcggcaccuacgggaccggcuccuggcccgacggggccgacaucaaccugaugcccaucuga

SEQ ID NO: 17632 - RNA, 1410 nt, Artificial Sequence
  derived and/or modified CDS sequence (AUadapt) from InfluenzaA__ABG80087__NA
augaaccccaaccagaagaucaucaccaucggcucggugucccugaccaucgccacgaucugcuuccucaugcagaucgccguccuggugaccaccgugacccugcacuucaagcaguacgagugcaacucgccgcccuccaaccaggucaugcucugcgagcccacgaucaucgagcgcaacaucaccgagaucguguaccugaccaacaccacgaucgagaaggagaucugccccaagcuggcggaguaccggaacuggagcaagccgcagugcaagaucaccggguucgcccccuucuccaaggacaacucgauccgccucuccgccggcggggacaucugggugacccgggagcccuacgucagcugcgaccccggcaagugcuaccaguucgcccuggggcagggcaccacgcugaacaaccgccacuccaacgacaccgugcacgaccggaccccguaccgcacccuccugaugaacgagcugggcgugcccuuccaccucgggacgaagcaggucugcauggccuggucguccagcuccugccacgacggcaaggcguggcugcacgugugcgugaccgggcacgacgagaacgccaccgccucguucaucuacgacggccggcuggucgacuccaucgggagcugguccaagaacauccuccgcacccaggagucggagugcgugugcaucaacggcacgugcaccguggucaugaccgacggcuccgccagcgagcgggcggacaccaagauccuguucaucgaggaggggaagaucgugcacaucucgccccuguccggcagcgcccagcacguggaggagugcuccugcuacccccgcuacccggggguccggugcgugugccgcgacaacuggaagggcucgaaccggcccaucguggacaucaacgucaaggacuacuccaucgugagcuccuacgugugcucgggccucgucggggacacgccccgcaagaacgacuccagcuccucguccuacugccggaaccccaacaacgagaagggcagccacggggugaagggcugggccuucgacgacgggaacgacgucuggaugggccgcaccaucuccgaggagcugcggucgggcuacgagaccuucaaggugaucgggggcugguccaagccgaacagcaagcugcagaucaaccgccaggugaucgucgaccgggggaaccgcuccggcuacucggggaucuucagcguggagggcaaguccugcaucaaccggugcuucuacguggagcucauccgcggccgcaagcaggagaccgaggucugguggacgucgaacuccaucgugguguucugcgggaccagcggcaccuacgggaccggcuccuggcccgacggggccgacaucaaccugaugcccaucuga

SEQ ID NO: 17633 - RNA, 1410 nt, Artificial Sequence; identical to SEQ ID NO: 17559
  derived and/or modified CDS sequence (AUadapt) from InfluenzaA__ABG80098__NA

SEQ ID NO: 17634 - RNA, 1410 nt, Artificial Sequence; identical to SEQ ID NO: 17503
  derived and/or modified CDS sequence (AUadapt) from InfluenzaA__ABG80109__NA

SEQ ID NO: 17635 - RNA, 1410 nt, Artificial Sequence
  derived and/or modified CDS sequence (AUadapt) from InfluenzaA__ABG80120__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccuccaaccaggugaugcucugcgagcccacgaucaucgagcgcaacaucaccgagaucgucuaccugaccaacaccacgaucgagaaggagaucugccccaagcuggcggaguaccggaacuggagcaagccgcagugcaagaucaccggguucgcccccuucuccaaggacaacucgauccgccucuccgccggcggggacaucugggugacccgggagcccuacgugagcugcgaccccggcaagugcuaccaguucgcccuggggcagggcaccacgcugaacaaccgccacuccaacgacaccguccacgaccggaccccguaccgcacccuccugaugaacgagcugggcgugcccuuccaccucgggacgaagcaggucugcaucgccuggucguccagcuccugccacgacggcaaggcguggcugcacgugugcgugaccgggcacgacgagaacgccaccgccucguucaucuacgacggccggcugguggacuccaucgggagcugguccaagaacauccuccgcacccaggagucggagugcaucugcaucaacggcacgugcaccgucgugaugaccgacggcuccgccagcgagcgggcggacaccaagauccuguucaucgaggaggggaagaucgugcacaucucgccccuguccggcagcgcccagcacgucgaggagugcuccugcuacccccgcuacccgggggugcggugcgugugccgcgacaacuggaagggcucgaaccggcccaucgucgacaucaacgugaaggacuacuccaucgugagcuccuacgucugcucgggccucgugggggacacgccccgcaagaacgacuccagcuccucguccuacugccggaaccccaacaacgagaagggcagccacggggugaagggcugggccuucgacgacgggaacgacgucuggaugggccgcaccaucuccgaggagcugcggucgggcuacgagaccuucaaggugaucgggggcugguccaagccgaacagcaagcugcagaucaaccgccaggucaucguggaccgggggaaccgcuccggcuacucggggaucuucagcguggagggcaaguccugcaucaaccggugcuucuacgucgagcucauccgcggccgcaagcaggagaccgaggugugguggacgucgaacuccaucguggucuucugcgggaccagcggcaccuacgggaccggcuccuggcccgacggggccgacaucaaccugaugcccaucuga

SEQ ID NO: 17636 - RNA, 1410 nt, Artificial Sequence
  derived and/or modified CDS sequence (AUadapt) from InfluenzaA__ABG80131__NA
augaaccccaaccagaagaucaucaccaucggcucggugucccugaccaucgccacgaucugcuuccucaugcagaucgccaucauggucaccaccgugacccugcacuucaagcaguacgagugcaacucgccgcccuccaaccaggugaugcugugcgagcccacgaucaucgagcgcaacaucaccgagaucgucuaccucaccaacaccacgaucgagaaggagaucugccccaagcuggcggaguaccggaacuggagcaagccgcagugcaagaucaccggguucgcccccuucuccaaggacaacucgauccgccuguccgccggcggggacaucugggugacccgggagcccuacgugagcugcgaccccggcaagugcuaccaguucgcccucgggcagggcaccacgcugaacaaccgccacuccaacgacaccguccacgaccggaccccguaccgcacccugcucaugaacgagcugggcgugcccuuccaccuggggacgaagcaggucugcaucgccuggucguccagcuccugccacgacggcaaggcguggcuccacgugugcgugaccgggcacgacgagaacgccaccgccucguucaucuacgacggccggcugguggacuccaucgggagcugguccaagaacauccugcgcacccaggagucggagugcgucugcaucaacggcacgugcaccguggugaugaccgacggcuccgccagcgagcgggcggacaccaagauccucuucaucgaggaggggaagaucguccacaucucgccccuguccggcagcgcccagcacguggaggagugcuccugcuacccccgcuacccgggggugcggugcgucugccgcgacaacuggaagggcucgaaccggcccaucguggacaucaacgugaaggacuacuccaucgucagcuccuacgugugcucgggccuggugggggacacgccccgcaagaacgacuccagcuccucguccuacugccggaaccccaacaacgagaagggcagccacggggucaagggcugggccuucgacgacgggaacgacguguggaugggccgcaccaucuccgaggagcuccggucgggcuacgagaccuucaaggucaucgggggcugguccaagccgaacagcaagcugcagaucaaccgccaggugaucguggaccgggggaaccgcuccggcuacucggggaucuucagcgucgagggcaaguccugcaucaaccggugcuucuacguggagcugauccgcggccgcaagcaggagaccgaggugugguggacgucgaacuccaucgucguguucugcgggaccagcggcaccuacgggaccggcuccuggcccgacggggccgacaucaaccucaugcccaucuga

SEQ ID NO: 17637 - RNA, 1410 nt, Artificial Sequence; identical to SEQ ID NO: 17503
  derived and/or modified CDS sequence (AUadapt) from InfluenzaA__ABG80142__NA

SEQ ID NO: 17638 - RNA, 1410 nt, Artificial Sequence; identical to SEQ ID NO: 17559
  derived and/or modified CDS sequence (AUadapt) from InfluenzaA__ABG80153__NA

SEQ ID NO: 17639 - RNA, 1410 nt, Artificial Sequence; identical to SEQ ID NO: 17503
  derived and/or modified CDS sequence (AUadapt) from InfluenzaA__ABG80164__NA

SEQ ID NO: 17640 - RNA, 1413 nt, Artificial Sequence; identical to SEQ ID NO: 17230
  derived and/or modified CDS sequence (AUadapt) from InfluenzaA__ABG80186__NA

SEQ ID NO: 17641 - RNA, 1410 nt, Artificial Sequence; identical to SEQ ID NO: 16463
  derived and/or modified CDS sequence (AUadapt) from InfluenzaA__ABG80197__NA

SEQ ID NO: 17642 - RNA, 1410 nt, Artificial Sequence; identical to SEQ ID NO: 16655
  derived and/or modified CDS sequence (AUadapt) from InfluenzaA__ABG80219__NA
